US010667523B2

(12) United States Patent
Ambrose et al.

(10) Patent No.: US 10,667,523 B2
(45) Date of Patent: Jun. 2, 2020

(54) SEED ENDOPHYTES ACROSS CULTIVARS AND SPECIES, ASSOCIATED COMPOSITIONS, AND METHODS OF USE THEREOF

(71) Applicants: INDIGO AGRICULTURE, INC., Boston, MA (US); INDIGO AG, INC., Boston, MA (US)

(72) Inventors: Karen V. Ambrose, Cambridge, MA (US); Nathan A. Billings, Topsfield, MA (US); Slavica Djonovic, Malden, MA (US); Richard Bailey Flavell, Thousand Oaks, CA (US); Trudi A. Gulick, Topsfield, MA (US); David Morris Johnston, Cambridge, MA (US); Jonathan W. Leff, Cambridge, MA (US); Stephanie M. Liva, Arlington, MA (US); Jeffrey Lyford, Hollis, NH (US); Geoffrey Von Maltzahn, Boston, MA (US); Luis Miguel Marquez, Belmont, MA (US); Yves Alain Millet, Newtonville, MA (US); Craig Sadowski, Somerville, MA (US); Phillip Samayoa, Cambridge, MA (US); Gerardo V. Toledo, Belmont, MA (US); David R. Weisman, Somerville, MA (US); Xuecheng Zhang, Newton, MA (US)

(73) Assignee: Indigo Ag, Inc., Boston, MA (US)

(*) Notice: Subject to any disclaimer, the term of this patent is extended or adjusted under 35 U.S.C. 154(b) by 7 days.

(21) Appl. No.: 15/540,961

(22) PCT Filed: Dec. 30, 2015

(86) PCT No.: PCT/US2015/068206

§ 371 (c)(1),
(2) Date: Jun. 29, 2017

(87) PCT Pub. No.: WO2016/109758

PCT Pub. Date: Jul. 7, 2016

(65) Prior Publication Data

US 2018/0020677 A1 Jan. 25, 2018

Related U.S. Application Data

(60) Provisional application No. 62/098,296, filed on Dec. 30, 2014, provisional application No. 62/098,298, filed on Dec. 30, 2014, provisional application No. 62/098,299, filed on Dec. 30, 2014, provisional application No. 62/098,302, filed on Dec. 30, 2014, provisional application No. 62/098,304, filed on Dec. 30, 2014, provisional application No. 62/156,021, filed on May 1, 2015, provisional application No. 62/156,028, filed on May 1, 2015.

(30) Foreign Application Priority Data

Jun. 26, 2015 (WO) .................. PCT/US2015/03818

(51) Int. Cl.

| | |
|---|---|
| ***A01N 63/04*** | (2006.01) |
| ***A01N 63/00*** | (2020.01) |
| ***C12N 1/20*** | (2006.01) |
| ***C12N 1/14*** | (2006.01) |
| ***C05F 11/08*** | (2006.01) |
| ***A01N 37/46*** | (2006.01) |
| ***A01N 63/02*** | (2006.01) |

(52) U.S. Cl.

CPC ............. *A01N 63/04* (2013.01); *A01N 37/46* (2013.01); *A01N 63/02* (2013.01); *C05F 11/08* (2013.01); *Y02W 30/47* (2015.05)

(58) Field of Classification Search

None
See application file for complete search history.

(56) References Cited

U.S. PATENT DOCUMENTS

| | | | |
|---|---|---|---|
| 2,200,532 | A | 5/1940 | Sherman |
| 4,940,834 | A | 7/1990 | Hurley et al. |
| 5,041,290 | A | 8/1991 | Gindrat et al. |
| 5,113,619 | A | 5/1992 | Leps et al. |
| 5,229,291 | A | 7/1993 | Nielsen et al. |
| 5,292,507 | A | 3/1994 | Charley |
| 5,415,672 | A | 5/1995 | Fahey et al. |
| 5,730,973 | A | 3/1998 | Morales et al. |
| 5,919,447 | A | 7/1999 | Marrone et al. |
| 5,994,117 | A | 11/1999 | Bacon et al. |

(Continued)

FOREIGN PATENT DOCUMENTS

| | | |
|---|---|---|
| CA | 1041788 | 11/1978 |
| CA | 1229497 | 11/1987 |

(Continued)

OTHER PUBLICATIONS

Yashiro et al. Effect of Streptomycin Treatment on Bacterial Community Structure in the Apple Phyllosphere. May 21, 2012. PLOS ONE. 10 pages. (Year: 2012).*
Sequence Alignment of JQ047949 with Instant SEQ ID No. 2. Search conducted on Jan. 2, 2019. 1 page. (Year: 2019).*
U'Ren et al. Community Analysis Reveals Close Affinities Between Endophytic and Endolichenic Fungi in Mosses and Lichens. Published online Jul. 13, 2010, vol. 60, pp. 340-353. (Year: 2010).*
Sequence Alignment of SEQ ID No. 446 with HM123598; Search conducted on Mar. 15, 2019; 3 pages. (Year: 2019).*
PCT Invitation to Pay Additional Fees, PCT Application No. PCT/CA2013/000091, dated Mar. 27, 2013, 2 Pages.

(Continued)

*Primary Examiner* — Channing S Mahatan
(74) *Attorney, Agent, or Firm* — Goodwin Procter LLP

(57) ABSTRACT

Materials and methods for improving plant traits and for providing plant fitness benefits are provided. In some embodiments, the materials, and methods employing the same, can comprise endophytes.

28 Claims, 3 Drawing Sheets

Specification includes a Sequence Listing.

(56) References Cited

U.S. PATENT DOCUMENTS

| | | | |
|---|---|---|---|
| 6,072,107 | A | 6/2000 | Latch et al. |
| 6,077,505 | A | 6/2000 | Parke et al. |
| 6,337,431 | B1 | 1/2002 | Tricoli et al. |
| 6,495,133 | B1 | 12/2002 | Xue |
| 6,602,500 | B1 | 8/2003 | Kharbanda et al. |
| 6,681,186 | B1 | 1/2004 | Denisov et al. |
| 6,689,880 | B2 | 2/2004 | Chen et al. |
| 6,823,623 | B2 | 11/2004 | Minato et al. |
| 7,037,879 | B2 | 5/2006 | Imada et al. |
| 7,084,331 | B2 | 8/2006 | Isawa et al. |
| 7,335,816 | B2 | 2/2008 | Kraus et al. |
| 7,341,868 | B2 | 3/2008 | Chopade et al. |
| 7,485,451 | B2 | 2/2009 | VanderGheynst et al. |
| 7,555,990 | B2 | 7/2009 | Beaujot |
| 7,632,985 | B2 | 12/2009 | Malven et al. |
| 7,763,420 | B2 | 7/2010 | Stritzker et al. |
| 7,906,313 | B2 | 3/2011 | Henson et al. |
| 7,977,550 | B2 | 7/2011 | West et al. |
| 8,143,045 | B2 | 3/2012 | Miansnikov et al. |
| 8,455,198 | B2 | 6/2013 | Gao et al. |
| 8,455,395 | B2 | 6/2013 | Miller et al. |
| 8,465,963 | B2 | 6/2013 | Rolston et al. |
| 8,728,459 | B2 | 5/2014 | Isawa et al. |
| 8,975,489 | B2 | 3/2015 | Craven |
| 9,049,814 | B2 | 6/2015 | Marx et al. |
| 9,113,636 | B2 | 8/2015 | von Maltzahn et al. |
| 9,277,751 | B2 | 3/2016 | Sword |
| 9,288,995 | B2 | 3/2016 | von Maltzahn et al. |
| 9,295,263 | B2 | 3/2016 | von Maltzahn et al. |
| 9,364,005 | B2 | 6/2016 | Mitter et al. |
| 9,408,394 | B2 | 8/2016 | von Maltzahn et al. |
| 9,532,572 | B2 | 1/2017 | von Maltzahn et al. |
| 9,532,573 | B2 | 1/2017 | von Maltzahn et al. |
| 9,545,111 | B2 | 1/2017 | Sword |
| 9,622,485 | B2 | 4/2017 | von Maltzahn et al. |
| 9,652,840 | B1 | 5/2017 | Shriver et al. |
| 9,687,001 | B2 | 6/2017 | Vujanovic et al. |
| 9,756,865 | B2 | 9/2017 | Sword |
| 10,058,101 | B2 | 8/2018 | von Maltzahn et al. |
| 10,076,120 | B2 | 9/2018 | von Maltzahn et al. |
| 10,104,862 | B2 | 10/2018 | Vujanovic et al. |
| 2005/0072047 | A1 | 4/2005 | Conkling et al. |
| 2006/0046246 | A1 | 3/2006 | Zeng et al. |
| 2007/0028318 | A1 | 2/2007 | Livore et al. |
| 2007/0055456 | A1 | 3/2007 | Raftery et al. |
| 2007/0142226 | A1 | 6/2007 | Franco |
| 2007/0292953 | A1 | 12/2007 | Mankin et al. |
| 2008/0229441 | A1 | 9/2008 | Young et al. |
| 2008/0289060 | A1 | 11/2008 | De Beuckeleer et al. |
| 2009/0155214 | A1 | 6/2009 | Isawa et al. |
| 2010/0064392 | A1 | 3/2010 | Yang et al. |
| 2010/0095396 | A1 | 4/2010 | Voeste et al. |
| 2010/0205690 | A1 | 8/2010 | Biasing et al. |
| 2010/0227357 | A1 | 9/2010 | Redman et al. |
| 2011/0182862 | A1 | 7/2011 | Green et al. |
| 2012/0108431 | A1 | 5/2012 | Williams et al. |
| 2012/0131696 | A1 | 5/2012 | Aayal et al. |
| 2012/0144533 | A1 | 6/2012 | Craven |
| 2012/0149571 | A1 | 6/2012 | Kloepper et al. |
| 2012/0178624 | A1 | 7/2012 | Kaminskyj et al. |
| 2012/0324599 | A1 | 12/2012 | Kerns et al. |
| 2013/0031673 | A1 | 1/2013 | Grandlic et al. |
| 2013/0071425 | A1 | 3/2013 | Vidal et al. |
| 2013/0079225 | A1 | 3/2013 | Smith et al. |
| 2013/0150240 | A1 | 6/2013 | Newman et al. |
| 2013/0233501 | A1 | 9/2013 | Van Zyl et al. |
| 2014/0020136 | A1 | 1/2014 | Van Der Wolf et al. |
| 2014/0109249 | A1 | 4/2014 | Turner et al. |
| 2014/0115731 | A1 | 4/2014 | Turner et al. |
| 2014/0147425 | A1 | 5/2014 | Henn et al. |
| 2014/0342905 | A1 | 11/2014 | Bullis et al. |
| 2015/0020239 | A1 | 1/2015 | von Maltzahn et al. |
| 2015/0033420 | A1 | 1/2015 | Rodriguez et al. |
| 2015/0126365 | A1 | 5/2015 | Sword |
| 2015/0230478 | A1 | 8/2015 | Vujanovic et al. |
| 2015/0242970 | A1 | 8/2015 | Avey et al. |
| 2015/0335029 | A1 | 11/2015 | Mitter et al. |
| 2015/0366217 | A1 | 12/2015 | Vujanovic et al. |
| 2015/0368607 | A1 | 12/2015 | Arnold et al. |
| 2015/0370935 | A1 | 12/2015 | Starr |
| 2015/0373993 | A1 | 12/2015 | von Maltzahn et al. |
| 2016/0021891 | A1 | 1/2016 | von Maltzahn et al. |
| 2016/0150796 | A1 | 6/2016 | von Maltzahn et al. |
| 2016/0174570 | A1 | 6/2016 | Vujanovic et al. |
| 2016/0192662 | A1 | 7/2016 | Sword |
| 2016/0205947 | A1 | 7/2016 | Sword |
| 2016/0235074 | A1 | 8/2016 | von Maltzahn et al. |
| 2016/0255844 | A1 | 9/2016 | Mitter et al. |
| 2016/0260021 | A1 | 9/2016 | Marek |
| 2016/0286821 | A1 | 10/2016 | Sword |
| 2016/0290918 | A1 | 10/2016 | Xu et al. |
| 2016/0316760 | A1 | 11/2016 | Ambrose et al. |
| 2016/0316763 | A1 | 11/2016 | Sword |
| 2016/0330976 | A1 | 11/2016 | Mitter et al. |
| 2016/0338360 | A1 | 11/2016 | Mitter et al. |
| 2016/0366892 | A1 | 12/2016 | Ambrose et al. |
| 2017/0020138 | A1 | 1/2017 | Von Maltzahn et al. |
| 2017/0164619 | A1 | 6/2017 | von Maltzahn et al. |
| 2017/0164620 | A1 | 6/2017 | von Maltzahn et al. |
| 2017/0215358 | A1 | 8/2017 | Franco et al. |
| 2017/0223967 | A1 | 8/2017 | Mitter et al. |
| 2018/0092365 | A1 | 4/2018 | Sword |
| 2018/0153174 | A1 | 6/2018 | Riley et al. |
| 2018/0177196 | A1 | 6/2018 | Sword |
| 2018/0213800 | A1 | 8/2018 | Djonovic et al. |
| 2018/0249716 | A1 | 9/2018 | Riley |
| 2018/0251776 | A1 | 9/2018 | Riley |

FOREIGN PATENT DOCUMENTS

| | | | |
|---|---|---|---|
| CA | 2562175 | | 1/2013 |
| CN | 1604732 | | 4/2005 |
| CN | 101311262 | A | 11/2008 |
| CN | 101423810 | A | 5/2009 |
| CN | 101570738 | | 11/2009 |
| CN | 101693881 | A | 4/2010 |
| CN | 102168022 | A | 8/2011 |
| CN | 102352327 | A | 2/2012 |
| CN | 102010835 | B | 4/2012 |
| CN | 102533601 | B | 10/2013 |
| CN | 103642725 | A | 3/2014 |
| CN | 104560742 | A | 1/2015 |
| CN | 104388356 | A | 3/2015 |
| EP | 0192342 | | 8/1986 |
| EP | 0223662 | | 5/1987 |
| EP | 0378000 | | 7/1990 |
| EP | 0494802 | | 7/1992 |
| EP | 0818135 | | 1/1998 |
| EP | 1621632 | | 2/2006 |
| EP | 1935245 | | 6/2008 |
| EP | 2676536 | | 12/2013 |
| JP | 2009/072168 | | 4/2009 |
| KR | 20100114806 | A | 10/2010 |
| KR | 101091151 | | 12/2011 |
| KR | 20130023491 | | 3/2013 |
| WO | WO 1988/009114 | | 1/1988 |
| WO | WO 1994/016076 | | 7/1994 |
| WO | WO 2000/029607 | | 5/2000 |
| WO | WO 2001/083697 | | 11/2001 |
| WO | WO 2001/083818 | | 11/2001 |
| WO | WO 2002/065836 | | 8/2002 |
| WO | WO 2004/046357 | | 6/2004 |
| WO | WO 2005/003328 | | 1/2005 |
| WO | WO 2007/021200 | | 2/2007 |
| WO | WO 2007/107000 | | 9/2007 |
| WO | WO 2008/103422 | | 8/2008 |
| WO | WO 2009/012480 | A2 | 1/2009 |
| WO | WO 2009/078710 | A1 | 6/2009 |
| WO | WO 2009/126473 | A1 | 10/2009 |
| WO | WO 2010/109436 | | 9/2010 |
| WO | WO 2010/115156 | | 10/2010 |
| WO | WO 2011/001127 | | 1/2011 |
| WO | WO 2011/082455 | | 7/2011 |
| WO | WO 2011/112781 | | 9/2011 |

(56) References Cited

FOREIGN PATENT DOCUMENTS

| | | |
|---|---|---|
| WO | WO 2011/117351 | 9/2011 |
| WO | WO 2012/034996 | 3/2012 |
| WO | WO 2013/016361 | 1/2013 |
| WO | WO 2013/029112 | 3/2013 |
| WO | WO 2013/090628 | 6/2013 |
| WO | WO 2013/122473 | 8/2013 |
| WO | WO 2013/177615 | 12/2013 |
| WO | WO 2013/190082 | 12/2013 |
| WO | WO 2014/046553 | 3/2014 |
| WO | WO 2014/082950 | 6/2014 |
| WO | WO 2014/121366 | 8/2014 |
| WO | WO 2014/206953 | 12/2014 |
| WO | WO 2014/210372 | 12/2014 |
| WO | WO 2015/035099 | 3/2015 |
| WO | WO 2015/069938 | 5/2015 |
| WO | WO 2015/100431 | 7/2015 |
| WO | WO 2015/100432 | 7/2015 |
| WO | WO 2015/192172 | 12/2015 |
| WO | WO 2015/200852 | 12/2015 |
| WO | WO 2015/200902 | 12/2015 |
| WO | WO 2016/090212 | 6/2016 |
| WO | WO 2016/109758 | 7/2016 |
| WO | WO 2016/179046 | 11/2016 |
| WO | WO 2016/179047 | 11/2016 |
| WO | WO 2016/200987 | 12/2016 |
| WO | WO 2016/057991 | 3/2019 |

OTHER PUBLICATIONS

PCT International Search Report and Written Opinion for PCT/CA2013/000091, dated Sep. 20, 2013, 17 Pages.
PCT International Search Report and Written Opinion for PCT/EP2013/062976, dated Dec. 22, 2014, 9 Pages.
PCT International Search Report, Application No. PCT/US2014/044427, Dec. 3, 2014, 9 Pages.
PCT International Search Report and Written Opinion, Application No. PCT/US2014/054160, dated Dec. 9, 2014, 21 Pages.
PCT Invitation to Pay Additional Fees, PCT Application No. PCT/US2014/064411, dated Feb. 5, 2015, 2 Pages.
PCT International Search Report and Written Opinion, International Application No. PCT/US2014/064411, dated Mar. 27, 2015, 15 Pages.
PCT Invitation to Pay Additional Fees, PCT Application No. PCT/US2014/072399, dated Apr. 14, 2015, 2 Pages.
PCT International Search Report and Written Opinion, International Application No. PCT/US2014/072399, dated Jun. 26, 2015, 22 Pages.
PCT Invitation to Pay Additional Fees, PCT Application No. PCT/US2014/072400, dated Apr. 16, 2015, 6 Pages.
PCT International Search Report and Written Opinion, Application No. PCT/US2014/072400, dated Jul. 8, 2015, 38 Pages.
PCT International Search Report and Written Opinion, Application No. PCT/AU2014/000360, dated Aug. 5, 2015, 12 Pages.
PCT Invitation to Pay Additional Fees, PCT Application No. PCT/US2015/038110, Sep. 22, 2015, 8 Pages.
PCT Invitation to Pay Additional Fees, PCT Application No. PCT/US2015/038187, dated Oct. 14, 2015, 5 Pages.
PCT International Search Report and Written Opinion, PCT Application No. PCT/US2015/038110, dated Dec. 11, 2015, 36 Pages.
PCT International Search Report and Written Opinion, PCT Application No. PCT/US2015/038187, dated Jan. 22, 2016, 36 Pages.
PCT Invitation to Pay Additional Fees, PCT Application No. PCT/US2015/068206, dated Apr. 12, 2016, 5 Pages.
PCT International Search Report and Written Opinion, PCT Application No. PCT/US2015/068206, dated Jun. 27, 2016, 20 Pages.
PCT International Search Report and Written Opinion, PCT Application No. PCT/US2016/030292, dated Aug. 12, 2016, 20 Pages.
PCT International Preliminary Report on Patentability, PCT Application No. PCT/US2016/030292, dated Aug. 2, 2017, 23 Pages.
PCT International Search Report and Written Opinion, PCT Application No. PCT/US2016/030293, dated Aug. 11, 2016, 23 Pages.
PCT International Search Report and Written Opinion, PCT Application No. PCT/US2016/036504, dated Nov. 4, 2016, 18 Pages.
PCT International Search Report and Written Opinion, PCT Application No. PCT/US2016/039191, dated Nov. 29, 2016, 20 Pages.
PCT International Search Report and Written Opinion, PCT Application No. PCT/US2016/068144, dated May 18, 2017, 30 Pages.
Canadian Patent Office, Office Action, Canadian Patent Application No. 2,916,678, dated Feb. 8, 2017, 8 Pages.
Canadian Patent Office, Office Action, Canadian Patent Application No. 2,935,218, dated Jun. 13, 2017, 5 Pages.
Chinese Patent Office, Office Action, Chinese Patent Application No. 201480072142.7, dated Apr. 25, 2017, 14 Pages. (with English translation).
European Patent Office, Supplementary Partial European Search Report, European Patent Application No. 13874703.5, dated Jun. 21, 2016, 3 Pages.
European Patent Office, Supplementary European Search Report, European Patent Application No. 13874703.5, dated Oct. 21, 2016, 16 Pages.
European Patent Office, Supplementary European Search Report, European Patent Application No. 14860187.5, dated May 24, 2017, 9 Pages.
European Patent Office, Supplementary European Search Report, European Patent Application No. 14874589.6, dated Jul. 11, 2017, 9 Pages.
European Patent Office, Examination Report, European Patent Application No. 14748326.7, dated Jul. 19, 2017, 4 Pages.
Intellectual Property Australia, Examination Report for Australian Patent Application No. 2016202480, dated Apr. 28, 2016, 2 Pages.
Intellectual Property Australia, Examination Report for Australian Patent Application No. 2014346664, dated Nov. 24, 2016, 3 Pages.
Intellectual Property Australia, Examination Report for Australian Patent Application No. 2014315191, dated Jul. 15, 2017, 6 Pages.
Intellectual Property Australia, Examination Report for Australian Patent Application No. 2015279600, dated Jul. 21, 2017, 7 Pages.
Intellectual Property Australia, Examination Report for Australian Patent Application No. 2015278238, dated Jul. 24, 2017, 3 Pages.
New Zealand Intellectual Property Office, First Examination Report, New Zealand Patent Application No. 715728, dated May 10, 2016, 4 Pages.
New Zealand Intellectual Property Office, First Examination Report, New Zealand Patent Application No. 715728, dated Dec. 5, 2016, 3 Pages.
New Zealand Intellectual Property Office, First Examination Report, New Zealand Patent Application No. 727449, dated Jun. 8, 2017, 7 Pages.
New Zealand Intellectual Property Office, First Examination Report, New Zealand Patent Application No. 726116, dated Jun. 29, 2017, 2 Pages.
New Zealand Intellectual Property Office, Second Examination Report, New Zealand Patent Application No. 726116, dated Sep. 26, 2017, 5 Pages.
New Zealand Intellectual Property Office, First Examination Report, New Zealand Patent Application No. 728495, dated Jul. 12, 2017, 5 Pages.
Russian Patent Office, Office Action for Russian Patent Application No. 2015137613, dated Jun. 7, 2017, 14 Pages. (with English translation).
Ukraine Patent Office, Office Action for Ukrainian Patent Application No. a201508515, dated May 19, 2017, 14 Pages. (with English translation).
Abarenkov, K., et al., "PlutoF—A Web Based Workbench for Ecological and Taxonomic Research, with an Online Implementation for Fungal ITS Sequences," Evol Bioinform Online, 2010, pp. 189-196, vol. 6.
Abarenkov, K., et al., "The UNITE Database for Molecular Identification of Fungi—Recent Updates and Future Perspectives," New Phytol., 2010, pp. 281-285, vol. 186.
Abdellatif, L., et al., "Endophytic hyphal compartmentalization is required for successful symbiotic Ascomycota association with root cells," Mycological Research, 2009, pp. 782-791, vol. 113.

(56) References Cited

OTHER PUBLICATIONS

Ahmad, F., et al., "Screening of Free-Living Rhizospheric Bacteria for Their Multiple Plant Growth Promoting Activities," Microbiol Res., 2008, pp. 173-181, vol. 163.
Amann, R., et al., "The Identification of Microorganisms by Fluorescence in Situ Hybridisation," Curr Opin Biotechnol., 2001, pp. 231-236, vol. 12.
Apel, K., et al., "Reactive Oxygen Species: Metabolism, Oxidative Stress, and Signal Transduction," Annu Rev Plant Biol., 2004, pp. 373-399, vol. 55.
Arendt, K. R., et al., "Isolation of endohyphal bacteria from foliar Ascomycota and in vitro establishment of their symbiotic associations," Appl. Environ. Microbiol., 2016, pp. 2943-2949, vol. 82, No. 10.
Ashrafuzzaman, M., et al., "Efficiency of plant growth-promoting rhizobacteria (PGPR) for the enhancement of rice growth," African Journal of Biotechnology, 2009, pp. 1247-1252, vol. 8, No. 7.
Bacon, C. W., et al., "Isolation, In Planta Detection, and Uses of Endophytic Bacteria for Plant Protection," Manual of Environmental Microbiology, 2007, pp. 638-647.
Baker, K. F., et al., "Dynamics of Seed Transmission of Plant Pathogens," Annu Rev Phytopathol., 1966, pp. 311-334, vol. 4.
Baltruschat, H., et al., "Salt tolerance of barley induced by the root endophyte Piriformospora indica is associated with a strong increase in antioxidants," New Phytologist., 2008, pp. 501-510, vol. 180.
Block, C. C., et al., "Seed Transmission of Pantoea stewartii in Field and Sweet Corn," Plant Disease, 1998, pp. 775-780, vol. 82.
Brinkmeyer, R., et al., "Uncultured Bacterium Clone ARKMP-100 16S Ribosomal RNA Gene, Partial Sequence," NCBI GenBank Accession No. AF468334, Submitted Jan. 14, 2002.
Brodie, E.L., et al., "Uncultured Bacterium Clone BANW722 16S Ribosomal RNA Gene, Partial Sequence," NCBI GenBank Accession No. DQ264636, Submitted Oct. 25, 2005.
Bulgarelli, D., et al., "Structure and Functions of the Bacterial Microbiota of Plants," Annu Rev Plant Biol., 2013, pp. 807-838, vol. 64.
Buttner, D., et al., "Regulation and secretion of Xanthomonas virulence factors," FEMS Microbiology Reviews, 2010, pp. 107-133, vol. 34, No. 2.
Caporaso, J.G., et al., "Ultra-High-Throughput Microbial Community Analysis on the Illumina HiSeq and MiSeq Platforms," ISME J., 2012, pp. 1621-1624, vol. 6.
Castillo, D., et al., "Fungal Entomopathogenic Endophytes: Negative Effects on Cotton Aphid Reproduction in Greenhouse and Field Conditions," Power Point Presentation dated Mar. 23, 2013.
Castillo, D., et al., "Fungal Endophytes: Plant Protective Agents Against Herbivores," Power Point Presentation dated Aug. 4, 2013.
Cavalier-Smith, T., "A Revised Six-Kingdom System of Life," Biol Rev Camb Philos Soc., 1998, pp. 203-266, vol. 73.
Cha, C., et al., "Production of Acyl-Homoserine Lactone Quorum-Sensing Signals by Gram-Negative Plant Associated Bacteria," Mol Plant Microbe Interact.,1998, pp. 1119-1129, vol. 11, No. 11.
Chernin, L. S., et al., "Chitinolytic Activity in Chromobacterium violaceum: Substrate Analysis and Regulation by Quorum Sensing," J Bacteriol., 1998, pp. 4435-4441, vol. 180, No. 17.
Clark, E. M., et al., "Improved Histochemical Techniques for the Detection of Acremonium coenophilum in Tall Fescue and Methods of in vitro Culture of the Fungus," J. Microbiol Methods, 1983, pp. 149-155, vol. 1.
Clay, K., "Effects of fungal endophytes on the seed and seedling biology of Lolium perenne and Festuca arundinacea," Oecologia, 1987, pp. 358-362, vol. 73.
Clough, S. J., et al., "Floral Dip: A Simplified Method for Agrobacterium-mediated Transformation of *Arabidopsis thaliana*," Plant J., 1998, pp. 735-743, vol. 16, No. 6.
Compant, S., et al., "Endophytes of Grapevines Flowers, Berries, and Seeds: Identification of Cultivable Bacteria, Comparison with Other Plant Parts, and Visualization of Niches of Colonization," Microbial Ecology, 2011, pp. 188-197, vol. 62.
Coombs, J. T., et al., "Isolation and Identification of Actinobacteria from Surface-Sterilized Wheat Roots," Applied and Environmental Microbiology, 2003, pp. 5603-5608, vol. 69, No. 9.
Conn, V. M., "Effect of Microbial Inoculants on the Indigenous Actinobacterial Endophyte Population in the Roots of Wheats as Determined by Terminal Restriction Fragment Length Polymorphism," Applied and Environmental Microbiology, 2004, pp. 6407-6413, vol. 70, No. 11.
Cottyn, B., et al., "Phenotypic and genetic diversity of rice seed-associated bacteria and their role in pathogenicity and biological control," Journal of Applied Microbiology, 2009, pp. 885-897, vol. 107.
Cox, C. D., "Deferration of Laboratory Media and Assays for Ferric and Ferrous Ions," Methods Enzymol., 1994, pp. 315-329, vol. 235.
Craine, J. M., et al., "Global Diversity of Drought Tolerance and Grassland Climate-Change Resilience," Nature Climate Change, 2013, pp. 63-67, vol. 3.
Dalal, J.M., et al., "Utilization of Endophytic Microbes for Induction of Systemic Resistance (ISR) in Soybean (*Glycine max* (L) Merril) Against Challenge Inoculation with R. solani," Journal of Applied Science and Research, 2014, pp. 70-84, vol. 2, No. 5.
Danhorn, T., et al., "Biofilnn Formation by Plant-Associated Bacteria," Annu Rev Microbiol., 2007, pp. 401-422, vol. 61.
Daniels, R., et al., "Quorum Signal Molecules as Biosurfactants Affecting Swarming in Rhizobium etli," PNAS, 2006, pp. 14965-14970, vol. 103, No. 40.
Darsonval, A., et al., "Adhesion and Fitness in the Bean Phyllosphere and Transmission to Seed of *Xanthomonas fuscans* subsp. *fuscans*," Molecular Plant-Microbe Interactions, 2009, pp. 747-757, vol. 22, No. 6.
Darsonval, A., et al., "The Type III Secretion System of *Xanthomonas fuscans* subsp. *fuscans* is involved in the Phyllosphere Colonization Process and in Transmission to Seeds of Susceptible Beans," Applied and Envioronmental Mirobiology, 2008, pp. 2669-2678, vol. 74, No. 9.
De Freitas, J. R., et al., "Phosphate-Solubilizing Rhizobacteria Enhance the Growth and Yield but not Phosphorus Uptake of Canola (*Brassica napus* L.)," Biol Fertil Soils, 1997, pp. 358-364, vol. 24.
De Lima Favaro, L. C., et al., "Epicoccum nigrum P16, a Sugarcane Endophyte, Produces Antifungal Compounds and Induces Root Growth," PLoS One, 2012, pp. 1-10, vol. 7, No. 6.
De Melo Pereira, G. V., et al. "A Multiphasic Approach for the Identification of Endophytic Bacterial in Strawberry Fruit and their Potential for Plant Growth Promotion," Microbial Ecology, 2012, pp. 405-417, vol. 63, No. 2.
De Souza, J. J., et al., "Terpenoids from Endophytic Fungi," Molecules, 2011, pp. 10604-10618, vol. 16, No. 12.
Dennis, C., et al., "Antagonistic Properties of Species Groups of Trichoderma," Trans Brit Mycol Soc, 1971, pp. 25-39, vol. 57, No. 1.
Desiro, A., et al., "Detection of a novel intracellular microbiome hosted in arbuscular mycorrhizal fungi," ISME Journal, 2014, pp. 257-270, vol. 8.
Djordjevic, D., et al., "Microtiter Plate Assay for Assessment of Listeria monocytogenes Biofilm Formation," Annl Environ Microbiol., 2002, pp. 2950-2958, vol. 68, No. 6.
Don, R. H., et al., "Properties of Six Pesticide Degradation Plasmids Isolated From Alcaligenes Paradoxus and Alcaligenes eutrophus," J Bacteriol., 1981, pp. 681-686, vol. 145, No. 2.
Dunbar, J, et al., "Uncultured Bacterium Clone NT42a2_20488 16S Ribosomal RNA Gene, Partial Sequence," NCBI GenBank Accession No. JQ378705. Submitted Nov. 8, 2012.
Eberhard, A., et al., "Structural Identification of Autoinducer of Photobacterium fischeri Luciferase," Biochem., 1981, pp. 2444-2449, vol. 20.
Edgar, R. C., "Search and Clustering Orders of Magnitude Faster than BLAST," Bioinformatics, 2010, pp. 2460-2461, vol. 26, No. 19.
Edgar, R. C., "UPARSE: Highly Accurate OTU Sequences From Microbial Amplicon Reads," Nat Methods, 2013, pp. 996-998, vol. 10, No. 10.

(56) References Cited

OTHER PUBLICATIONS

Ek-Ramos, M. J., "Ecology, Distribution and Benefits of Fungal Endophytes Isolated from Cultivated Cotton (*Gossypium hirsutum*) in Texas," Power Point Presentation dated Nov. 7, 2012.
EK-Ramos, M. J., et al., "Spatial and Temporal Variation in Fungal Endophyte Communities Isolated from Cultivated Cotton (*Gossypium hirsutum*)," PLoS ONE, 2013, vol. 8, No. 6, 13 Pages.
Ek-Ramos, M. J., et al., "Spatial and Temporal Variation in Fungal Endophyte Communities Isolated from Cultivated Cotton (*Gossypium hirsutum*)," Power Point Presentation dated Jan. 7, 2013.
El-Shanshoury, A. R., "Growth Promotion of Wheat Seedlings by Streptomyces atroolivaceus," Journal of Agronomy and Crop Science, 1989, pp. 109-114, vol. 163.
Emerson, D., et al., Identifying and Characterizing Bacteria in an Era of Genomics and Proteomics, BioScience, 2008, pp. 925-936, vol. 58, No. 10.
Endre, G., et al., "A Receptor Kinase Gene Regulating Symbiotic Nodule Development," Nature, 2002, pp. 962-966, vol. 417.
Faria, D. C., et al., "Endophytic Bacteria Isolated from Orchid and Their Potential to Promote Plant Growth," World J Microbiol Biotechnol., 2013, pp. 217-221, vol. 29.
Ferrando, L., et al., "Molecular and Culture-Dependent Analyses Revealed Similarities in the Endophytic Bacterial Community Composition of Leaves from Three Rice (*Oryza sativa*) Varieties," FEMS Microbiol Ecol., 2012, pp. 696-708, vol. 80.
Fiehn, O., et al., "Metabolite Profiling for Plant Functional Genomics," Nature Biotechnol., 2000, pp. 1157-1161, vol. 8.
Fierer, N., et al., "Cross-Biome Metagenomic Analyses of Soil Microbial Communities and Their Functional Attributes," Proc Natl Acad Sci USA, 2012, pp. 21390-21395, vol. 109, No. 52.
Fincher, G. B., "Molecular and Cellular Biology Associated with Endosperm Mobilization in Germinating Cereal Grains," Annu Rev Plant Phvsiol Plant Mol Biol., 1989, pp. 305-346, vol. 40.
Fisher, P. J., et al., "Fungal saprobes and pathogens as endophytes of rice (*Oryza sativa* L.)," New Phytol., 1992, pp. 137-143, vol. 120.
Fisher, P. R., et al., "Isolation and Characterization of the Pesticide-Degrading Plasmid pJP1 from Alcaligenes paradoxus," J Bacteriol., 1978, pp. 798-804, vol. 135, No. 3.
Franco, C., et al., "Actinobacterial Endophytes for Improved Crop Performance," Australasian Plant Pathology, 2007, pp. 524-531, vol. 36.
Fulthorpe, R. R., et al., "Distantly Sampled Soils Carry Few Species in Common," ISME J., 2008, pp. 901-910, vol. 2.
Gantner, S., et al., "Novel Primers for 16S rRNA-based Archaeal Community Analyses in Environmental Samples," J Microbiol Methods, 2011, pp. 12-18, vol. 84.
Gao, Z., et al., "Quantitation of Major Human Cutaneous Bacterial and Fungal Populations," J Clin Microbiol., 2010, pp. 3575-3581, vol. 48, No. 10.
Gasser, I., et al., "Ecology and Characterization of Polyhydroxyalkanoate-Producing Microorganisms on and in Plants," FEMS Microbiol Ecol., 2010, pp. 142-150, vol. 70.
Gavrish, E, et al., "*Lentzea* sp. MS6 16S Ribosomal RNA Gene, Partial Sequence," NCBI GenBank Accession No. EF599958. Submitted May 9, 2007.
Gilmour, S. J., et al., "Overexpression of the *Arabidopsis* CBF3 Transcriptional Activator Mimics Multiple Biochemical Changes Associated with Cold Acclimation," Plant Physiol., 2000, pp. 1854-1865, vol. 124.
Giraldo, A., et al., "Phylogeny of Sarocladium (Hypocreales)," Persoonia, 2015, pp. 10-24, vol. 34.
Gitaitis, R., et al., "The Epidemiology and Management of Seedborne Bacterial Diseases," Annu Rev Phytopathol., 2007, pp. 371-397, vol. 45.
Grondona, I., et al., "TUSAL®, a commercial biocontrol formulation based on Trichoderma," Bulletin OILB/SROP, 2004, pp. 285-288, vol. 27, No. 8.
Gu, O., et al., "*Glyconnyces sambucus* sp. nov., an endophytic actinomycete islolated from the stem of Sambucus adnata Wall," International Journal of Systematic and Evolutionary Microbiology, 2007, pp. 1995-1998, vol. 57.
Haake, V., et al., "Transcription Factor CBF4 is a Regulator of Drought Adaptation in *Arabidopsis*," Plant Physiol., 2002, pp. 639-648, vol. 130.
Haas, D., et al., "R Factor Variants with Enhanced Sex Factor Activity in Pseudomonas aeruginosa," Mol Gen Genet., 1976, pp. 243-251, vol. 144.
Hallman, J., et al., "Bacterial Endophytes in Agricultural Crops," Canadian J Microbiol., 1997, pp. 895-914, vol. 43.
Hanson, L.E., "Reduction of Verticillium Wilt Symptoms in Cotton Following Seed Treatment with Trichoderma virens," the Journal of Cotton Science, 2000, pp. 224-231, vol. 4, No. 4.
Hanson, L.E., "Reduction of Verticillium Wilt Symptoms in Cotton Following Seed Treatment with Trichoderma virens," Proceedings Beltwide Cotton Conferences, 2000, vol. 1. (Abstract).
Hardegree, S. P. et al., "Effect of Polyethylene Glycol Exclusion on the Water Potential of Solution-Saturated Filter Paper," Plant Physiol., 1990, pp. 462-466, vol. 92.
Hardoim, P. R., et al., "Assessment of Rice Root Endophytes and Their Potential for Plant Growth Promotion," In: Hardoim, P.R., Bacterial Endophytes of Rice—Their Diversity, Characteristics and Perspectives, Groningen, 2011, pp. 77-100.
Hardoim, P. R., et al., "Dynamics of Seed-Borne Rice Endophytes on Early Plant Growth Stages," PLoS ONE, 2012, vol. 7, No. 2, 13 Pages.
Harman, G.E., et al., "Symposium: biocontrol and biotechnological methods for controlling cotton pests," Proceedings of the Beltwide Cotton Production Research Conf., 1989, Memphis, Tennessee, USA, pp. 15-20. (Abstract).
Hepler, P. K., et al., "Polarized Cell Growth in Higher Plants," Annu Rev Cell Dev Biol., 2001, pp. 159-187, vol. 17.
Hiatt, E. E., et al., "Tall Fescue Endophyte Detection: Commerical Immunoblot Test Kit Compared with Microscopic Analysis," Crop Science, 1999, pp. 796-799, vol. 39.
Hibbett, D. S., et al., "A Higher-Level Phylogenetic Classification of the Fungi," Mycol Res., 2007, pp. 509-547, vol. 111.
Hill, N. S., et al., "Endophyte Survival during Seed Storage: Endophyte-Host Interactions and Heritability," Crop Sci., 2009, pp. 1425-1430, vol. 49.
Hill N. S., et al., "Endophyte Survival during Seed Storage: Endophyte-Host Interactions and Heritability," PowerPoint, Dept. Crop Soil Sciences, University of Georgia, Nov. 16, 2012, 3 Pages.
Hinton, D. M., et al., "Enterobacter cloacae is an endophytic symbiont of corn," Mycopathologia, 1995, pp. 117-125, vol. 129.
Howell, C.R., et al., "Induction of Terpenoid Synthesis in Cotton Roots and Control of Rhizoctonia solani by Seed Treatment with Trichoderma virens," Phytopathology, 2000, pp. 248-252, vol. 90, No. 3.
Hubbard, M., et al., "Fungal Endophytes Improve Wheat Seed Germination Under Heat and Drought Stress," Botany, 2012, pp. 137-149, vol. 90.
Hung, P.Q., et al., "Isolation and Characterization of Endophytic Bacteria in Soybean (*Glycine* Sp.)," Omonrice, 2004, pp. 92-101, vol. 12.
Idris, A., et al., "Efficacy of Rhizobacteria for Growth Promotion in Sorghum Under Greenhouse Conditions and Selected Modes of Action Studies," J Agr Sci., 2009, pp. 17-30, vol. 147.
Ikeda, S., et al., "The Genotype of the Calcium/Calmodulin-Dependent Protein Kinase Gene (CCaMK) Determines Bacterial Community Diversity in Rice Roots Under Paddy and Upland Field Conditions," Applied and Environmental Microbiology, 2011, pp. 4399-4405, vol. 77, No. 13.
Imoto, K., et al., "Comprehensive Approach to Genes Involved in Cell Wall Modifications in *Arabidopsis thaliana*," Plant Mol Biol., 2005, pp. 177-192, vol. 58.
Jalgaonwala, R., et al., "A Review on Microbial Endophytes from Plants: A Treasure Search for Biologically Active Metabolites," Global Journal of Research on Medicinal Plants & Indigenous Medicine, 2014, pp. 263-277, vol. 3, No. 6.

(56) References Cited

OTHER PUBLICATIONS

Janda, J. M., et al., "16S rRNA Gene Sequencing for Bacterial Identification in the Diagnostic Laboratory: Pluses, Perils, and Pitfalls," Journal of Clinical Microbiology, 2007, pp. 2761-2764, vol. 45, No. 9.
Johnston-Monje, D., et al., "Conservation and Diversity of Seed Associated Endophytes in *Zea* Across Boundaries of Evolution, Ethnography and Ecology," PLoS ONE, 2011, vol. 6, No. 6, 22 Pages.
Johnston-Monje, D., et al., "Plant and Endophyte Relationships: Nutrient Management," Comprehensive Biotechnol., 2011, pp. 713-727, vol. 4.
Johnston-Monje, D., "Microbial Ecology of Endophytic Bacteria in *Zea* Species as Influenced by Plant Genotype, Seed Origin, and Soil Environment," Thesis, University of Guelph, 2011, 230 Pages.
Jones, K.L., "Fresh Isolates of Actinomycetes in which the Presence of Sporogenous Aerial Mycelia is a Fluctuating Characteristic," J Bacteriol., 1949, pp. 141-145, vol. 57, No. 2.
Kaga, H., et al., "Rice Seeds as Sources of Endophytic Bacteria," Microbes Environ., 2009, pp. 154-162,vol. 24, No. 2.
Kalns, L., et al., "The Effects of Cotton Fungal Endophytes in the Field on Arthropod Community Structure," Power Point Presentation dated Jan. 7, 2013.
Kang, B. H., et al., "Members of the *Arabidopsis* Dynamin-Like Gene Family, ADL1, are Essential for Plant Cytokinesis and Polarized Cell Growth," Plant Cell, 2003, pp. 899-913, vol. 15.
Kasana, R. C., et al., "A Rapid and Easy Method for the Detection of Microbial Cellulases on Agar Plates Using Gram's Iodine," Curr Microbiol., 2008, pp. 503-507, vol. 57.
Khan, A.L., et al., "Salinity Stress Resistance Offered by Endophytic Fungal Interaction Between Penicillium minioluteum LHL09 and Glycine max. L," J. Microbiol. Biotechnol., 2011, pp. 893-902, vol. 21, No. 9.
Kruger, M., et al., "DNA-Based Species Level Detection of Glomeromycota: One PCR Primer Set for All Arbuscular Mycorrhizal Fungi," New Phvtol., 2009, pp. 212-223, vol. 183.
Kuklinsky-Sobral, J., et al., "Isolation and Characterization of Endophytic Bacteria from Soybean (*Glycine max*) Grown in Soil Treated with Glyphosate Herbicide," Plant and Soil, 2005, pp. 91-99, vol. 273.
Lanver, D., et al., "Sho1 and Msb2-Related Proteins Regulate Appressorium Development in the Smut Fungus Ustilago aydis," Plant Cell, 2010, pp. 2085-2101, vol. 22.
Laus, M. C., et al., "Role of Cellulose Fibrils and Exopolysaccharides of Rhizobium leguminosarum in Attachment to and Infection of Vicia sativa Root Hairs," Mol Plant Microbe Interact., 2005, pp. 533-538, vol. 18, No. 6.
Le, X.H., et al., "Effects of endophytic Streptomyces on the lucerne (*Medicago sativa* L.) symbiosis at different levels of nitrogen," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 66-67.
Le, X.H., et al., "Isolation and characterisation of endophytic actinobacteria and their effect on the early growth and nodulation of lucerne (*Medicago sativa* L.)," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 134-136.
Lehman, S.G., "Treat Cotton Seed," Review of Applied Mycology, 1945, 24, 369.
Lehman, S.G., "Treat Cotton Seed," Research and Farming III, Progr. Rept., 1945, 3, 5.
Leonard, C. A., et al., "Random Mutagenesis of the Aspergillus oryzae Genome Results in Fungal Antibacterial Activity," Int J Microbiol., 2013, vol. 2013, Article ID 901697, 6 Pages.
Li, H. M., et al., "Expression of a Novel Chitinase by the Fungal Endophyte in Poa ampla," Mycologia, 2004, pp. 526-536, vol. 96, No. 3.
Li, H., et al., "Endophytes and their role in phytoremediation," Fungal Diversity, 2012, pp. 11-18, vol. 54.
Li, Q., "Agrobacterium tumefaciens Strain TA-AT-10 16S Ribosomal RNA Gene, Partial Sequence: GenBank: KF673157.1," Submitted Sep. 17, 2013.
Liu, M., et al., "A Novel Screening Method for Isolating Exopolysaccharide-Deficient Mutants," Appl Environ Microbiol., 1998, pp. 4600-4602, vol. 64, No. 11.
Liu, Y., et al., "Investigation on Diversity and Population Succession Dynamics of Endophytic Bacteria from Seeds of Maize (*Zea mays* L., Nongda108) at Different Growth Stages," Ann Microbiol., 2013, pp. 71-79, vol. 63.
Liu, D., et al., "Osmotin Overexpression in Potato Delays Development of Disease Symptoms," Proc Natl Acad Sci USA, 1994, pp. 1888-1892, vol. 91.
Liu, Y., et al., "Study on Diversity of Endophytic Bacterial Communities in Seeds of Hybrid Maize and their Parental Lines," Arch Microbiol., 2012, pp. 1001-1012, vol. 194.
Long, H. H., et al., "The Structure of the Culturable Root Bacterial Endophyte Community of Nicotiana attenuata is Organized by Soil Composition and Host Plant Ethylene Production and Perception," New Phytol., 2010, pp. 554-567, vol. 185.
Lopez-Lopez, A., et al., "Phaseolus vulgaris Seed-Borne Endophytic Community with Novel Bacterial Species such as *Rhizobium endophyticum* sp. nov.," Systematic Appl Microbiol., 2010, pp. 322-327, vol. 33.
Lorck, H., "Production of Hydrocyanic Acid by Bacteria," Physiol Plant, 1948, pp. 142-146, vol. 1.
Lugtenberg, B., et al., "Plant-Growth-Promoting Rhizobacteria," Ann. Rev. Microbiol., 2009, pp. 541-556, vol. 63.
Lundberg, D. S., et al., "Defining the Core *Arabidopsis thaliana* Root Microbiome," Nature, 2012, pp. 86-90, vol. 488, No. 7409.
Lundberg, D. S., et al., "Practical Innovations for High-Throughput Amplicon Sequencing," Nat Methods, 2013, pp. 999-1002, vol. 10, No. 10.
Ma, Y., et al., "Plant Growth Promoting Rhizobacteria and Endophytes Accelerate Phytoremediation of Metalliferous Soils," Biotechnology Advances, 2011, pp. 248-258, vol. 29.
Madi, L. et al., "Aggregation in Azospirillum brasilense Cd: Conditions and Factors Involved in Cell-to-Cell Adhesion," Plant Soil, 1989, pp. 89-98, vol. 115.
Mannisto, M.K., et al., "Characterization of Psychrotolerant Heterotrophic Bacteria From Finnish Lapland," Svst Appl Microbiol., 2006, pp. 229-243, vol. 29.
Mano, H., et al., "Culturable Surface and Endophytic Bacterial Flora of the Maturing Seeds of Rice Plants (*Oryza sativa*) Cultivated in a Paddy Field," Microbes Environ., 2006, vol. 21, No. 2.
Manter, D. K., et al., "Use of the ITS Primers, ITSIF and ITS4, to Characterize Fungal Abundance and Diversity in Mixed-Template Samples by qPCR and Length Heterogeneity Analysis," J Microbiol Methods, 2007, pp. 7-14, vol. 71.
Mao, W., et al., "Seed Treatment with a Fungal or a Bacterial Antagonist for Reducing Corn Damping-off Caused by Species of Pythium and Fusarium," Plant Disease, 1997, pp. 450-454, vol. 81, No. 5.
Marasco, R., et al., "A Drought Resistance-Promoting Microbiome is Selected by Root System Under Desert Farming," PLoS ONE, 2012, vol. 7, No. 10, 14 Pages.
Marquez, L. M., et al., "A Virus in a Fungus in a Plant: Three-Way Symbiosis Required for Thermal Tolerance," Science, 2007, pp. 513-515, vol. 315.
Mastretta, C., et al., "Endophytic Bacteria from Seeds of Nicotiana Tabacum Can Reduce Cadmium Phytotoxicity," Intl J Phytoremediation, 2009, pp. 251-267, vol. 11.
Mateos, P. F., et al., "Cell-Associated Pectinolytic and Cellulolytic Enzymes in Rhizobium leguminosarum biovar trifolii," Appl Environ Microbiol., 1992, pp. 816-1822, vol. 58, No. 6.
McDonald, D., et al., "An Improved Greengenes Taxonomy with Explicit Ranks for Ecological and Evolutionary Analyses of Bacteria and Archaea," ISME J., 2012, pp. 610-618, vol. 6.
McGuire, K.L., et al., "Digging the New York City Skyline: Soil Fungal Communities in Green Roofs and City Parks," PloS One, 2013, vol. 8, No. 3, 13 Pages.

(56) References Cited

OTHER PUBLICATIONS

Medina, P., et al., "Rapid Identification of Gelatin and Casein Hydrolysis Using TCA," J Microbiol Methods, 2007, pp. 391-393, vol. 69.
Mehnaz, S., et al., "Growth Promoting Effects of Corn (*Zea mays*) Bacterial Isolates Under Greenhouse and Field Conditions," Soil Biology and Biochemistry, 2010, pp. 1848-1856, vol. 42.
Mehnaz, S., et al., "Isolation and 16S rRNA sequence analysis of the beneficial bacteria from the rhizosphere of rice," Canada Journal of Microbiology, 2001, pp. 110-117, vol. 47, No. 2.
Mei, C., et al., "The Use of Beneficial Microbial Endophytes for Plant Biomass and Stress Tolerance Improvement," Recent Patents on Biotechnology, 2010, pp. 81-95, vol. 4.
Michel, B. E., et al., "The Osmotic Potential of Polyethylene Glycol 6000," Plant Physiol., 1973, pp. 914-916, vol. 51.
Moe, L. A., "Amino Acids in the Rhizosphere: From Plants to Microbes," American Journal of Botany, 2013, pp. 1692-1705, vol. 100, No. 9.
Mohiddin, F. A., et al., "Tolerance of Fungal and Bacterial Biocontrol Agents to Six Pesticides Commonly Used in the Control of Soil Borne Plant Pathogens," African Journal of Agricultural Research, 2013, pp. 5331-5334, vol. 8, No. 43.
Mousa, W. K., et al., "The Diversity of Anti-Microbial Secondary Metabolites Produced by Fungal Endophytes: An Interdisciplinary Perspective," Front Microbiol., 2013, vol. 4, No. 65, 18 Pages.
Mundt, J.O., et al., "Bacteria Within Ovules and Seeds," Appl Environ Microbiol., 1976, pp. 694-698, vol. 32, No. 5.
Naik, B. S., et al., "Study on the diversity of endophytic communities from rice (*Oryza sativa* L.) and their antagonistic activities in vitro," Microbiological Research, 2009, pp. 290-296, vol. 164.
Naveed, M., "Maize Endophytes—Diversity, Functionality and Application Potential," University of Natural Resources and Life Sciences, 2013, pp. 1-266 and 81-87; Tables 1-3; Figure 2.
Nejad, P. et al., "Endophytic Bacteria Induce Growth Promotion and Wilt Disease Suppression in Oilseed Rape and Tomato," Biological Control, 2000, pp. 208-215, vol. 18.
Neslon, E.B., "Microbial Dynamics and Interactions in the Spermosphere," Ann. Rev. Phytopathol., 2004, pp. 271-309, vol. 42.
Nikolcheva, L.G., et al., "Taxon-Specific Fungal Primers Reveal Unexpectedly High Diversity During Leaf Decomposition in a Stream," Mycological Progress, 2004, pp. 41-49, vol. 3, No. 1.
Nimnoi, P., et al., "Co-Inoculation of Soybean (*Glycin max*) with Actinomycetes and Bradyrhizobium Japonicum Enhances Plant Growth, Nitrogenase Activity and Plant Nutrition," Journal of Plant Nutrition, 2014, pp. 432-446, vol. 37.
Normander, B., et al., "Bacterial Origin and Community Composition in the Barley Phytosphere as a Function of Habitat and Presowing Conditions," Appl Environ Microbiol., Oct. 2000, pp. 4372-4377, vol. 66, No. 10.
Okunishi, S., et al., "Bacterial Flora of Endophytes in the Maturing Seeds of Cultivated Rice (*Oryza sativa*)," Microbes and Environment, 2005, pp. 168-177, vol. 20, No. 3.
Orole, O. O., et al., "Bacterial and fungal endophytes associated with grains and roots of maize," Journal of Ecology and the Natural Enviornment, 2011, pp. 298-303, vol. 3, No. 9.
Partida-Martinez, L.P., et al., "The Microbe-Free Plant: Fact or Artifact?" Front Plant Sci., 2011, vol. 2, No. 100, 16 Pages.
Pearson, W.R., et al., "Rapid and Sensitive Sequence Comparison With FASTP and FASTA," Methods Enzymol., 2011, pp. 63-98, vol. 183.
Pedraza, R. O., et al., "Azospirillum inoculation and nitrogen fertilization effect on grain yield and on the diversity of endophytic bacteria in the phyllosphere of rice rainfed crop," European Journal of Soil Biology, 2009, pp. 36-43, vol. 45.
Perez-Fernandez, M. A., et al., "Simulation of Germination of Pioneer Species Along an Experimental Drought Gradient," J Environ Biol., 2006, pp. 669-685, vol. 27, No. 4.
Perez-Miranda, S., et al., "O-CAS, A Fast and Universal Method for Siderophore Detection," J Microbiol Methods, 2007, pp. 127-131, vol. 70.
Petti, C. A., "Detection and Identification of Microorganisms by Gene Amplification and Sequencing," Clinical Infectious Diseases, 2007, pp. 1108-1114, vol. 44.
Phalip, V., et al., "A Method for Screening Diacetyl and Acetoin-Producing Bacteria on Agar Plates," J Basic Microbiol.,1994, pp. 277-280, vol. 34.
Philippot, L., et al., "Going Back to the Roots: The Microbial Ecology of the Rhizosphere," Nat Rev Microbiol., Nov. 2013, pp. 789-799, vol. 11.
Philrice Batac, Philippine Rice R&D Highlights, 2012, Area-Based R&D Projects, [online][Retrieved Aug. 11, 2016] Retrieved from the Internet <URL:http://www.philrice.gov.ph/2012-rd-highlights/>.
Pillay, V. K., et al., "Inoculum Density, Temperature, and Genotype Effects on in vitro Growth Promotion and Epiphytic and Endophytic Colonization of Tomato (*Lycopersicon esculentum* L.) Seedlings Inoculated with a Pseudomonad Bacterium," Can J Microbiol.,1997, pp. 354-361, vol. 43.
Powell, W. A., et al., "Evidence of Endophytic Beauveria Bassiana in Seed-Treated Tomato Plants Acting as a Systemic Entomopathogen to Larval *Helicoverpa zea* (Lepidoptera: Noctuidae)," J. Entomol. Sci., 2009, pp. 391-396, vol. 44, No. 4.
Quadt-Hallmann, A., et al., "Bacterial Endophytes in Cotton: Mechanisms of Entering the Plant," Can J Microbiol., 1997, pp. 577-582, vol. 43.
R Core Team, "R: A Language and Environment for Statistical Computing," R Foundation for Statistical Computing, Vienna, Austria, May 2013, ISBN: 3-900051-07-0. Available online at http://www.R- 25project.org/, 3604 Pages.
Rasmussen, S., et al., "Grass-endophyte interactions: a note on the role of monosaccharide transport in the Neotyphodium lolii-Lolium perenne symbiosis," New Phytologist, 2012, pp. 7-12, vol. 196.
Ravel, C., et al., "Beneficial effects of Neotyphodium lolii on the growth and the water status in perennial ryegrass cultivated under nitrogen deficiency or drought stress," Agronomie, 1997, pp. 173-181, vol. 17.
Redman, R. S., et al., "Thermotolerance Generated by Plant/Fungal Symbiosis," Science, Nov. 2002, vol. 298, 1 Page (with 4 pages of supplemental material).
Reiter, B., et al., "Response of Endophytic Bacterial Communities in Potato Plants to Infection with *Erwinia carotovora* subsp. *atroseptica*," Appl Environ Microbiol., 2001, pp. 2261-2268, vol. 68, No. 5.
Rodriguez, H., et al., "Expression of a Mineral Phosphate Solubilizing Gene From Erwinia herbicola in Two Rhizobacterial Strains," J Biotechnol., 2001, pp. 155-161, vol. 84.
Rodriguez, R.J., et al., "Stress Tolerance in Plants via Habitat-Adapted Symbiosis," ISME J., 2008, pp. 404-416, vol. 2.
Rodriguez-Navarro, D., et al., "Soybean Interactions with Soil Microbes, Agronomical and Molecular Aspects," Agronomy for Sustainable Development, 2011, pp. 173-190, vol. 31, No. 1.
Roessner, U., et al., "Metabolic Profiling Allows Comprehensive Phenotyping of Genetically or Environmentally Modified Plant Systems," Plant Cell, 2001, pp. 11-29, vol. 13.
Rosado, A. S., et al., "Phenotypic and Genetic Diversity of Paenibacillus azotofixans Strains Isolated from the Rhizoplane or Rhizosphere Soil of Different Grasses," J App Microbiol., 1998, pp. 216-226, vol. 84.
Rosenblueth, A., et al., "Seed Bacterial Endophytes: Common Genera, Seed-to-Seed Variability and Their Possible Role in Plants," Acta Hort., 2012, pp. 39-48, vol. 938.
Rosenblueth, M., et al., "Bacterial Endophytes and Their Interactions With Host," Molecular Plant-Microbe Interactions, 2006, pp. 827-837, vol. 19, No. 8.
Ross, P.L., et al., "Multiplexed Protein Quantitation in *Saccharomyces cerevisiae* Using Amine-Reactive Isobaric Tagging Reagents," Mol Cell Proteomics, 2004, pp. 1154-1169, vol. 3, No. 12.
Saleem, M., et al., "Perspective of Plant Growth Promoting Rhizobacteria (PGPR) Containing ACC Deaminase in Stress Agriculture," J Ind Microbiol Biotechnol., Oct. 2007, pp. 635-648, vol. 34.

(56) References Cited

OTHER PUBLICATIONS

Samac, D.A., et al., "Recent Advances in Legume-Microbe Interactions: Recognition, Defense Response, and Symbiosis from a Genomic Perspective," Plant Physiol., 2007, pp. 582-587, vol. 144.
Sardi, P., et al., "Isolation of Endophytic Streptomyces Strains from Surface Sterilized Roots," Applied and Environmental Microbiology, 1992, pp. 2691-2693, vol. 58, No. 8.
Sarwar, M., et al., "Tryptophan Dependent Biosynthesis of Auxins in Soil," Plant Soil, 1992, pp. 207-215, vol. 147.
Schmieder, R., et al., "Quality Control and Preprocessing of Metagenomic Datasets," Bioinformatics, 2011, pp. 863-864, vol. 27, No. 6.
Schoch, C. L., et al., "Nuclear Ribosomal Internal Transcribed Spacer (ITS) Region as a Universal DNA Barcode Marker for Fungi," Proc Natl Acad Sci USA, 2012, pp. 6241-6246, vol. 109, No. 16.
Schwyn, B. et al., "Universal Chemical Assay for the Detection and Determination of Siderophores," Analytical Biochemistry, 1987, pp. 47-56, vol. 160.
Sessitsch, A., et al., "*Burkholderia phytofirmans* sp. Nov., a novel plant-associated bacterium with plant-beneficial properties," International Journal of Systematic and Evoluntary Microbiology, 2005, pp. 1187-1192, vol. 55.
Shapiro-Ilan, D.I., et al., "The Potential for Enhanced Fungicide Resistance in Beauveria Bassiana Through Strain Discovery and Artificial Selection," Journal of Invertebrate Pathology, 2002, pp. 86-93, vol. 81.
Shankar, M., et al.,"Root colonization of a rice growth promoting strain of Enterobacter cloacae," Journal of Basic Microbiology, 2011, pp. 523-530, vol. 51.
Singh, A. K., et al., "*Uncultured Actinomyces* sp. Clone EMLACT 80 IV (New) 16S Ribosomal RNA Gene, Partial Sequence," NCBI GenBank Accession No. JQ285908. Submitted Dec. 13, 2011.
Soares, M. M. C. N., et al., "Screening of Bacterial Strains for Pectinolytic Activity: Characterization of the Polygalacturonase Produced by Bacillus SP," Revista de Microbiolgia, 1999, pp. 299-303, vol. 30.
Soe, K.M., et al., "Effects of endophytic actinomycetes and Bradyrhizobium japonicum strains on growth, nodulation, nitrogen fixation and seed weight of different soybean varieties," Soil Science and Plant Nutrition, 2012, pp. 319-325, vol. 58, No. 3.
Soe, K.M., et al., "Low-Density Co-Inoculation of Myanmar Bradyrhizobium yuanmingense MAS34 and Streptomyces griseoflavus P4 to Enhance Symbiosis and Seed Yield in Soybean Varieties," American Journal of Plant Sciences, 2013, pp. 1879-1892, vol. 4.
Song, M., et al., "Effects of Neotyphodium Endophyte on Germination of Hordeum brevisubulatum under Temperature and Water Stress Conditions," Acta Agrestia Sinica, 2010, pp. 834-837, vol. 18, No. 6. (English Abstract).
Souleimanov, A., et al., "The Major Nod Factor of Bradyrhizobium japonicum Promotes Early Growth of Soybean and Corn," J. Exp. Bot., 2002, pp. 1929-1934, vol. 53, No. 376.
Spiekermann, P., et al., "A Sensitive, Viable-Colony Staining Method Using Nile Red for Direct Screening of Bacteria that Accumulate Polyhydroxyalkanoic Acids and Other Lipid Storage Compounds," Arch Microbiol., 1999, pp. 73-80, vol. 171.
Staudt, A. K., et al., "Variations in Exopolysaccharide Production by Rhizobium tropici," Arch Microbiol., 2012, pp. 197-206, vol. 194.
Strobel, G. A., "Endophytes as Sources of Bioactive Products," Microbes and Infection, 2003, pp. 535-544, vol. 5.
Sturz, A. V., et al., "Weeds as a Source of Plant Growth Promoting Rhizobacteria in Agricultural Soils," Can J Microbiol., 2001, pp. 1013-1024, vol. 47, No. 11.
Surette, M. A., et al. "Bacterial Endophytes in Processing Carrots (*Daucus carota* L. var. *sativus*): Their Localization, Population Density, Biodiversity and Their Effects on Plant Growth," Plant and Soil, 2003, pp. 381-390, vol. 253, No. 2.
Suto, M., et al., "Endophytes as Producers of Xylanase," J Biosci Bioeng., 2002, pp. 88-90, vol. 93, No. 1.
Sword, G., "Manipulating Fungal Endophytes to Protect Plants from Insects and Nematodes," Power Point Presentation dated Aug. 7, 2013.
Sword, G., et al., "Manipulating Fungal Endophytes for the Protection of Cotton in the Field," Power Point Presentation dated Jan. 7, 2013.
Sword, G., et al., "Field Trials of Potentially Beneficial Fungal Endophytes in Cotton," Power Point Presentation dated Jan. 7, 2013.
Sword, G., "Fungal Endophytes to Protect Cotton from Insects and Nematodes," Power Point Presentation dated Dec. 7, 2012.
Sword, G., "Natural Enemies—The Forgotten Basis of IPM?" Power Point Presentation dated Sep. 6, 2013.
Taghavi, S., et al., "Genome Survey and Characterization of Endophytic Bacteria Exhibiting a Beneficial Effect on Growth and Development of Poplar Trees," Applied and Environmental Microbiology, 2009, pp. 748-757, vol. 75, No. 3.
Taylor, A. G., et al., "Concepts and Technologies of Selected Seed Treatments," Annu. Rev. Phytopathol., 1990, pp. 321-339, vol. 28.
Teather, R. M., et al., "Use of Congo Red-Polysaccharide Interactions in Enumeration and Characterization of Cellulolytic Bacteria from the Bovine Rumen," Appl Environ Microbiol., 1982, pp. 777-780, vol. 43, No. 4.
Theis, K. R., et al., "Uncultured Bacterium Clone GM2GI8201A64RC 16S Ribosomal RNA Gene, Partial Sequence," NCBI GenBank Accession No. JX051943, Submitted May 14, 2012.
Thomas, L., et al., "Development of Resistance to Chlorhexidine Diacetate in Pseudomonas aeruginosa and the Effect of a "Residual" Concentration," J Hosp Infect., 2000, pp. 297-303, vol. 46.
Thomashow, M. F., "So What's New in the Field of Plant Cold Acclimation? Lots!," Plant Physiol., 2001, pp. 89-93, vol. 125.
Tokala, R. T., et al., "Novel Plant-Microbe Rhizosphere Interaction Involving Streptomyces Lydicus WYEC108 and the Pea Plant (*Pisum sativum*)," Applied and Environmental Microbiology, May 2002, pp. 2161-2171, vol. 68, No. 5.
Trichoderma definition, 2016, [online] [Retrieved on Sep. 16, 2016,] Retrieved from the Internet <URL:https://en.wikipedia.org/wiki/Trichoderma>.
Trotel-Aziz, P., et al., "Characterization of New Bacterial Biocontrol Agents Acinetobacter, Bacillus, Pantoea and *Pseudomonas* spp. Mediating Grapevine Resistance Against Botrytis cinerea," Environmental and Experimental Botany, 2008, pp. 21-32, vol. 64.
Truyens, S., et al., "Changes in the Population of Seed Bacteria of Transgenerationally Cd-Exposed *Arabidopsis thaliana*," Plant Biol., 2013, pp. 971-981, vol. 15.
Usadel, B., et al., "The Plant Transcriptome—From Integrating Observations to Models," Front Plant Sci., 2013, pp. 1-3, vol. 4., Article 48, 3 Pages.
Vacheron, J., et al., "Plant Growth-Promoting Rhizobacteria and Root System Functioning," Frontiers Plant Sci., 2013, vol. 4, Article 356, 19 Pages.
Valencia, C. U., et al., "Endophytic Establishment as an Unintended Consequence of Biocontrol with Fungal Entomopathogens," Power Point Presentation dated Jan. 7, 2013.
Van Der Lelie, D., et al., "Poplar and its Bacterial Endophytes: Coexistence and Harmony," Critical Rev Plant Sci., 2009, pp. 346-358, vol. 28.
Vining, K., et al., "Methylome Reorganization During in vitro Dedifferentiation and Regeneration of Populus trichocarpa," BMC Plant Biol., 2013, vol. 13, No. 92, 15 Pages.
Viruel, E., et al., "Pseudomonas thiveralensis Strain IEHa 16S Ribosomal RNA Fene, Partial Sequence," NCBI GenBank Accession No. GQ169380.1, Submitted May 15, 2009.
Waller, F., et al., "The Endophytic Fungus Piriformospora indica Reprograms Barley to Salt-Stress Tolerance, Disease Resistance, and Higher Yield," PNAS, 2005, pp. 13386-13391, vol. 102, No. 38.
Wang, B., et al., "Fungal endophytes of native *Gossypium* species in Australia," Mycological Research, 2007, pp. 347-354, vol. 111, No. 3.
Wang, K., et al., "Monitoring in Planta Bacterial Infection at Both Cellular and Whole-Plant Levels Using the Green Fluorescent Protein Variant GFPuv," New Phytol., 2007, pp. 212-223, vol. 174.

(56) References Cited

OTHER PUBLICATIONS

Wang, Q., et al., "Naive Bayesian Classifier for Rapid Assignment of rRNA Sequences into the New Bacterial Taxonomy," Appl. Environ. Microbiol., 2007, pp. 5261-5267, vol. 73, No. 16.
Waqas, M., et al., "Endophytic Fungi Produce Gibberellins and Indoleacetic Acid and Promotes Host-Plant Growth during Stress," Molecules, 2012, pp. 10754-10773, vol. 17.
Weaver, P.F., et al., "Characterization of Rhodopseudomonas capsulata," Arch Microbiol., 1975, pp. 207-216, vol. 105.
Weindling, R., "Relation of dosage to control of cotton seedling diseases by seed treatment," Plant Disease Reporter, 1943, 27, 68-70.
Welty, R.E., et al., "Influence of Moisture Content, Temperature, and Length of Storage on Seed Germination and Survival of Endophytic Fungi in Seeds of Tall Fescue and Perennial Ryegrass," Phytopathyol., 1987, pp. 893-900, vol. 77, No. 6.
White, J. F., et al., "A Proposed Mechanism for Nitrogen Acquisition by Grass Seedlings Through Oxidation of Symbiotic Bacteria," Symbiosis, 2012, pp. 161-171, vol. 57.
Wiegand, I., et al., "Agar and Broth Dilution Methods to Determine the Minimal Inhibitory Concentration (MIC) of Antimicrobial Substances," Nature Protocols, 2008, pp. 163-175, vol. 3, No. 2.
Xu, M., et al., "Bacterial Community Compositions of Tomato (*Lycopersicum esculentum* Mill.) Seeds and Plant Growth Promoting Activity of ACC Deaminase Producing Bacillus subtilis (HYT-12-1) on Tomato Seedlings," World J Microbiol Biotechnol., 2014, pp. 835-845, vol. 30.
Xu, Y., et al., "Biosynthesis of the Cyclooligomer Despipeptide bassianolide, an Insecticidal Virulence Factor of Beauveria bassiana," Fungal Genetics and Biology, 2009, pp. 353-364, vol. 46.
Xue, Q.Y., et al., "Evaluation of the Strains of Acinetobacter and Enterobacter as potential Biocontrol Agents Against Ralstonia Wilt of Tomato," Biological Control, 2009, vol. 48, pp. 252-258.
Yandigeri, M. S., et al., "Drought-tolerant endophytic actinobacteria promote growth of wheat (*Triticum aestivum*) under water stress conditions," Plant Growth Regulation, 2012, pp. 411-420, vol. 68.
Yezerski, A., et al., "The Effects of the Presence of Stored Product Pests on the Microfauna of a Flour Community," Journal of Applied Microbiology, 2005, pp. 507-515, vol. 98.
You, Y., et al., "Analysis of Genomic Diversity of Endophytic Fungal Strains Isolated from the Roots of Suaeda japonica and S. maritima for the Restoration of Ecosystems in Buan Salt Marsh," Korean Journal of Microbiology and Biotechnology, 2012, pp. 287-295, vol. 40, No. 4. (with English Abstract).
Zhou, W., et al., "Effects of the Fungal Endophyte *Paecilomyces* sp. in Cotton on the Roo-Knot Nematode Meloidogyne incognita," poster dated Jan. 7, 2013.
Zimmerman, N.B., et al., "Fungal Endophyte Communities Reflect Environmental Structuring Across a Hawaiian Landscape," Proc Natl Acad Sci USA, 2012, pp. 13022-13027, vol. 109, No. 32.
Zuccaro, A., et al., "Endophytic Life Strategies Decoded by Genome and Transcriptome Analyses of the Mutualistic Root Symbiont Piriformospora indica," PLOS Pathogens, 2011, vol. 7, No. 10, e1002290.
Zuniga, A., et al., "Quorum Sensing and Indole-3-Acetic Acid Degradation Play a Role in Colonization and Plant Growth Promotion of *Arabidopsis thaliana* by Burkholderia phytofirmans PsJN," Mol Plant Microbe Interact., 2013, pp. 546-553, vol. 26, No. 5.
Langille, M.G.I. et al., "Predictive functional profiling of microbial communities using 16S rRNA marker gene sequences," Nature Biotechnology, 2013, vol. 31, No. 9, pp. 814-821.
Li, W. et al., "Ultrafast clustering algorithms for metagenomic sequence analysis," Briefings in Bioinformatics, Nov. 1, 2012, vol. 13, No. 6., pp. 656-668.
PCT Invitation to Pay Additional Fees, PCT Application No. PCT/US2017/064351, dated Feb. 9, 2018, 18 Pages.
PCT International Search Report and Written Opinion, PCT Application No. PCT/US2017/064351, dated Apr. 9, 2018, 25 Pages.
PCT Invitation to Pay Additional Fees, PCT Application No. PCT/US2017/064361, dated Mar. 7, 2018, 18 Pages.
PCT Invitation to Pay Additional Fees, PCT Application No. PCT/US2017/064292, dated Mar. 5, 2018, 15 Pages.
PCT International Search Report and Written Opinion, PCT Application No. PCT/USS2017/068255, dated Mar. 19, 2018, 14 Pages.
European Patent Office, Communication Pursuant to Article 94(3) EPC for European Patent Application No. EP 14748326.7, dated Feb. 15, 2018, 7 Pages.
European Patent Office, Supplementary European Search Report for European Patent Application No. 15810847.2, dated Feb. 28, 2018, 19 Pages.
European Patent Office, Extended European Search Report, European Patent Application No. EP 15812324.0, dated Feb. 21, 2018, 23 Pages.
European Patent Office, Extended European Search Report, European Patent Application No. EP 15809264.3, dated Mar. 12, 2018, 14 Pages.
Intellectual Property Australia, Examination Report No. 1 for Australian Patent Application No. AU 2017201009, dated Apr. 4, 2018, 3 Pages.
New Zealand Intellectual Property Office, Further Examination Report, New Zealand Patent Application No. 726116, dated Feb. 27, 2018, 6 Pages.
Ukraine Patent Office, Office Action for Ukrainian Patent Application No. a201508515, dated Feb. 20, 2018, 9 Pages (with English translation).
Office Action for Israel Patent Application No. IL 255682, dated Mar. 15, 2018, 2 Pages. (Translation).
Office Action for Israel Patent Application No. IL 255684, dated Mar. 19, 2018, 2 Pages. (Translation).
Office Action for Israel Patent Application No. IL 255685, dated Mar. 20, 2018, 2 Pages. (Translation).
Office Action for Israel Patent Application No. IL 255688, dated Mar. 22, 2018, 2 Pages. (Translation).
Abdellatif, L., et al., "Characterization of virulence and PCR-DGGE profiles of Fusarium avenaceum from western Canadian Prairie Ecozone of Saskatchewan," Canadian Journal of Plant Pathology, 2010, pp. 468-480.
Abou-Shanab, R.A., et al: "Characterization of Ni-resistant bacteria in the rhizosphere of the hyperaccumulator Alyssum murale by 16S rRNA gene sequence analysis", World Journal of Microbiology and Biotechnology, vol. 26, No. 1, Aug. 15, 2009, pp. 101-108.
Amatuzzi, R.F., et al., "Universldade Federal Do Parana," Jan. 1, 2014, 52 Pages. (With English Abstract).
Amatuzzi, R.F., et al., "Potential of endophytic fungi as biocontrol agents of Duponchelia fovealis (Zeller) (Lepidoptera:Crambidae," Brazilian Journal of Biology, Nov. 9, 2017, 7 Pages.
Bethlenfalvay, G., et al., "Mycorrhizal fungi effects on nutrient composition and yield of soybean seeds", Journal of Plant Nutrition, vol. 20, No. 4-5, Apr. 1, 1997, pp. 581-591.
NCBI GenBank: CP000653.1 "*Enterobacter* sp. 638, complete genome" Jan. 28, 2014, 5 Pages, Can be retrieved at <URL:https://www.ncbi.nlm.nih.gov/nuccore/CP000653.1>.
NCBI GenBank: CP000653.1 "*Enterobacter* sp. 638, complete genome" ASM1632v1, Apr. 18, 2007, 2 Pages, Can be retrieved at <URL:https://www.ncbi.nlm.nih.gov/assembly/GCA_000016325.1>.
NCBI GenBank: EU340965.1 "*Enterobacter* sp. 638 16S ribosomal RNA gene, partial sequence" Jan. 30, 2009, 1 Page, Can be retrieved at <URL:https://www.ncbi.nlm.nih.gov/nuccore/EU340965.1>.
NCBI GenBank: EBI accession No. EM STD:JQ759988, "*Dothideomycetes* sp. genotype 226 isolate FL0175 internal transcribed spacer 1, partial sequence; 5.85 ribosomal RNA gene and internal transcribed spacer 2, complete sequence; and 285 ribosomal RNA gene, partial sequence," May 17, 2012, 1 Page.
NCBI GenBank: EBI accession No. EM STD:GU055658, "Uncultured Periconia clone NG R 806 18S ribosomal RNA gene, partial sequence; internal transcribed spacer 1, 5.8S ribosomal RNA gene, and internal transcribed spacer 2, complete sequence; and 28S ribosomal RNA gene, partial sequence," Oct. 27, 2009, 1 Page.
Database Geneseq Database accession No. BAP97938 "Pantoea dispersa strain KACC91642P 16S rDNA sequence, SEQ ID 1." Aug. 15, 2013, 1 Page.

(56) References Cited

OTHER PUBLICATIONS

Hamayun, M., et al., "Cladosporium sphaerospermum as a new plant growth-promoting endophyte from the roots of Glycine max (L.) Merr," World Journal of Microbiology and Biotechnology, Kluwer Academic Publishers, Feb. 15, 2009, pp. 627-632, vol. 25, No. 4.
Klaubauf, S., et al., "Molecular diversity of fungal conmunities in agricultural soils from Lower Austria," Fungal Diversity, Aug. 13, 2010, pp. 65-75, vol. 44, No. 1.
Knapp, D., et al., "Inter- and intraspecific functional diversity of fungal root endophytes of semiarid sandy grasslands," Acta Microbiologica et Immunologica Hungarica, Nov. 2017, pp. 1-101, vol. 64, Issue Supplement 1.
Kumar, A., et al., "Bio-control potential of *Cladosporium* sp. (MCPL-461), against a noxious weed *Parthenium hysterophorus* L.," J. Environ Biol., Mar. 2009, pp. 307-312, vol. 30, Issue 2.
Kusari, S., et al. "Chemical ecology of endophytic fungi: origins of secondary metabolites," Cell Press, Chem & Biol., 2012, pp. 792-798, vol. 19.
Mandyam, K., et al., "Mutualism-parasitism paradigm synthesized from results of root-endophyte models", Frontiers in Microbiology, Jan. 12, 2015, pp. 1-14, vol. 5.
Rae, R., et al., "A subset of naturally isolated Bacillus strains show extreme virulence to the free-living nematodes *Caenorhabditis elegans* and *Pristionchus pacificus*", Environmental Microbiology, 2010, pp. 3007-3021, vol. 12, No. 11.
Samways, M.J., et al., "Assessment of the Fungus *Cladosporium oxyspoum* (Berk. and Curt.) As a Potential BioControl Agent Against Certain Homoptera," Elsevier Science Publioshers B.V., Jan. 1, 1986, pp. 231-239.
Saunders, M., et al., "Host-Synthesized Secondary Compounds Influence the In Vitro Interactions between Fungal Endophytes of Maize", Applied and Environmental Microbiology, Nov. 9, 2007, pp. 136-142, vol. 74, No. 1.
Shiraishi, A., et al., "Nodulation in black locust by the ammaproteobacteria *Pseudomonas* sp. and the *Betaproteobacteria burkholderia* sp", Systematic and Applied Microbiology, Aug. 2010, pp. 269-274, vol. 33, No. 5.
Simola, L., et al., "The Effect of Some Protein and Non-Protein Amino Acids on the Growth of Cladosporium herbarum and Trichotheeium roseum," Effect of Amino Acids on Fungi, Physiologia Plantarum, 1979, pp. 381-387, vol. 46.
Taghavi, S., et al., "Genome Sequence of the Plant Growth promoting Endophytic Bacterium *Enterobacter* sp. 638", PLoS Genet., May 2010, pp. 1-15, vol. 6, Issue 5, e1000943.
U'Ren, J.M., et al., "Host and geographic structure of endophytic and endolichenic fungi at the continental scale," American Journal of Botany, May 1, 2012, pp. 898-914, vol. 99, No. 5.
Valencia, E., et al., "Mini-review: Brazilian fungi diversity for biomass degradation," Fungal Genetics and Biology, 2013, pp. 9-18, vol. 60.
Vujanovic, V., et al., "Viability Testing of Orchid Seed and the Promotion of Colouration and Germination," Annals of Botany, Mar. 17, 2000, pp. 79-86, vol. 86.
Vujanovic, V., et al., "Endophytic hyphal compartmentalization is required for successful mycobiont-wheat interaction as revealed by confocal laser microscopy," The proceedings of the Soils and Crops conference in Saskatoon (2008) published 2009, 7 Pages.
Vujanovic, V., et al., "Mycovitality—a new concept of plant biotechnology," Canadian Journal Plant Pathol, 2007, vol. 29, p. 451.
Vujanovic, V., et al., "Seed endosymbiosis: a vital relationship in providing prenatal care to plants," Can. J. Plant Sci., NRC Research Press, Feb. 6, 2017, pp. 972-981, vol. 97.
Youssef, Y.A., et al., "Production of Plant Growth Substances by Rhizosphere Myoflora of Broad Bean and Cotton," Biologia Plantarum, 1975, pp. 175-181, vol. 17, No. 3.
Canadian Patent Office, Office Action, Canadian Patent Application No. CA 2,953,466, dated Dec. 11, 2017, 7 Pages.
Canadian Patent Office, Office Action, Canadian Patent Application No. CA 2,953,697, dated Oct. 12, 2017, 6 Pages.
Canadian Patent Office, Office Action, Canadian Patent Application No. CA 2,952,057, dated Oct. 12, 2017, 4 Pages.
Canadian Patent Office, Office Action, Canadian Patent Application No. CA 2,929,487, dated Dec. 7, 2017, 4 Pages.
Chinese Patent Office, 2nd Office Action for Chinese Patent Application No. CN 201480072142.7, dated Oct. 30, 2017, 13 Pages, (with English translation).
European Patent Office, Communication Pursuant to Article 94(3) EPC for European Patent Application No. 13874703.5, dated Jan. 5, 2018, 4 Pages.
European Patent Office, Examination Report for European Patent Application No. EP 14777213.1, dated Oct. 20, 2017, 12 Pages.
European Patent Office, Supplementary European Search Report, European Patent Application No. EP 15809264.3, dated Dec. 4, 2017, 16 Pages.
European Patent Office, Communication Pursuant to Article 94(3) EPC for European Patent Application No. 15810847.2, dated Nov. 17, 2017, 17 Pages.
European Patent Office, Supplementary European Search Report, European Patent Application No. EP 15812324.0, dated Nov. 2, 2017, 19 Pages.
Intellectual Property Australia, Examination Report No. 1 for Australian Patent Application No. AU 2017254880, dated Nov. 15, 2017, 2 Pages.
New Zealand Intellectual Property Office, First Examination Report, New Zealand Patent Application No. 726116, dated Sep. 26, 2017, 5 Pages.
New Zealand Intellectual Property Office, First Examination Report for New Zealand Patent Application No. NZ 728483, dated Dec. 8, 2017, 2 Pages.
Russian Patent Office, Office Action for Russian Patent Application No. RU 2017127214, dated Nov. 22, 2017, 4 Pages, (with English translation).
Abdou, R., et al., "Botryorhodines A-D, antifungal and cytotoxic depsidones from Botryosphaeria rhodina, an endophyte of the medicinal plant Bidens pilosa," Phytochemistry, 2010, vol. 71, pp. 110-116.
Adhikari, M., et al., "A New Record of Pseudeurotium bakeri from Crop Field Soil in Korea," The Korean Journal of Mycology, 2016, pp. 145-149, vol. 44.
Alvarez-Perez, S., et al., "Zooming-in on floral nectar: a first exploration of nectar-associated bacteria in wild plant communities," FEMS Microbiol. Ecol., 2012, vol. 80, No. 3, pp. 591-602.
Bensch, K., et al., "Species and ecological diversity within the Cladosporium cladosporioides complex (Davidiellaceae, Capnodiales)," Studies in Mycology, 2010, pp. 1-94, vol. 67.
Chagas, F., et al., "A Mixed Culture of Endophytic Fungi Increases Production of Antifungal Polyketides," J. Chem Ecol., Oct. 2013, pp. 1335-1342, vol. 39.
Clarridge, J., "Impact of 16S rRNA Gene Sequence Analysis for Identification of Bacteria on Clinical Microbiology and Infectious Diseases," Clinical Microbiology Reviews, Oct. 2004, pp. 840-862, vol. 17, No. 4.
Dbget, "Orthology: K14454," 2005, 2 pages, can be retrieved at <URL:http://www.genome.jp/dbget-bin/www_bget?ko:K14454>.
Gebhardt, J., et al., "Characterization of a single soybean cDNA encoding cytosolic and glyoxysomal isozymes of aspartate aminostransferase," Plant Molecular Biology, 1998, pp. 99-108, vol. 37.
GenBank: AF034210.1 "Glycine max aspartate aminotransferase glyoxysomal isozyme AAT1 precursor and aspartate aminotransferase cytosolic isozyme AAT2 (AAT) mRNA, complete cds," NCBI, May 26, 1998, 2 Pages, can be retrieved at <URL:https://www.ncbi.nlm.nih.gov/nuccore/AF034210>.
GenBank: JN210900.1, "*Enterobacter* sp. WS05 16S ribosomal RNA gene, partial sequence," NCBI, Sep. 24, 2012, 1 Page, can be retrieved at <URL:https://www.ncbi.nlm.nih.gov/nuccore/jn210900>.
GenBank: NP_001237541.1, "aspartate aminotransferase glyoxysomal isozyme AAT1 precursor [Glycine max]," NCBI, Oct. 29, 2016, 2 Pages, can be retrieved at <URL:https://www.ncbi.nlm.nih.gov/protein/NP_001237541.1>.

(56) References Cited

OTHER PUBLICATIONS

GenEmbl Database, GenEmbl Record No. KF673660, Sandberg, et al., "Fungal endophytes of aquatic macrophytes: diverse host-generalists characterized by tissue preferences and geographic structure," 2013, 35 Pages.
GenEmbl Database, GenEmbl Record No. KP991588, Huang, et al., "Pervasive effects of wildfire on foliar endophyte communities in montane forest trees," Mar. 2015, 35 Pages.
GenEmbl Database, GenEmbl Record No. JN872548, 38 Pages, Alvarez-Perez, S., et al., "Zooming-in on floral nectar: a first exploration of nectar-associated bacteria in wild plant communities," FEMS Microbiol. Ecol., 2012, vol. 80, No. 3, pp. 591-602.
GenEmbl database, GenEmbl Record No. EU 977189, Jan. 21, 2009, 4 Pages, Smith, S.A., et al., "Bioactive endophytes warrant intensified exploration and conservation," PloS ONE 3(8):E3052, 2008.
GenEmbl database, GenEmbl Record No. KF011597, Paenibacillus strain No. HA 13, Aug. 26, 2013, 5 Pages, Park, H.J., et al., "Isolation and characterization of humic substances-degrading bacteria from the subarctic Alaska grasslands," J Basic Microbiol, 2013.
Hahm, M-S., et al., "Biological Control and Plant Growth Promoting Capacity of Rhizobacteria and Pepper Under Greenhouse and Field Conditions," The Journal of Microbiology, The Microbiological Society of Korea, Heidelberg, Jun. 30, 2012, pp. 380-385, vol. 50, No. 3.
Kuklinsky-Sobral, J., et al., "Isolation and characterization of soybean-associated bacteria and their potential for plant growth promotion," Environmental Microbiology, 2004, pp. 1244-1251, vol. 6, No. 12.
Labeda, D.P., et al., "Phylogenetic study of the species within the family Streptomycetaceae," Antonie van Leeuwenhoek, 2012, vol. 101, pp. 73-104, Springer.
Misk, A., et al., "Biocontrol of chickpea root rot using endophytic actinobacteria", Biocontrol, vol. 56, No. 5, Mar. 12, 2011, pp. 811-822, XP036215297.
Op De Beeck, M., et al., "Comparison and Validation of Some ITS Primer Pairs Useful for Fungal Metabarcoding Studies," PLOS ONE, Jun. 2014, vol. 9, Issue 6, e97629, pp. 1-11.
Riken, Gi No. GMFL01-01-D03, 2 Pages, [online] [Retrieved on Dec. 18, 2017] Retrieved from the internet <URL:http://spectra.psc.riken.jp/menta.cgi/rsoy/datail?id=GMFL01-01-D03>.
Senthilkumar, M., et al., "Biocontrol Potential of Soybean Bacterial Endophytes Against Charcoal Rot Fungus, *Rhizoctonia batatiola,*" Current Microbiology, 2009, vol. 58, pp. 288-293.
Sogonov, M.V., et al., "The hyphomycete *Teberdinia hygrophila* gen. nov., sp. nov. and related anamorphs of *Pseudeurotium* species," Mycologia, May 2005, pp. 695-709, vol. 97, No. 3.
Thakur, A., et al., "Detrimental effects of endophytic fungus *Nigrospora* sp. on survival and development of Spodoptera litura," Biocontrol Science and Technology, Feb. 1, 2012, pp. 151-161, vol. 22, No. 2.
Thakur, A., et al., "Enhanced Resistance to Spodoptera litura in Endophyte Infected Cauliflower Plants," Environmental Entomology, Apr. 1, 2013, pp. 240-246, vol. 42, No. 2.
Thakur, A., et al., "Suppression of Cellular Immune Response in Spodoptera litura (Lepidoptera: Noctuidae) Larvae by Endophytic Fungi *Nigrospora oryzae* and *Cladosporium uredinicola,*", Annals of the Entomological Society of America, May 1, 2014, pp. 674-679, vol. 107, No. 3.
Verkley, G., et al., "Paraconiothyrium, a new genus to accommodate the mycoparasite Coniothyrium minitans, anamorphs of Paraphaeosphaeria, and four new species," Studies in Mycology, 2004, pp. 323-335, vol. 50.
Visagie, C.M., et al., "Identification and nomenclature of the genus *Penicillium,*" Studies in Mycology, Jun. 2014, pp. 343-371, vol. 78.
Zhang, J., et al: "Isolation and Characterization of Plant Growth-Promoting Rhizobacteria from Wheat Roots by Wheat Germ Agglutinin Labeled with Fluorescein Isothiocyanate", The Journal of Microbiology, Apr. 27, 2012, vol. 50, No. 2, pp. 191-198, GenBank Accession No. JN210900.
Zhao, J.H., et al., "Bioactive secondary metabolites from *Nigrospora* sp. LLGLM003, an endophytic fungus of the medicinal plant Moringa oleifera Lam." World Journal of Microbiology and Biotechnology, Kluwer Academic Publishers, Feb. 12, 2012, pp. 2107-2112, vol. 28, No. 5.
Garazzino, S., et al., "Osteomyelitis Caused by Enterobacter cancerogenus Infection following a Traumatic Injury: Case Report and Review of the Literature," J Clin Microbiol., Mar. 2005, vol. 43, No. 3, pp. 1459-1461.
Humann, J., et al., "Complete genome of the onion pathogen Enterobacter cloacae EcWSU1," Standard in Genomic Sciences, Dec. 31, 2011, vol. 5, No. 3, pp. 279-286.
Kumar, S., et al., "MEGA7: Molecular Evolutionary Genetics Analysis version 7.0 for bigger datasets," Molecular Biology and Evolution, Mar. 22, 2016, vol. 33, pp. 1870-1874.
Nishijima, K.A., et al., "Demonstrating Pathogenicity of Enterobacter cloacae on Macadamia and Identifying Associated Volatiles of Gray Kernel of Macadamia in Hawaii," Plant Disease, Oct. 2007, vol. 91, No. 10, pp. 1221-1228.
Ren, Y., et al., "Complete Genome Sequence of *Enterobacter cloacae* subsp. cloacae Type Strain ATCC 13047," J. Bacteriol. May 2010, vol. 192, No. 9, pp. 2463-2464.
Tamura, K., et al., "Estimation of the No. of nucleotide substitutions in the control region of mitochondrial DNA in humans and chimpanzees," Molecular Biology and Evolution, 1993, vol. 10, No. 3, pp. 512-526.
Hoffman, M., et al., "Diverse Bacteria Inhabit Living Hyphae of Phylogenetically Diverse Fungal Endophytes," Applied and Environmental Microbiology, Jun. 2010, p. 4063-4075, vol. 76, No. 12.
Hoffman, M., et al., "Endohyphal Bacterium Enhances Production of Indole-3-Acetic Acid by a Foliar Fungal Endophyte," PLOS One, Sep. 24, 2013, pp. 1-8, vol. 8, Issue 9, e73132.
Jung, C., et al., "The Effects of Endohyphal Bacteria on Anti-Cancer and Anti-Malaria Metabolites of Endophytic Fungi," Honors Thesis, University of Arizona, May 2012, 15 Pages.
Kim, M., et al., "Towards a taxonomic coherence between average nucleotide identity and 16S rRNA gene sequence similarity for species demarcation of prokaryotes", Int J Systematic Evolutionary Microbial., 2014, vol. 64, pp. 346-351.
Yennamalli, R., et al., "Endoglucanases: insights into thermostability for biofuel applications", Biotech Biofuels, 2013, vol. 6, Issue 136, pp. 1-9.
Antony-Badu, S., et al., "Multiple *Streptomyces* species with distinct secondary metabolomes have identical 16S rRNA gene sequences." Scientific Reports 7.1, Sep. 2017, No. 7, 11089, pp. 1-8.
Artursson, V., et al., "Interactions between arbuscular mycorrhizal fungi and bacteria and their potential for stimulating plant growth", Environmental Microbiology, vol. 8, No. 1, Jan. 1, 2006, pp. 1-10.
Azcon, R., et al., "Selective interactions between different species of mycorrhizal fungi and Rhizobium meliloti strains, and their effects on growth, N2-fixation (15N) and nutrition of *Medicago sativa* L.," New PhytoL., 1991, vol. 117, pp. 399-404.
Fox, G., et al., "How close is close: 16S rRNA sequence identity may not be sufficient to guarantee species identity." International Journal of Systematic and Evolutionary Microbiology 42.1, 1992, pp. 166-170.
Kanbar, A., et al., "Relationship between Root and Yield Morphological Characters in Rainfed Low Land Rice (*Oryza sativa* L.)," Cereal Research Communications, 2009, vol. 37, No. 2, pp. 261-268.
NCBI, GenBank Accession No. KX641980.1, Jul. 29, 2017, Scott, M., et al., "*Dothideomycetes* sp. isolate FT14-6 internal transcribed spacer 1, partial sequence; 5.8S ribosomal RNA gene and internal transcribed spacer 2, complete sequence; and large subunit ribosomal RNA gene, partial sequence," 2 Pages, Can be retrieved at <URL:https://www.ncbi.nlm.nih.gov/nuccore/KX641980>.
NCBI GenBank: Accession No. JX880250.1, "Enterobacteriaceae bacterium Clero1 16S ribosomal RNA gene, partial sequence," NIH, Jun. 24, 2015, 2 Pages, can be retreived at <URL:https://www.ncbi.nlm.nih.gov/nucleotide/JX880250.1?report=genbank&log$=nuclalign&blast_rank=80&RID=KWUPBV08015>.

(56) References Cited

OTHER PUBLICATIONS

Sarkar, S., et al., "New report of additional enterobacterial species causing wilt in West Bengal, India," Canadian Journal of Microbiology, 2015, vol. 61, No. 7, pp. 477-486.

PCT International Search Report and Written Opinion for PCT/US2017/064361, dated May 11, 2018, 22 Pages.

PCT International Search Report and Written Opinion, PCT Application No. PCT/US2017/064292, dated May 11, 2018, 20 Pages.

Canadian Patent Office, Office Action, Canadian Patent Application No. 2,935,218, dated May 8, 2018, 5 Pages.

European Patent Office, Extended European Search Report, European Patent Application No. EP 15876324.3, dated Jun. 12, 2018, 9 Pages.

Intellectual Property Australia, Examination Report No. 1 for Australian Patent Application No. AU 2017210482, dated May 15, 2018, 4 Pages.

Russian Patent Office, Office Action for Russian Patent Application No. RU 2017141758, dated Apr. 17, 2018, 4 Pages (with Concise Explanation of Relevance).

Russian Patent Office, Office Action for Russian Patent Application No. RU 2017141632, dated Apr. 17, 2018, 4 Pages (with Concise Explanation of Relevance).

Office Action for Israel Patent Application No. IL 245385, Apr. 23, 2018, 3 Pages (With Concise Explanation of Relevance).

Aveskamp, M., et al., "DNA phylogeny reveals polyphyly of Phoma section Peyronellaea and multiple taxonomic novelties," Mycologia, 2009, vol. 101, No. 3, pp. 363-382.

Bing, LA, et al., "Suppression of Ostrinia nubilalis (Hübner) (Lepidoptera: Pyralidae) by endophytic Beauveria bassiana (Balsamo) Vuillemin", Environmental Entomol, Entomological Society of America, College Park, MD, US, vol. 20, Jan. 1, 1991, pp. 1207-1211.

Compant, S., et al., "Endophytic colonization of Vitis vinfera L. By Burkholderia phytofirmans strain PsJN: from the rhizosphere to inflorescence tissues," FEMS Microbiol Ecol, 2008, pp. 84-93, vol. 63.

Database Embl [Online] Oct. 1, 2001, 2 Pages, "Setosphaeria monoceras 28S ribosomal RNA gene, partial sequence," XP002777918, retrieved from EBI accession No. EM_STD:AY016368 Database accession No. AY016368 sequence.

Hubbard, M., et al., 2011. "Agricultural Potential of Fungal Endophytes of Grasses, Cereals and Wheat," In: Wheat: Genetics, Crops and Food Production. Nova Science Publishers Hauppauge, NY, USA. pp. 333-345.

Impullitti, A.E., et al., "Fungal endophyte diversity in soybean", Journal of Applied Microbiolog, vol. 114, No. 5, May 1, 2013, pp. 1500-1506.

Liu, Y., et al., "Phylogenetic relationships among ascomycetes: evidence from an RNA polymerase II subunit," Mol. Biol. Evol. 1999. vol. 16, No. 12, pp. 1799-1808.

Miyoshi-Akiyama, T., et al., "Multilocus Sequence Typing (MLST) for Characterization of Enterobacter cloacae," PLoS ONE, 2013, vol. 8, No. 6, 10 Pages, e66358.

Nassar, A., et al., "Promotion of plant growth by an auxin-producing isolate of the yeast *Williopsis saturnus* endophytic in maize (*Zea mays* L.) roots", Biology and Fertility of Soils; Cooperating Journal of International Society of Soil Science, Springer, Berlin, DE, vol. 42, No. 2, Nov. 1, 2005, pp. 97-108.

O'Hanlon, K., et al., "Exploring the potential of symbiotic fungal endophytes in cereal disease suppression", Biological Control, vol. 63, No. 2, Sep. 5, 2012, pp. 69-78.

Riess, K., et al., "High genetic diversity at the regional scale and possible speciation in Sebacina epigaea and S. incrustans," BMC Evolutionary Biology, 2013, vol. 13, No. 102, 17 Pages.

Stielow, J.B., et al., "One fungus, which genes? Development and assessment of universal primers for potential secondary fungal DNA barcodes," Persoonia: Molecular Phylogeny and Evolution of Fungi, 2015, vol. 35, pp. 242-263.

Vujanovic, V., et al., "A comparative study of endophytic mycobiota in leaves of Acer saccharum in eastern North America," Mycological Progress, May 2002, pp. 147-154, vol. 1, Issue 2.

Vujanovic, V., et al.,"Orchid seed viability testing by fungal bioassays and molecular phylogeny," Floriculture, ornamental and plant biotechnology, 2006, vol. 63, pp. 563-569.

Vujanovic, V., et al., "19th International Conference on *Arabidopsis*. Research Proceedings—ICAR13," Jul. 23-27, 2008, 264 Pages, Montreal, QC, Canada.

Vujanovic, V., et al., "Mycovitality and mycoheterotrophy: where lies dormancy in terrestrial orchid and plants with minute seeds?" Symbiosis, 2007, vol. 44, pp. 93-99.

Vujanovic, V., et al: "Fungal communities associated with durum wheat production system: A characterization by growth stage, plant organ and preceding crop", Crop Protection, Elsevier Science, GB, vol. 37, Feb. 19, 2012, pp. 26-34.

Zhang, Y., et al., "BcGsl, a glycoprotein from Botrytis cinerea, elicits defence response and improves disease resistance in host plants. Biochemical and biophysical research communications," Biochemical and Biophysical Research Communications, 2015, vol. 457, No. 4, pp. 627-634.

Zhang, W., et al., Host range of Exserohilum monoceras, a potential bioherbicide for the control of *Echinochloa* species, Canadian Journal of Botany/ Journal Canadien De Botan, National Research Council, Ottawa, CA, vol. 75, Jan. 1, 1997, pp. 685-692.

Zhu et al., Helminthosporium velutinum and *H. aquaticum* sp. nov. from aquatic habitats in Yunnan Province, China. Phytotaxa, 2016, vol. 253, No. 3, pp. 179-190.

Barnett, S., et al., "Selection of microbes for control of Rhizoctonia root rot on wheat using a high throughput pathosystem", Biological Control, Jul. 6, 2017, 113: 45-57.

Bashan, Yoav Ed, et al., "Inoculants of plant growth-promoting bacteria for use in agriculture," Biotechnology Advances, Elsevier Publishing, Barking, GB, vol. 16, No. 4, Jul. 1 1998, pp. 729-770, XP004123985.

De Medeiros, L., et al., "Evaluation of Herbicidal Potential of Depsides from Cladosporium uredinicola an Endophytic Fungus found in Guava Fruit," J. Braz. Chem. Soc., 2012, vol. 23, No. 8, p. 1551-1557.

Iverson, C., et al, "The taxonomy of Enterobacter sakazakii: proposal of a new genus *Cronobacter* gen. nov. and descriptions of *Cronobacter sakazakii* comb. nov. *Cronobacter sakazakii* subsp. sakazakii, comb. nov., *Cronobacter sakazakii* subsp. *malonaticus* subsp. nov., *Cronobacter turicensis* sp. nov., *Cronobacter muytjensii* sp. nov., *Cronobacter dublinensis* sp. nov. and *Cronobacter* genomospecies I", BMC Evolutionary Biology 2007, Apr. 17, 2017, 11 pages.

Lind, A., et al., "Drivers of genetic diversity in secondary metabolic gene clusters within a fungal species", PLOS Biology, Nov. 17, 2017, 26 pages.

Manoharan, M. J. et. Al., "Survival of flocculated cells in alginate and its inoculatin effect on growth and yield of maize under water deficit conditions," EP J of Siil Biology, Gauthier-Villars, Montrouge, FR, vol. 50, Mar. 7, 2012, pp. 198-206, XP028421147.

Murali, Gopal, et al., "Microbiome Selection Could Spur Next-Generation Plant Breeding Strategies," Frontiers in Microbiology, vol. 7, Dec. 7, 2016, XP055531064.

United States Patent Office, Non-Final Office Action, U.S. Appl. No. 14/766,065, dated Oct. 27, 2017, 11 Pages.

United States Patent Office, Non-Final Office Action, U.S. Appl. No. 14/964,429, dated Aug. 9, 2016, 6 Pages.

United States Patent Office, Final Office Action, U.S. Appl. No. 14/964,429, dated May 31, 2017, 9 Pages.

United States Patent Office, Non-Final Office Action, U.S. Appl. No. 15/212,038, dated Sep. 21, 2016, 10 Pages.

United States Patent Office, Non-Final Office Action, Appl. No. 15/063,350, dated Nov. 10, 2016, 18 Pages.

United States Patent Office, Final Office Action, U.S. Appl. No. 14/614,193, dated Dec. 22, 2016, 13 Pages.

United States Patent Office, Final Office Action, U.S. Appl. No. 14/614,193, dated Jul. 18, 2017, 14 Pages.

United States Patent Office, Final Office Action, U.S. Appl. No. 14/614,193, dated May 3, 2018, 10 Pages.

(56) References Cited

OTHER PUBLICATIONS

United States Patent Office, Non-Final Office Action, U.S. Appl. No. 15/107,973, dated Apr. 10, 2017, 39 Pages.
United States Patent Office, Final Office Action, U.S. Appl. No. 15/107,973, dated Jan. 26, 2018, 20 Pages.
United States Patent Office, Final Office Action, U.S. Appl. No. 14/410,537, dated May 5, 2017, 9 Pages.
United States Patent Office, Non-Final Office Action, U.S. Appl. No. 15/034,862, dated May 19, 2017, 8 Pages.
United States Patent Office, Final Office Action, U.S. Appl. No. 15/034,862, dated Jan. 12, 2018, 14 Pages.
United States Patent Office, Non-Final Office Action, U.S. Appl. No. 15/436,592, dated Aug. 30, 2017, 17 Pages.
United States Patent Office, Non-Final Office Action, U.S. Appl. No. 15/436,609, dated Aug. 30, 2017, 21 Pages.
United States Patent Office, Non-Final Office Action, U.S. Appl. No. 14/916,514, dated Sep. 20, 2017, 31 Pages.
United States Patent Office, Non-Final Office Action, U.S. Appl. No. 15/143,398, dated Sep. 22, 2017, 17 Pages.
United States Patent Office, Non-Final Office Action, U.S. Appl. No. 15/143,394, dated Sep. 25, 2017, 15 Pages.
United States Patent Office, Non-Final Office Action, U.S. Appl. No. 15/107,965, dated Jun. 21, 2018, 27 Pages.
Orakçi GE et al, "Selection of antagonistic actinomycete isolates as biocontrol agents against root-rot fungi", Fresenius Environmental Bulletin, 2010, 19: 417-424 & GenBank Accession No. GQ475299, Oct. 5, 2009.
Ikeda, H., et al., "Complete genome sequence and comparative analysis of the industrial microorganism Streptomyces avermitilis," Nat Biotechnol. May 2003;21 (5) :526-31. Epub Apr. 14, 2003. (Year: 2003).
Lee, J., et al., "*Streptomyces koyangensis* sp. nov., a novel actinomycete that produces 4-phenyl-3-butenoic acid," Int J Syst Evol Microbial. Jan. 2005;55(Pt 1):257-62. (Year: 2005).
Bently, S.D., et al, "Complete genome sequence of the model actinomycete Streptomyces coelicolor A3(2)," Nature. May 9, 2002;417(6885):141-7. (Year: 2002).
Gabor, J., et al., "Mycorrhizal fungi effects on nutrient composition and yield of soybean seeds," Journal of Plant Nutrition, 20:4-5, 581-591, 1997.
Gopalakrishnan, S. et al., "Plant growth-promoting activities of Streptomyces spp. In sorghum and rice", SpringerPlus, 2/1/574, pp. 1-8, http://www.springerplus.com/content/2/1/574, 2013.
Groppe, K., et al., "Interaction between the endophytic fungus Epichloë bromicola and the grass Bromus erectus: effects of endophyte infection, fungal concentration and environment on grass growth and flowering," Mol Ecol., 8:1827-1835, 1999.
Hubbard, M., "Fungal Endophytes that Confer Heat and Drought Tolerance to Wheat," Doctoral dissertation, University of Saskatchewan, 2012.
Ikeda, H., et al., "Complete genome sequence and comparative analysis of the industrial microorganism Streptomyces avermitilis," Nat Biotechnol. 2003 May;21 (5) :526-31. Epub Apr. 14, 2003 (Year: 2003).
Langille, M., et al., "Predictive functional profiling of microbial communities, using 16S rRNA marker gene sequences", Nature Biotechnology, vol. 31, No. 9, Sep. 2013, 11 pages.
Lee, J., et al., "Streptomyces koyangensis sp. nov., a novel actinomycete that produces 4-phenyl-3-butenoic acid," Int J Syst Evol Microbial. 2005 Jan;55(Pt 1):257-62. (Year: 2005).
Pacovsky, R., "Carbohydrate, protein and amino acid status of Glycine-Glomus-Bradyrhizobium symbioses," Physiologia Pantarium; 75:346-354, 1989).
Wiebold, M., et al., "Agriculture Experiment Station, College of Agriculture, Food & Natural Resources, University of Missouri, Special Report 589, pp. 1-124).".
Abello, J., et al., "Agrobacterium-mediated transformation of the endophytic fungus Acremonium implicatum associated with Brachiaria grasses", Mycological Research, pp. 407-413, vol. 112, Pt 3.
Al-Askar AA, "Microbiological studies on the in vitro inhibitory effect of Streptomyces collinus albescens against some phytopathogenic fungi", African Journal of Microbiology Research, 2012, 6: 3277-3283 & GenBank Accession No. AB184101, May 20, 2008.
Ardakani, M.R. et al., "Absorption of N, P, K through triple inoculation of wheat (Triticum aestivum L.) by Azospirillum brasilense, Streptomyces sp., Glomus intraradices and manure application," Physiol Mol Biol Plants, 2011, vol. 17, No. 2, pp. 181-192.
Bandara, W.M.M.S., et al., "Interactions among endophytic bacteria and fungi: effects and potentials", Journal of Biosciences, Dec. 2006, vol. 31, No. 5, pp. 645-650.
Barnett, S., et al., "Selection of microbes for control of Rhizoctonia root rot on wheat using a high throughput pathosystem", Biological Control, 6 Jul. 2017, 113: 45-57.
Bashan, Yoav Ed, et al., "Inoculants of plant growth-promoting bacteria for use in agriculture," Biotechnology Advances, Elsevier Publishing, Barking, GB, Vol,. 16, No. 4, 1 Jul. 1998, pp. 729-770, XP004123985.
Bashan, Yoav E., et al., "Alginate Beads as Synthetic Inoculant Carriers for Slow Release of Bacteria that Affect Plant Growth," Applied and Environmental Microbiology, pp. 1089-1098, May 1986.
Bragantia, et al: "Identificaqao E Avaliaqao De Rizobacterias Isoladas De Raizes De Milho," Jan. 1, 2010, pp. 905-911, Retrieved from the Internet: URL:http://www.scielo.br/pdf/brag/v69n4/v69n4a17.pdf (With English Abstract).
Chenhua Li , et al., "Change in deep soil microbial communities due to long-term fertilization," Soil Biology and Biochemistry, vol. 75, Mar. 5, 2014, pp. 264-272, XP055530941.
Cheow, W.S., et al., "Biofilm-like Lactobacillus rhamnosus Probiotices Encapsulated in Algiinate and Carrageenan Microcapsules Exhibiting Enhanced Thermotolerance and Freeze-drying Resistance," Biomacromolecules 2013, vol. 14(9):3214-3222.
De Medeiros, L., et al., "Evaluation of Herbicidal Potential of Depsides from Cladosporium uredinicola an Endophytic Fungus found in Guava Fruit," J. Braz. Chem. Soc., 2012, vol. 23, No. 8, pg. 1551-1557.
De Santi, M. et al., "A combined morphologic and molecular approach for characterizing fungal microflora from a traditional Italian cheese (Fossa cheese)," Inter. Dairy J., 2010, vol. 10, No. 7, pp. 465-471.
Fatima Z et al, "Antifungal activity of plant growth-promoting rhizobacteria isolates against Rhizoctonia solani in wheat", African Journal of Biotechnology, 2009, 8: 219-225.
GenBank Accession No. KY643705, Feb. 27, 2017.
GenBank Accession No. KF951483, Jan. 5, 2014.
GenBank Accession No. KJ152029, May 6, 2015.
GenBank Accession No. KJ162248, Apr. 8, 2014.
Ncbi, GenBank Accession No. XP_002568042, Aug. 14, 2009, 4 Pages, Berg, V.D., et al., "Genome sequencing and analysis of the filamentous fungus," Nat. Biotechnol. 26 (10), 1161-1168 (2008).
Goudjal, Y., et al., "Biocontrol of Rhizoctonia solanidamping-off and promotion of tomato plant growth by endophytic actinomycetes isolated from native plants of Algerian Sahara", Microbiological Research, 2014, vol. 169, No. 1, pp. 59-65.
Govindarajan, M. et al., "Effects of the Inoculation of Burkholderia vietnamensis and Related Endophytic Diaztrophic Bacteria on Grain Yield of Rice", Mircobial Ecology, Apr. 4, 2007, 17 pages.
Guo, X., et al., "Red Soils Harbor Diverse Culturable Actinomycetes That Are Promising Sources of Novel Secondary Metabolites", Applied and Environmental Microbiology, Feb. 27, 2015, vol. 81, No. 9, pp. 3086-3103.
Hain, T., et al., "Chitinolytic transgenes from Streptomyces albidoflavus as phytochemicals defences against herbivorous insects, use in transgenic plants and effect in plant development", International Journal of Systematic Bacteriology, Jan. 1997, vol. 47, No. 1, pp. 202-206.
Hanshew, a., et al., "Characterization of Actinobacteria Associated with Three Ant-Plant Mutualisms", Microbial Ecology, Aug., 6, 2017, vol. 69, No. 1, pp. 192-203.
Hjort, K., et al., "Chitinase genes revealed and compared in bacterial isolates, DNA extracts and a metagenomic library from a

(56) References Cited

OTHER PUBLICATIONS phytopathogen-suppressive soil", Fems Microbiology Ecology, Feb. 2010, vol. 71, No. 2, pp. 197-207.
Iverson, C., et al, "The taxonomy Cronobacter gen. nov. And descriptions sakazakii, comb. nov., Cronobacter sakazakii nov., Cronobacter muytjensii sp. nov., BMC Evolutionary Biology 2007, Apr. of Enterobacter sakazakii: proposal of Cronobacter sakazakii comb. subsp. malonaticus subsp. of a new genus nov. Cronobacter sakazakii subsp. nov., Cronobacter turicensis sp. nov. And Cronobacter genomospecies I",.Cronobacter dublinensis sp. 17, 2017, 11 pp.
Joe, M.M. et al., "Development of alginate-based aggregate inoculants of Methylobacterium sp. And Azospirillum brasilense tested under in vitro conditions to promote plant growth," Journal of Applied Microbiology 2013, 116(2):408-423, XP055225426, Nov. 22, 2013.
Li, M., et al., "Atp Modulates the Growth of Specific Microbial Strains", Current Microbiology, May 30, 2010, vol. 62, no. 1, pp. 84-89.
Lind, a., et al., "Drivers of genetic diversity in secondary metabolic gene clusters within a fungal species", Plos Biology, Nov. 17, 2017, 26 pp.
Manoharan, M. J. et. Al., "Survival of flocculated cells in alginate and its inoculatin effect on growth and yield of maize under water deficit conditions," Ep J of Siil Biology, Gauthier-Villars, Montrouge, Fr, vol. 50, 7 Mar. 2012, pp. 198-206, XP028421147.
Mural!, Gopal, et al., "Microbiome Selection Could Spur Next-Generation Plant Breeding Strategies," Frontiers in Microbiology, vol. 7, Dec. 7, 2016, XP055531064.
United States Patent Office, Non-Final Office Action, U.S. Appl. No. 14/766,065, Oct. 27, 2017, 11 pages.
United States Patent Office, Non-Final Office Action, U.S. Patent Appl. No. 14/964,429, Aug. 9, 2016, 6 pages.
United States Patent Office, Final Office Action, U.S. Appl. No. 14/964,429, May 31, 2017, 9 pages.
United States Patent Office, Non-Final Office Action, U.S. Appl. No. 15/212,038, Sep. 21, 2016, 10 pages.
United States Patent Office, Non-Final Office Action, U.S. Appl. No. 15/063,350, Nov. 10, 2016, 18 pages.
United States Patent Office, Final Office Action, U.S. Appl. No. 14/614,193, Dec. 22, 2016, 13 pages.
United States Patent Office, Final Office Action, U.S. Appl. No. 14/614,193, Jul. 18, 2017, 14 pages.
United States Patent Office, Final Office Action, U.S. Appl. No. 14/614,193, May 3, 2018, 10 pages.
United States Patent Office, Non-Final Office Action, U.S. Appl. No. 15/107,973, Apr. 10, 2017, 39 pages.
United States Patent Office, Final Office Action, U.S. Appl. No. 15/107,973, Jan. 26, 2018, 20 pages.
United States Patent Office, Final Office Action, U.S. Appl. No. 14/410,537, May 5, 2017, 9 pages.
United States Patent Office, Non-Final Office Action, U.S. Appl. No. 15/034,862, May 19, 2017, 8 pages.
United States Patent Office, Final Office Action, U.S. Appl. No. 15/034,862, Jan. 12, 2018, 14 pages.
United States Patent Office, Non-Final Office Action, U.S. Appl. No. 15/436,592, Aug. 30, 2017, 17 pages.
United States Patent Office, Non-Final Office Action, U.S. Appl. No. 15/436,609, Aug. 30, 2017, 21 pages.
United States Patent Office, Non-Final Office Action, U.S. Appl. No. 14/916,514, Sep. 20, 2017, 31 pages.
United States Patent Office, Non-Final Office Action, U.S. Appl. No. 15/143,398, Sep. 22, 2017, 17 pages.
United States Patent Office, Non-Final Office Action, U.S. Appl. No. 15/143,394, Sep. 25, 2017, 15 pages.
United States Patent Office, Non-Final Office Action, U.S. Appl. No. 15/107,965, Jun. 21, 2018, 27 pages.
Ogbo, F., et al., "Some Characteristics of a Plant Growth Promoting iEnterobacter/isp. Isolated from the Roots of Maize", Advances in Microbiology, Jan. 1, 2012, vol. 02, No. 03, pp. 368-374.
Oracki Ge et al, "Selection of antagonistic actinomycete isolates as biocontrol agents against root-rot fungi", Fresenius Environmental Bulletin, 2010, 19: 417-424 & GenBank Accession No. GQ475299, Oct. 5, 2009.
Partida-Martinez, L.P., et al., "Endosymbiont-Dependent Host Reproduction Maintains Bacterial-Fungal Mutualism", Current Biology, May 1, 2007, vol. 17, No. 9, pp. 773-777.
"Sequence Alignment of JQ047949 with Instant SEQ ID No: 2," Search conducted on Jan. 2, 2019. 2 pages.
Sha, T. et al., "Genetic diversity of the endemic gourmet mushroom Thelephora ganbajun from southwestern China", Microbiology (2008), 154, 3460-3468.
Sharma et al., "Detection and identification of bacteria intimately associated with fungi of the order Sebacinales", Cellular Microbiology, Aug. 5, 2008, pp. 2235-2246, vol. 10, No. 11.
Sugita, T. et al., "Intraspecies Diversity of Cryptococcus laurentii as Revealed by Sequences of Internal Transcribed Spacer Regions and 28S rRNA Gene and Taxonomic Position of C. laurentii Clinical Isolates", Journal of Clinical Microbiology, Apr. 2000, p. 1468-1471.
Wang, L. et al. Application of Bioorganic Fertilizer Significantly Increased Apple Yields and Shaped Bacterial Community Structure in Orchard Soil.
Whelehan, et al., "Microencapsulation using vibrating technology," Journal of Microencapsulation 2011, vol. 28(8), pp: 669-688.
Yashiro et al., "Effect of Streptomycin Treatment on Bacterial Community Structure in the Apple Phyllosphere," PLOS One, May 21, 2012, vol. 7, No. 5, 10 pages.
Zhao, Jun, et al., "Effects of organic-inorganic compound fertilizer with reduced chemical fertilizer application on crop yields, soil biological activity and bacterial community structure in a rice-wheat cropping system," Applied Soil Ecology, vol. 99, Nov. 28, 2015, pp. 1-12, XP055530937.

* cited by examiner

FIG. 1 Continued…
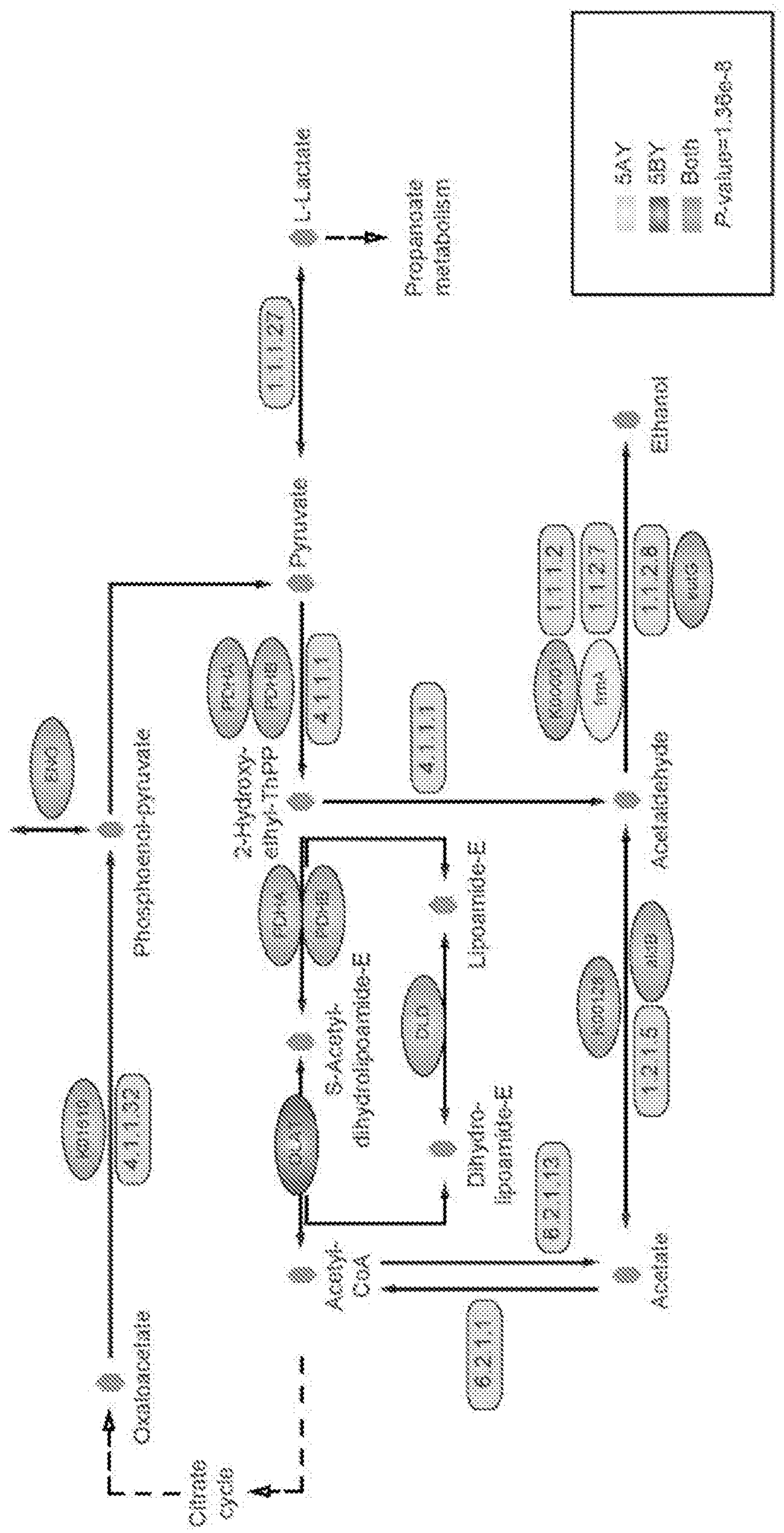

SEED ENDOPHYTES ACROSS CULTIVARS AND SPECIES, ASSOCIATED COMPOSITIONS, AND METHODS OF USE THEREOF

CROSS-REFERENCE TO RELATED APPLICATIONS

This application is the National Stage of International Application No. PCT/US2015/068206, filed Dec. 30, 2015, which claims the benefit of and priority to International Application No. PCT/US2015/038187, filed Jun. 26, 2015, U.S. Provisional Application No. 62/156,021, filed May 1, 2015, U.S. Provisional Application No. 62/156,028, filed May 1, 2015, U.S. Provisional Application No. 62/098,296, filed Dec. 30, 2014, U.S. Provisional Application No. 62/098,298, filed Dec. 30, 2014, U.S. Provisional Application No. 62/098,299, filed Dec. 30, 2014, U.S. Provisional Application No. 62/098,302, filed Dec. 30, 2014, and U.S. Provisional Application No. 62/098,304, filed Dec. 30, 2014, each of which is incorporated by reference it its entirety.

SEQUENCE LISTING

The instant application contains a Sequence Listing with 4957 sequences which has been submitted via EFS-Web and is hereby incorporated by reference in its entirety. Said ASCII copy, created on Jun. 27, 2017, is named 32831US_10035US_Sequence_Listing.txt, and is 21,064,136 bytes in size.

FIELD OF THE INVENTION

Among other things, inventions disclosed herein relate to compositions and methods for improving the cultivation of plants, particularly agricultural plants. In an aspect, inventions described herein relate to beneficial bacteria and fungi that are capable of living in a plant, which may be used to impart improved agronomic traits to the plants. In another aspect, inventions described herein relate to methods of improving plant characteristics by introducing synthetic combinations of such beneficial bacteria and/or fungi to those plants. Further, inventions described herein also provide methods of treating seeds and other plant elements with synthetic combinations of beneficial bacteria and/or fungi that are capable of living within a plant, to impart improved agronomic characteristics to plants, particularly agricultural plants.

BACKGROUND

Agriculture faces numerous challenges that are making it increasingly difficult to provide food, materials, and fuels to the world's population. Population growth and changes in diet associated with rising incomes are increasing global food demand, while many key resources for agriculture are becoming increasingly scarce. By 2050, the FAO projects that total food production must increase by 70% to meet the needs of the growing population, a challenge that is exacerbated by numerous factors, including diminishing freshwater resources, increasing competition for arable land, rising energy prices, increasing input costs, and the likely need for crops to adapt to the pressures of a more extreme global climate. The need to grow nearly twice as much food in more uncertain climates is driving a critical need for new innovations.

Today, crop performance is optimized via of technologies directed towards the interplay between crop genotype (e.g., plant breeding, genetically-modified (GM) crops) and its surrounding environment (e.g., fertilizer, synthetic herbicides, pesticides). While these paradigms have assisted in doubling global food production in the past fifty years, yield growth rates have stalled in many major crops and shifts in the climate have been linked to production declines in important crops such as wheat. In addition to their long development and regulatory timelines, public fears of GM-crops and synthetic chemicals has challenged their use in many key crops and countries, resulting in a complete lack of acceptance for GM traits in wheat and the exclusion of GM crops and many synthetic chemistries from European markets. Thus, there is a significant need for innovative, effective, and publically-acceptable approaches to improving the intrinsic yield and resilience of crops to severe stresses.

SUMMARY OF THE INVENTION

The disclosures of PCT/US2014/044427, filed Jun. 26, 2014, U.S. application Ser. No. 14/316,469, filed Jun. 26, 2014, and PCT/US2014/054160, filed Sep. 4, 2014, are incorporated by reference in their entirety, including the sequence listings containing SEQ ID NOs: 1-1448.

The present invention is based on the discovery that a plant element (e.g., a whole plant, seedling, meristematic tissue, ground tissue, vascular tissue, dermal tissue, seed, leaf, root, shoot, stem, flower, fruit, stolon, bulb, tuber, corm, kelkis, shoot, bud) can be effectively augmented by associating its surface with a single endophyte strain or a plurality of endophytes in an amount that is not normally found on the plant element. Endophytes described herein can be isolated from inside the same plant or a different plant, or from inside a part or tissue of the same plant or different plant. The plant element thus associated with a single endophyte strain or a plurality of endophytes can be used to confer improved agronomic trait or traits to the seed or the plant that is grown or derived from the plant element.

In an embodiment, the invention features a method for improving an agricultural trait in an agricultural plant. In an embodiment, the method includes providing an agricultural plant, seed or tissue thereof; contacting the plant, seed or tissue thereof with a formulation comprising an endophyte that is common to at least two donor plant types that is present in the formulation in an amount effective to colonize the plant; and growing the plants under conditions that allow the endophyte to improve a trait in the plant. In some embodiments, the two donor plants are of the same family. In some embodiments, the two donor plants are of the same genus. In some embodiments, the two donor plants are of the same species. In some embodiments, the agricultural plant tissue, is a seed. In a further embodiment, the population is disposed on the surface of the seed.

In an embodiment, the method for improving an agricultural trait in an agricultural plant includes providing a modern agricultural plant, seed or tissue thereof; contacting the plant, seed, or tissue thereof with a formulation comprising an endophyte derived from an ancestral plant in an amount effective to colonize the plant; and allowing the plant to grow under conditions that allow the endophyte to colonize the plant.

The invention also features a method for preparing a seed comprising an endophyte population. The method comprising applying to an exterior surface of a seed a formulation comprising an endophyte population consisting essentially of an endophyte comprising a 16S rRNA or ITS rRNA nucleic acid sequence at least 95% identical to a nucleic acid sequence selected from the group consisting of SEQ ID NOs: 1-455.

In some embodiments, provided herein is a method for treating seedlings. The method includes contacting foliage or the rhizosphere of a plurality of agricultural plant seedlings with a seed a formulation comprising an endophyte population consisting essentially of an endophyte comprising a 16S rRNA or ITS rRNA nucleic acid sequence at least 95% identical to a nucleic acid sequence selected from the group consisting of SEQ ID NOs: 1-455; and growing the contacted seedlings.

The invention also features a method for modulating a plant trait. The method includes applying to vegetation or an area adjacent the vegetation, a seed a formulation comprising an endophyte population consisting essentially of an endophyte comprising a 16S rRNA or ITS rRNA nucleic acid sequence at least 95% identical to a nucleic acid sequence selected from the group consisting of SEQ ID NOs: 1-455, wherein the formulation is capable of providing a benefit to the vegetation, or to a crop produced from the vegetation.

A method for modulating a plant trait also is featured. The method comprising applying a formulation to soil, the seed a formulation comprising an endophyte population consisting essentially of an endophyte comprising a 16S rRNA or ITS rRNA nucleic acid sequence at least 95% identical to a nucleic acid sequence selected from the group consisting of SEQ ID NOs: 1-455, wherein the formulation is capable of providing a benefit to seeds planted within the soil, or to a crop produced from plants grown in the soil.

In some embodiments, the endophyte comprises a 16S rRNA or ITS rRNA nucleic acid sequence at least 95% identical to a nucleic acid sequence selected from the group consisting of SEQ ID NOs: 1-455. In some embodiments, the endophyte is capable of a function or activity selected from the group consisting of auxin production, nitrogen fixation, production of an antimicrobial compound, mineral phosphate solubilization, siderophore production, cellulase production, chitinase production, xylanase production, and acetoin production. In some embodiments, the endophyte exhibits at least two of: auxin production, nitrogen fixation, production of an antimicrobial compound, mineral phosphate solubilization, siderophore production, cellulase production, chitinase production, xylanase production, and acetoin production.

In some embodiments, the endophyte is capable of metabolizing at least one substrate selected from the group consisting of: a-D-glucose, arabinose, arbutin, b-methyl-D-galactoside, b-methyl-D-glucoside, D-alanine, D-arabitol, D-aspartic acid, D-cellobiose, dextrin, D-fructose, D-galactose, D-gluconic acid, D-glucosamine, dihydroxyacetone, DL-malic acid, D-mannitol, D-mannose, D-melezitose, D-melibiose, D-raffinose, D-ribose, D-serine, D-threonine, D-trehalose, D-xylose, g-amino-N-butyric acid, g-cyclodextrin, gelatin, gentiobiose, glycogen, glycyl-L-aspartic acid, glycyl-L-glutamic acid, glycyl-L-proline, glyoxylic acid, i-erythritol, inosine, L-alanine, L-alanyl-glycine, L-arabinose, L-asparagine, L-aspartic acid, L-galactonic acid-g-lactone, L-glutamic acid, L-glutamine, L-histidine, L-proline, L-rhamnose, L-serine, L-threonine, maltitol, maltose, maltotriose, mannose, N-acetyl-D-glucosamine, oxalic acid, palatinose, pectin, proline, salicin, stachyose, sucrose, trehalose, turanose, tyramine, uridine, and xylose.

In some embodiments, the endophyte is capable of metabolizing at least two substrates selected from the group consisting of: a-D-glucose, arabinose, arbutin, b-methyl-D-galactoside, b-methyl-D-glucoside, D-alanine, D-arabitol, D-aspartic acid, D-cellobiose, dextrin, D-fructose, D-galactose, D-gluconic acid, D-glucosamine, dihydroxyacetone, DL-malic acid, D-mannitol, D-mannose, D-melezitose, D-melibiose, D-raffinose, D-ribose, D-serine, D-threonine, D-trehalose, D-xylose, g-amino-N-butyric acid, g-cyclodextrin, gelatin, gentiobiose, glycogen, glycyl-L-aspartic acid, glycyl-L-glutamic acid, glycyl-L-proline, glyoxylic acid, i-erythritol, inosine, L-alanine, L-alanyl-glycine, L-arabinose, L-asparagine, L-aspartic acid, L-galactonic acid-g-lactone, L-glutamic acid, L-glutamine, L-histidine, L-proline, L-rhamnose, L-serine, L-threonine, maltitol, maltose, maltotriose, mannose, N-acetyl-D-glucosamine, oxalic acid, palatinose, pectin, proline, salicin, stachyose, sucrose, trehalose, turanose, tyramine, uridine, and xylose.

In some embodiments, the endophyte is present at a concentration of at least $10^2$ CFU or spores per seed on the surface of seeds after contacting. In some embodiments, the applying or contacting comprises spraying, immersing, coating, encapsulating, or dusting the seeds or seedlings with the formulation.

In some embodiments, the benefit or agricultural trait is selected from the group consisting of: increased root biomass, increased root length, increased height, increased shoot length, increased leaf number, increased water use efficiency, increased tolerance to low nitrogen stress, increased nitrogen use efficiency, increased overall biomass, increased grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, a detectable modulation in the transcriptome, and a detectable modulation in the proteome, relative to reference seeds or agricultural plants derived from reference seeds. In some embodiments, the benefit or agricultural trait comprises at least two benefits or agricultural traits selected from the group consisting of: increased root biomass, increased root length, increased height, increased shoot length, increased leaf number, increased water use efficiency, increased tolerance to low nitrogen stress, increased nitrogen use efficiency, increased overall biomass, increased grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, a detectable modulation in the transcriptome, and a detectable modulation in the proteome, relative to reference seeds or agricultural plants derived from reference seeds. In some embodiments, the benefit is increased tolerance to low nitrogen stress or increased nitrogen use efficiency, and the endophyte is non-diazotrophic.

In some embodiments, the formulation comprises at least one member selected from the group consisting of an agriculturally compatible carrier, a tackifier, a microbial stabilizer, a fungicide, an antibacterial agent, an herbicide, a nematicide, an insecticide, a plant growth regulator, a rodenticide, and a nutrient.

In some embodiments, the endophyte comprises a nucleic acid sequence that is at least 97% identical to a nucleic acid sequence selected from the group consisting of SEQ ID NOs: 1-455, wherein the endophyte is present in the formulation in an amount effective to colonize the mature agricultural plant. In some embodiments, the endophyte comprises a nucleic acid sequence that is at least 99% identical to a nucleic acid sequence selected from the group consisting of SEQ ID NOs: 1-455, wherein the endophyte is present in the formulation in an amount effective to colonize the mature agricultural plant. In some embodiments, the endophyte comprises a nucleic acid sequence that is at least 99.5% identical to a nucleic acid sequence selected from the group consisting of SEQ ID NOs: 1-455, wherein the endophyte is present in the formulation in an amount effective to colonize the mature agricultural plant.

In some embodiments, the plant, seed or tissue thereof is contacted with at least 10 CFU or spores, at least 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, at least 1,000,000 CFU or spores, or more, of the endophyte.

In some embodiments, the formulation comprises at least two endophytes comprising a nucleic acid sequence that is at least 97% identical, at least 98% identical, at least 99% identical, at least 99.5% identical, or 100% identical, to a nucleic acid sequence selected from the group consisting of SEQ ID NOs: 1-455, wherein the at least two endophytes are present in the formulation in an amount effective to colonize the mature agricultural plant. In some embodiments, the formulation comprises at least two endophytes provided in Table 1, Table 2, Table 7 and Table 8.

In some embodiments, the plant is a monocot. The monocot can be corn, wheat, barley or rice. In some embodiments, the plant is a dicot. The dicot can be a soybean, peanut, canola, cotton, *Brassica Napus*, cabbage, lettuce, melon, strawberry, turnip, watermelon, tomato or pepper.

In some embodiments, the endophyte is present in the formulation in an amount effective to be detectable within a target tissue of the agricultural plant selected from a fruit, seed, leaf, root or portion thereof.

In some embodiments, the endophyte is detected in an amount of at least 10 CFU or spores, at least 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, at least 1,000,000 CFU or spores, or more, in the target tissue.

In some embodiments, the endophyte is present in the formulation in an amount effective to increase the biomass and/or yield of the fruit or seed produced by the plant by at least 1%, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with the fruit or seed of a reference agricultural plant.

In some embodiments, the endophyte is present in the formulation in an amount effective to detectably increase the biomass of the plant or tissue thereof. In some embodiments, the biomass of the plant, or tissue thereof is detectably increased by at least 1%, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with a reference agricultural plant.

In some embodiments, the endophyte is present in the formulation in an amount effective to detectably increase the rate of germination of the seed. In some embodiments, the rate of germination of the seed is increased by at least 0.5%, at least 1%, at least 2%, at least 3%, at least 5%, at least 10%, at least 20%, at least 30%, at least 40%, at least 50%, at least 60%, at least 70%, at least 80%, at least 90%, at least 100% or more, when compared with a reference agricultural plant.

In some embodiments, the endophyte is present in the formulation in an amount effective to detectably induce production of auxin in the plant. In some embodiments, the production of auxin in the plant is increased by at least 1%, at least 2%, at least 3%, at least 5%, at least 10%, at least 20%, at least 30%, at least 40%, at least 50%, at least 60%, at least 70%, at least 80%, at least 90%, at least 100% or more, when compared with a reference agricultural plant.

The invention also features an agricultural plant, or portion of tissue thereof, comprising a formulation comprising an endophyte that is common to at least two donor plant types that is disposed on an exterior surface of the plant or portion of tissue thereof, or within the plant or portion of tissue thereof, in an amount effective to colonize the plant, and in an amount effective to provide a benefit to the modern agricultural plant.

In some embodiments of the agricultural plant, or portion of tissue thereof, the endophyte comprises a nucleic acid sequence that is at least 97% identical to a nucleic acid sequence selected from the group consisting of SEQ ID NOs: 1-455. In some embodiments of the agricultural plant, or portion of tissue thereof, the endophyte comprises a nucleic acid sequence that is at least 99% identical to a nucleic acid sequence selected from the group consisting of SEQ ID NOs: 1-455. In some embodiments of the agricultural plant, or portion of tissue thereof, the endophyte comprises a nucleic acid sequence that is at least 99.5% identical to a nucleic acid sequence selected from the group consisting of SEQ ID NOs: 1-455.

In some embodiments of the agricultural plant, or portion of tissue thereof, the endophyte is capable of a function or activity selected from the group consisting of auxin production, nitrogen fixation, production of an antimicrobial compound, mineral phosphate solubilization, siderophore production, cellulase production, chitinase production, xylanase production, and acetoin production.

In some embodiments of the agricultural plant, or portion of tissue thereof, the endophyte exhibits at least two of: auxin production, nitrogen fixation, production of an antimicrobial compound, mineral phosphate solubilization, siderophore production, cellulase production, chitinase production, xylanase production, and acetoin production.

In some embodiments of the agricultural plant, or portion of tissue thereof, the endophyte is capable of metabolizing at least one substrate selected from the group consisting of: a-D-glucose, arabinose, arbutin, b-methyl-D-galactoside, b-methyl-D-glucoside, D-alanine, D-arabitol, D-aspartic acid, D-cellobiose, dextrin, D-fructose, D-galactose, D-gluconic acid, D-glucosamine, dihydroxyacetone, DL-malic acid, D-mannitol, D-mannose, D-melezitose, D-melibiose, D-raffinose, D-ribose, D-serine, D-threonine, D-trehalose, D-xylose, g-amino-N-butyric acid, g-cyclodextrin, gelatin, gentiobiose, glycogen, glycyl-L-aspartic acid, glycyl-L-glutamic acid, glycyl-L-proline, glyoxylic acid, i-erythritol, inosine, L-alanine, L-alanyl-glycine, L-arabinose, L-asparagine, L-aspartic acid, L-galactonic acid-g-lactone, L-glutamic acid, L-glutamine, L-histidine, L-proline, L-rhamnose, L-serine, L-threonine, maltitol, maltose, maltotriose, mannose, N-acetyl-D-glucosamine, oxalic acid, palatinose, pectin, proline, salicin, stachyose, sucrose, trehalose, turanose, tyramine, uridine, and xylose.

In some embodiments of the agricultural plant, or portion of tissue thereof, the endophyte is capable of metabolizing at least two substrates selected from the group consisting of: a-D-glucose, arabinose, arbutin, b-methyl-D-galactoside, b-methyl-D-glucoside, D-alanine, D-arabitol, D-aspartic acid, D-cellobiose, dextrin, D-fructose, D-galactose, D-gluconic acid, D-glucosamine, dihydroxyacetone, DL-malic acid, D-mannitol, D-mannose, D-melezitose, D-melibiose, D-raffinose, D-ribose, D-serine, D-threonine, D-trehalose, D-xylose, g-amino-N-butyric acid, g-cyclodextrin, gelatin, gentiobiose, glycogen, glycyl-L-aspartic acid, glycyl-L-glutamic acid, glycyl-L-proline, glyoxylic acid, i-erythritol, inosine, L-alanine, L-alanyl-glycine, L-arabinose, L-asparagine, L-aspartic acid, L-galactonic acid-g-lactone, L-glutamic acid, L-glutamine, L-histidine, L-proline, L-rhamnose, L-serine, L-threonine, maltitol, maltose, maltotriose, mannose, N-acetyl-D-glucosamine, oxalic acid, palatinose, pectin, proline, salicin, stachyose, sucrose, trehalose, turanose; tyramine, uridine, and xylose.

In some embodiments of the agricultural plant, or portion of tissue thereof, the formulation is disposed on an exterior surface of the plant or portion of tissue thereof, or within the plant or portion of tissue thereof, by spraying, immersing, coating, encapsulating, or dusting the plant or portion of tissue thereof with the formulation.

In some embodiments, the agricultural plant, or portion of tissue thereof further comprises a formulation that comprises at least one member selected from the group consisting of an agriculturally compatible carrier, a tackifier, a microbial stabilizer, a fungicide, an antibacterial agent, an herbicide, a nematicide, an insecticide, a plant growth regulator, a rodenticide, and a nutrient.

In some embodiments of the agricultural plant, or portion of tissue thereof, the benefit is selected from the group consisting of: increased root biomass, increased root length, increased height, increased shoot length, increased leaf number, increased water use efficiency, increased tolerance to low nitrogen stress, increased nitrogen use efficiency, increased overall biomass, increased yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, increased resistance to herbivory, a detectable modulation in, the level of a metabolite, a detectable modulation in the proteome, and a detectable modulation in the transcriptome, relative to a reference agricultural plant.

In some embodiments of the agricultural plant, or portion of tissue thereof, the benefit comprises at least two benefits selected from the group consisting of increased: root biomass, increased root length, increased height, increased shoot length, increased leaf number, increased water use efficiency, increased tolerance to low nitrogen stress, increased nitrogen use efficiency, increased overall biomass, increased yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, increased resistance to herbivory, a detectable modulation in the level of a metabolite, a detectable modulation in the proteome, and a detectable modulation in the transcriptome, relative to a reference agricultural plant. In some embodiments of the agricultural plant, or portion of tissue thereof, the benefit is increased tolerance to low nitrogen stress or increased nitrogen use efficiency, and the endophyte is non-diazotrophic.

In some embodiments of the agricultural plant, or portion of tissue thereof, the plant or portion of tissue thereof is contacted with at least 10 CFU or spores, at least 100 CFU or spores, at least 300 CFU or spores, at least 1,000 CFU or spores, at least 3,000 CFU or spores, at least 10,000 CFU or spores; at least 30,000 CFU or spores, at least 100,000 CFU or spores, at least 300,000 CFU or spores, at least 1,000,000 CFU or spores, or more, of the endophyte. In some embodiments of the agricultural plant, or portion of tissue thereof, the plant tissue is a seed. In a further embodiment, the endophyte is disposed on the surface of the seed.

In some embodiments, the agricultural plant, or portion of tissue thereof comprises at least two endophytes comprising a nucleic acid sequence that is at least 97% identical, at least 98% identical, at least 99% identical, at least 99.5% identical, or 100% identical, to a nucleic acid sequence selected from the group consisting of SEQ ID NOs: 1-455 in an amount effective to colonize the mature agricultural plant. In some embodiments of the agricultural plant, or portion of tissue thereof, the two endophytes are selected from the groups disclosed in Table 1, Table 2, Table 7 and Table 8.

In some embodiments, the agricultural plant is a monocot. In some embodiments, the portion of tissue thereof is derived from a monocot. The monocot can be corn, wheat, barley or rice.

In some embodiments, the agricultural plant is a dicot. In some embodiments, the portion of tissue thereof is derived from a dicot. The dicot can be a soybean, canola, cotton, *Brassica Napus*, tomato or pepper.

In some embodiments of the agricultural plant, or portion of tissue thereof, the endophyte is disposed in an amount effective to be detectable within a target tissue of the mature target tissue of the mature agricultural plant selected from a fruit, seed, leaf, root or portion thereof.

In some embodiments of the agricultural plant, or portion of tissue thereof, the population is disposed in an amount effective to increase the rate of germination of the seed. The rate of germination of the seed can be increased by at least 0.5%, at least 1%, at least 2%, at least 3%, at least 5%, at least 10%, at least 20%, at least 30%, at least 40%, at least 50%, at least 60%, at least 70%, at least 80%, at least 90%, at least 100% or more, when compared with a reference agricultural plant.

In some embodiments of the agricultural plant, or portion of tissue thereof, the population is disposed in an amount effective to be detectable within a target tissue of the mature plant. The target tissue can be the root, shoot, leaf, flower, fruit or seed.

In some embodiments of the agricultural plant, or portion of tissue thereof, the population is detected in an amount of at least 10 CFU or spores, at least 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, at least 1,000,000 CFU or spores, or more, in the plant or target tissue thereof.

In some embodiments of the agricultural plant, or portion of tissue thereof, the population of is disposed in an amount effective to be detectable in the rhizosphere surrounding the plant. The population can be detected in an amount of at least 10 CFU or spores, at least 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, at least 1,000,000 CFU or spores, or more, in the rhizosphere surrounding the plant.

In some embodiments of the agricultural plant, or portion of tissue thereof, the population is disposed in an amount effective to detectably increase the biomass of the plant. The biomass of the plant can be detectably increased by at least 1%, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with a reference agricultural plant.

In some embodiments of the agricultural plant, or portion of tissue thereof, the population is disposed in an amount effective to increase the biomass of a fruit or seed of the plant. The biomass of the fruit or seed of the plant can be detectably increased by at least 1%, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with the fruit or seed of a reference agricultural plant.

In some embodiments of the agricultural plant, or portion of tissue thereof, the population is disposed in an amount effective to increase the height of the plant. The height of the plant can be increased by at least 1%, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with the height of a reference agricultural plant.

In some embodiments of the agricultural plant, or portion of tissue thereof, the population is disposed in an amount effective to increase production of auxin in the plant. The auxin production of the plant can be increased by at least 1%, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with the auxin production of a reference agricultural plant.

In some embodiments of the agricultural plant, or portion of tissue thereof, the population is disposed in an amount effective to increase production of acetoin in the plant. The acetoin production of the plant can be increased by at least 1%, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with the acetoin production of a reference agricultural plant.

In some embodiments of the agricultural plant, or portion of tissue thereof, the population is disposed in an amount effective to increase production of siderophore in the plant. The siderophore production of the plant can be increased by at least 1%, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with the siderophore production of a reference agricultural plant.

In some embodiments of the agricultural plant, or portion of tissue thereof, the population is disposed in an amount effective to increase resistance to one or more stress conditions selected from the group consisting of a drought stress, heat stress, cold stress, salt stress, and low mineral stress.

In some embodiments of the agricultural plant, or portion of tissue thereof, the population is disposed in an amount effective to effective to increase resistance to one or more biotic stress conditions selected from the group consisting of a nematode stress, insect herbivory stress, fungal pathogen stress, bacterial pathogen stress, and viral pathogen stress.

The invention also features bag comprising at least 1,000 seeds, wherein each seed comprises a formulation comprising an endophyte that is common to at least two donor plant types that is disposed on an exterior surface of the plant or portion of tissue thereof, or within the plant or portion of tissue thereof, in an amount effective to colonize the plant, and in an amount effective to provide a benefit to the modern agricultural plant, wherein each seed is contacted with at least 10 CFU or spores, at least 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, at least 1,000,000 CFU or spores, or more, of the endophyte, and wherein the bag further comprises a label describing the seeds and/or the population.

In an embodiment, the invention features an agricultural formulation comprising an endophyte comprising a nucleic acid sequence that is at least 97% identical, at least 98% identical, at least 99% identical, at least 99.5% identical, or 100% identical, to a nucleic acid sequence selected from the group consisting of SEQ ID NOs: 1-455 that is present in an amount effective to colonize a mature agricultural plant, wherein the formulation further comprises at least one member selected from the group consisting of an agriculturally compatible carrier, a tackifier, a microbial stabilizer, a fungicide, an antibacterial agent, an herbicide, a nematicide, an insecticide, a plant growth regulator, a rodenticide, and a nutrient.

In some embodiments of the agricultural formulation, the agricultural plant is a monocot. The monocot can be maize, barley, rice, or wheat. In some embodiments of the agricultural formulation, the agricultural plant is a dicot. The dicot can be soybean, canola, cotton, *Brassica Napus*, tomato, squash, cucumber, pepper, peanut, sunflower, or sugar beet.

In some embodiments of the agricultural formulation, the population consists essentially of an endophyte comprising a nucleic acid sequence that is at least 99% identical to a nucleic acid sequence selected from the group consisting of SEQ ID NOs: 1-455. In some embodiments of the agricultural formulation, the population consists essentially of an endophyte comprising a nucleic acid sequence that is at least 99.5% identical to a nucleic acid sequence selected from the group consisting of SEQ ID NOs: 1-455.

The preparation of claim 87, comprising at least two different endophytes each comprise a nucleic acid sequence that is at least 97% identical, at least 98% identical, at least 99% identical, at least 99.5% identical, or 100% identical, to a nucleic acid sequence selected from the group consisting of SEQ ID NOs: 1-455.

In some embodiments of the agricultural formulation, each of the two different endophytes comprises the nucleic acid sequence disclosed in Table 1, Table 2, Table 7, and Table 8.

In some embodiments of the agricultural formulation, at least 1%, at least 5%, at least 10%, at least 20%, at least 30%, at least 40%, at least 50%, at least 75%, at least 80%, at least 90%, or at least 95% or more, of the population is in spore form.

In some embodiments of the agricultural formulation, the endophytes were adapted to culture on growth medium.

In some embodiments of the agricultural formulation, the preparation is substantially stable at temperatures between about 0° C. and about 50° C. for at least three days. In some embodiments of the agricultural formulation, the preparation is substantially stable at temperatures between about 4° C. and about 37° C. for at least thirty days.

In some embodiments, the agricultural formulation is formulated to provide a population of plants that demonstrates a substantially homogenous growth rate when introduced into agricultural production.

The invention also features a method for making the plant comprising a formulation comprising an endophyte that is common to at least two donor plant types that is disposed on an exterior surface of the plant or portion of tissue thereof, or within the plant or portion of tissue thereof, in an amount effective to colonize the plant, and in an amount effective to provide a benefit to the modern agricultural plant. The method includes providing a modern agricultural plant, and applying to the plant a formulation comprising an endophyte comprising an endophytic microbe comprising a nucleic acid sequence that is at least 97% identical, at least 98% identical, at least 99% identical, at least 99.5% identical, or 100% identical, to a nucleic acid sequence selected from the group consisting of SEQ ID NOs: 1-455 that is present in an amount effective to colonize the plant.

The invention also features a commodity plant product comprising a plant, or a portion or part thereof, comprising a formulation comprising an endophyte that is common to at least two donor plant types that is disposed on an exterior surface of the plant or portion of tissue thereof, or within the plant or portion of tissue thereof, in an amount effective to colonize the plant, and in an amount effective to provide a benefit to the modern agricultural plant. The commodity plant product can be a grain, a flour, a starch, a syrup, a meal, an oil, a film, a packaging, a nutraceutical product, a pulp, an animal feed, a fish fodder, a bulk material for industrial chemicals, a cereal product, a processed human-food product, a sugar or an alcohol and protein.

The invention also features a method of producing a commodity plant product. The method includes obtaining a plant or plant tissue from a plant, progeny or derivative thereof, the plant comprising a formulation comprising an endophyte that is common to at least two donor plant types that is disposed on an exterior surface of the plant or portion of tissue thereof, or within the plant or portion of tissue thereof, in an amount effective to colonize the plant, and in an amount effective to provide a benefit to the modern agricultural plant; and producing the commodity plant product therefrom.

The invention also features a synthetic combination comprising a purified microbial population in association with a plurality of seeds or seedlings of an agricultural plant, wherein the purified microbial population comprises a first endophyte, wherein the first endophyte comprises a 16S rRNA or ITS rRNA nucleic acid sequence at least 97% identical to a nucleic acid sequence selected from the group consisting of SEQ ID NOs: 1-455, and wherein the endophyte is present in the synthetic combination in an amount effective to provide a benefit to the seeds or seedlings or the plants derived from the seeds or seedlings.

In some embodiments of the synthetic combination comprising a purified microbial population, the first endophyte is capable of at least one of: production of an auxin, nitrogen fixation, production of an antimicrobial, production of a siderophore, mineral phosphate solubilization, production of a cellulase, production of a chitinase, production of a xylanase, and production of acetoin, or a combination of two or more thereof.

In some embodiments of the synthetic combination comprising a purified microbial population, the microbial population further comprises a second endophyte. In a further embodiment, the microbial population comprises a second microbial endophyte having an 16S rRNA or ITS rRNA nucleic acid sequence that is less than 95% identical to that of the first microbial endophyte.

In some embodiments of the synthetic combination comprising a purified microbial population, the microbial population further comprises a second endophyte, and wherein the first and second endophytes are independently capable of at least one of production of an auxin, nitrogen fixation, production of an antimicrobial, production of a siderophore, mineral phosphate solubilization, production of a cellulase, production of a chitinase, production of a xylanase, or production of acetoin, or a combination of two or more thereof.

In some embodiments of the synthetic combination comprising a purified microbial population, the first and second endophytes are independently capable of at least one of production of an auxin, nitrogen fixation, production of an antimicrobial, production of a siderophore, mineral phosphate solubilization, production of a cellulase, production of a chitinase, production of a xylanase, or production of acetoin, or a combination of two or more thereof.

In some embodiments of the synthetic combination comprising a purified microbial population, the microbial population further comprises a second endophyte, wherein the first and second endophytes are independently capable of metabolizing at least one substrate selected from the group consisting of: a-D-glucose, arabinose, arbutin, b-methyl-D-galactoside, b-methyl-D-glucoside, D-alanine, D-arabitol, D-aspartic acid, D-cellobiose, dextrin, D-fructose, D-galactose, D-gluconic acid, D-glucosamine, dihydroxyacetone, DL-malic acid, D-mannitol, D-mannose, D-melezitose, D-melibiose, D-raffinose, D-ribose, D-serine, D-threonine, D-trehalose, D-xylose, g-amino-N-butyric acid, g-cyclodextrin, gelatin, gentiobiose, glycogen, glycyl-L-aspartic acid, glycyl-L-glutamic acid, glycyl-L-proline, glyoxylic acid, i-erythritol, inosine, L-alanine, L-alanyl-glycine, L-arabinose, L-asparagine, L-aspartic acid, L-galactonic acid-g-lactone, L-glutamic acid, L-glutamine, L-histidine, L-proline, L-rhamnose, L-serine, L-threonine, maltitol, maltose, maltotriose, mannose, N-acetyl-D-glucosamine, oxalic acid, palatinose, pectin, proline, salicin, stachyose, sucrose, trehalose, turanose, tyramine, uridine, and xylose, or a combination of two or more thereof.

The invention also features a synthetic combination comprising at least two endophytes associated with a seed, wherein at least the first endophyte is heterologous to the seed and wherein the first endophyte comprises a 16S rRNA or ITS rRNA nucleic acid sequence at least 97% identical to a nucleic acid sequence selected from the group consisting of SEQ ID NOs: 1-455, wherein the endophytes are present in the formulation in an amount effective to provide a benefit to the seeds or seedlings or the plants derived from the seeds or seedlings.

In some embodiments of the synthetic combination comprising at least two endophytes, the second endophyte is a bacterial endophyte. In some embodiments of the synthetic combination comprising at least two endophytes, the second endophyte is a fungal endophyte.

In some embodiments of the synthetic combination comprising at least two endophytes, the first endophyte is a fungal endophyte. In some embodiments of the synthetic combination comprising at least two endophytes, the first endophyte is a fungal endophyte and the second endophyte is a fungal endophyte. In some embodiments of the synthetic combination comprising at least two endophytes, the first endophyte is a fungal endophyte and the second endophyte is a bacterial endophyte.

In some embodiments of the synthetic combination comprising at least two endophytes, the first and second endophytes are independently capable of, metabolizing at least one substrate selected from the group consisting of: a-D-glucose, arabinose, arbutin, b-methyl-D-galactoside, b-methyl-D-glucoside, D-alanine, D-arabitol, D-aspartic acid, D-cellobiose, dextrin, D-fructose, D-galactose, D-gluconic acid, D-glucosamine, dihydroxyacetone, DL-malic acid, D-mannitol, D-mannose, D-melezitose, D-melibiose, D-raffinose, D-ribose, D-serine, D-threonine, D-trehalose, D-xylose, g-amino-N-butyric acid, g-cyclodextrin, gelatin, gentiobiose, glycogen, glycyl-L-aspartic acid, glycyl-L-glutamic acid, glycyl-L-proline, glyoxylic acid, i-erythritol, inosine, L-alanine, L-alanyl-glycine, L-arabinose, L-asparagine, L-aspartic acid, L-galactonic acid-g-lactone, L-glutamic acid, L-glutamine, L-histidine, L-proline, L-rhamnose, L-serine, L-threonine, maltitol, maltose, maltotriose, mannose, N-acetyl-D-glucosamine, oxalic acid, palatinose, pectin, proline, salicin, stachyose, sucrose, trehalose, turanose, tyramine, uridine, and xylose, or a combination of two or more thereof.

In some embodiments of any of the synthetic combinations, the first endophyte is capable of metabolizing at least one substrate selected from the group of: a-D-glucose, arabinose, arbutin, b-methyl-D-galactoside, b-methyl-D-glucoside, D-alanine, D-arabitol, D-aspartic acid, D-cellobiose, dextrin, D-fructose, D-galactose, D-gluconic acid, D-glucosamine, dihydroxyacetone, DL-malic acid, D-mannitol, D-mannose, D-melezitose, D-melibiose, D-raffinose, D-ribose, D-serine, D-threonine, D-trehalose, D-xylose, g-amino-N-butyric acid, g-cyclodextrin, gelatin, gentiobiose, glycogen, glycyl-L-aspartic acid, glycyl-L-glutamic acid, glycyl-L-proline, glyoxylic acid, i-erythritol, inosine, L-alanine, L-alanyl-glycine, L-arabinose, L-asparagine, L-aspartic acid, L-galactonic acid-g-lactone, L-glutamic acid, L-glutamine, L-histidine, L-proline, L-rhamnose, L-serine, L-threonine, maltitol, maltose, maltotriose, mannose, N-acetyl-D-glucosamine, oxalic acid, palatinose, pectin, proline, salicin, stachyose, sucrose, trehalose, turanose, tyramine, uridine, and xylose. In some embodiments of the synthetic combination comprising at least two endophytes associated with a seed, both of the endophytes are heterologous to the seed.

In some embodiments of any of the synthetic combinations, the synthetic combination is disposed within a packaging material selected from a bag, box, bin, envelope, carton, or container. In an embodiment of any of the synthetic combinations, the synthetic combination comprises 1000 seed weight amount of seeds, wherein the packaging material optionally comprises a desiccant, and wherein the synthetic combination optionally comprises an anti-fungal agent.

In some embodiments of any of the synthetic combinations, the first endophyte is localized on the surface of the seeds or seedlings. In some embodiments of any of the synthetic combinations, the first endophyte is obtained from a plant species other than the seeds or seedlings of the synthetic combination. In some embodiments of any of the synthetic combinations, the first endophyte is obtained from a plant cultivar different from the cultivar of the seeds or seedlings of the synthetic combination. In some embodiments of any of the synthetic combinations, the first endophyte is obtained from a plant cultivar that is the same as the cultivar of the seeds or seedlings of the synthetic combination.

In some embodiments of any of the synthetic combinations, the first endophyte is a bacterial endophyte.

In some embodiments of any of the synthetic combinations, the first endophyte is capable of at least two of auxin production, nitrogen fixation, production of an antimicrobial compound, mineral phosphate solubilization, siderophore production, cellulase production, chitinase production, xylanase production, and acetoin production.

In some embodiments of any of the synthetic combinations, the first endophyte is capable of metabolizing at least two substrates selected from the group consisting of: a-D-glucose, arabinose, arbutin, b-methyl-D-galactoside, b-methyl-D-glucoside, D-alanine, D-arabitol, D-aspartic acid, D-cellobiose, dextrin, D-fructose, D-galactose, D-gluconic acid, D-glucosamine, dihydroxyacetone, DL-malic acid, D-mannitol, D-mannose, D-melezitose, D-melibiose, D-raffinose, D-ribose, D-serine, D-threonine, D-trehalose, D-xylose, g-amino-N-butyric acid, g-cyclodextrin, gelatin, gentiobiose, glycogen, glycyl-L-aspartic acid, glycyl-L-glutamic acid, glycyl-L-proline, glyoxylic acid, i-erythritol, inosine, L-alanine; L-alanyl-glycine, L-arabinose, L-asparagine, L-aspartic acid, L-galactonic acid-g-lactone, L-glutamic acid, L-glutamine, L-histidine, L-proline, L-rhamnose, L-serine, L-threonine, maltitol, maltose, maltotriose, mannose, N-acetyl-D-glucosamine, oxalic acid, palatinose, pectin, proline, salicin, stachyose, sucrose, trehalose, turanose, tyramine, uridine, and xylose.

In some embodiments of any of the synthetic combinations, the benefit is selected from the group consisting of: increased root biomass, increased root length, increased height, increased shoot length, increased leaf number, increased water use efficiency, increased tolerance to low nitrogen stress, increased nitrogen use efficiency, increased overall biomass, increased grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, a detectable modulation in the transcriptome, and a detectable modulation in the proteome, relative to reference seeds or agricultural plants derived from reference seeds. In some embodiments, the benefit comprises at least two benefits selected from the group consisting of: increased root biomass, increased root length, increased height, increased shoot length, increased leaf number, increased water use efficiency, increased tolerance to low nitrogen stress, increased nitrogen use efficiency, increased overall biomass, increased grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, a detectable modulation in the transcriptome, and a detectable modulation in the proteome, relative to reference seeds or agricultural plants derived from reference seeds.

In some embodiments of any of the synthetic combinations, the combination comprises seeds and the first endophyte is associated with the seeds as a coating on the surface of the seeds. In some embodiments of any of the synthetic combinations, the combination comprises seedlings and the first endophyte is contacted with the seedlings as a spray applied to one or more leaves and/or one or more roots of the seedlings. In some embodiments of any of the synthetic combinations, the synthetic combination further comprises one or more additional endophyte species.

In some embodiments of any of the synthetic combinations, the effective amount is at least 1×102 CFU or spores/per seed. In some embodiments of any of the synthetic combinations, the effective amount is at least 1×103 CFU or spores/per seed. In some embodiments of any of the synthetic combinations, the combination comprises seeds and the effective amount is from about 1×102 CFU or spores/per seed to about 1×108 CFU or spores/per seed.

In some embodiments of any of the synthetic combinations, the seed is a seed from an agricultural plant. In some embodiments of any of the synthetic combinations, the seed is a transgenic seed.

In some embodiments of any of the synthetic combinations, the first endophytes are present in an amount of at least 10 CFU or spores, at least 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, or at least 1,000,000 CFU spores per seed.

In some embodiments, any of the synthetic combinations further comprise one or more of the following: a stabilizer, or a preservative, or a carrier, or a surfactant, an anticomplex agent, or any combination thereof. In some embodiments, any of the synthetic combinations further comprise one or more of the following: fungicide, nematicide, bactericide, insecticide, and herbicide.

The invention also features a plurality of any of the synthetic combinations placed in a medium that promotes plant growth, the medium selected from the group consisting of: soil, hydroponic apparatus, and artificial growth medium. The invention also features a plurality of any of the synthetic combinations, wherein the synthetic combinations are shelf-stable.

The invention also features a plant grown from any of the synthetic combinations disclosed herein, the plant exhibiting an improved phenotype of agronomic interest, selected from the group consisting of: increased root biomass, increased root length, increased height, increased shoot length, increased leaf number, increased water use efficiency, increased tolerance to low nitrogen stress, increased nitrogen use efficiency, increased overall biomass, increased grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, a detectable modulation in the transcriptome, and a detectable modulation in the proteome.

In some embodiments, the invention features a method for preparing an agricultural seed composition comprising contacting the surface of a plurality of seeds with a formulation comprising a purified microbial population that comprises at least two endophytes that are heterologous to the seed, wherein the first endophyte is capable of metabolizing at least one of a-D-glucose, arabinose, arbutin, b-methyl-D-galactoside, b-methy l-D-glucoside, D-alanine, D-arabitol, D-aspartic acid, D-cellobiose, dextrin, D-fructose, D-galactose, D-gluconic acid, D-glucosamine, dihydroxyacetone, DL-malic acid, D-mannitol, D-mannose, D-melezitose, D-melibiose, D-raffinose, D-ribose, D-serine, D-threonine, D-trehalose, D-xylose, g-amino-N-butyric acid, g-cyclodextrin, gelatin, gentiobiose, glycogen, glycyl-L-aspartic acid, glycyl-L-glutamic acid, glycyl-L-proline, glyoxylic acid, i-erythritol, inosine, L-alanine, L-alanyl-glycine, L-arabinose, L-asparagine, L-aspartic acid, L-galactonic acid-g-lactone, L-glutamic acid, L-glutamine, L-histidine, L-proline, L-rhamnose, L-serine, L-threonine, maltitol, maltose, maltotriose, mannose, N-acetyl-D-glucosamine, oxalic acid, palatinose, pectin, proline, salicin, stachyose, sucrose, trehalose, turanose, tyramine, uridine, and xylose, wherein the endophytes are present in the formulation in an amount capable of modulating a trait of agronomic importance, as compared to isoline plants grown from seeds not contacted with the formulation.

In some embodiments, the invention features a method for preparing an agricultural seed composition, comprising contacting the surface of a plurality of seeds with a formulation comprising a purified microbial population that comprises at least two endophytes that are heterologous to the seed, wherein the first endophyte is capable of at least one function or activity selected from the group consisting of auxin production, nitrogen fixation, production of an antimicrobial compound, mineral phosphate solubilization, siderophore production, cellulase production, chitinase production, xylanase production, and acetoin production, wherein the endophytes are present in the formulation in an amount capable of modulating a trait of agronomic importance, as compared to isoline plants grown from seeds not contacted with the formulation.

In some embodiments, the invention features a method of improving a phenotype during water limited conditions of a plurality of host plants grown from a plurality of seeds, comprising treating the seeds with a formulation comprising at least two endophytes that are heterologous to the seeds, wherein the first endophyte is capable of metabolizing at least one of a-D-glucose, arabinose, arbutin, b-methyl-D-galactoside, b-methyl-D-glucoside, D-alanine, D-arabitol, D-aspartic acid, D-cellobiose, dextrin, D-fructose, D-galactose, D-gluconic acid, D-glucosamine, dihydroxyacetone, DL-malic acid, D-mannitol, D-mannose, D-melezitose, D-melibiose, D-raffinose, D-ribose, D-serine, D-threonine, D-trehalose, D-xylose, g-amino-N-butyric acid, g-cyclodextrin, gelatin, gentiobiose, glycogen, glycyl-L-aspartic acid, glycyl-L-glutamic acid, glycyl-L-proline, glyoxylic acid, i-erythritol, inosine, L-alanine, L-alanyl-glycine, L-arabinose, L-asparagine, L-aspartic acid, L-galactonic acid-g-lactone, L-glutamic acid, L-glutamine, L-histidine, L-proline, L-rhamnose, L-serine, L-threonine, maltitol, maltose, maltotriose, mannose, N-acetyl-D-glucosamine, oxalic acid, palatinose, pectin, proline, salicin, stachyose, sucrose, trehalose, turanose, tyramine, uridine, and xylose, the phenotype improvement selected from the group consisting of: increased root biomass, increased root length, increased height, increased shoot length, increased leaf number, increased water use efficiency, increased tolerance to low nitrogen stress, increased nitrogen use efficiency, increased overall biomass, increased grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, a detectable modulation in the transcriptome, and a detectable modulation in the proteome.

In some embodiments of the methods, the first endophyte is a bacterial endophyte. In some embodiments of the methods, the first endophyte is a bacterial endophyte and the second endophyte is a bacterial endophyte. In some embodiments of the methods, the first endophyte is a bacterial endophyte and the second endophyte is a fungal endophyte. In some embodiments of the methods, the first endophyte is a fungal endophyte. In some embodiments of the methods, the first endophyte is a fungal endophyte and the second endophyte is a fungal endophyte. In some embodiments of the methods, the first endophyte is a fungal endophyte and the second endophyte is a bacterial endophyte.

In some embodiments of the methods, the first endophyte is capable of metabolizing at least two of a-D-glucose, arabinose, arbutin, b-methyl-D-galactoside, b-methyl-D-glucoside, D-alanine, D-arabitol, D-aspartic acid, D-cellobiose, dextrin, D-fructose, D-galactose, D-gluconic acid, D-glucosamine, dihydroxyacetone, DL-malic acid, D-mannitol, D-mannose, D-melezitose, D-melibiose, D-raffinose, D-ribose, D-serine, D-threonine, D-trehalose, D-xylose, g-amino-N-butyric acid, g-cyclodextrin, gelatin, gentiobiose, glycogen, glycyl-L-aspartic acid, glycyl-L-glutamic acid, glycyl-L-proline, glyoxylic acid, i-erythritol, inosine, L-alanine, L-alanyl-glycine, L-arabinose, L-asparagine, L-aspartic acid, L-galactonic acid-g-lactone, L-glutamic acid, L-glutamine, L-histidine, L-proline, L-rhamnose, L-serine, L-threonine, maltitol, maltose, maltotriose, mannose, N-acetyl-D-glucosamine, oxalic acid, palatinose, pectin, proline, salicin, stachyose, sucrose, trehalose, turanose, tyramine, uridine, and xylose.

In some embodiments of the methods, the second endophyte is capable of metabolizing at least two of a-D-glucose, arabinose, arbutin, b-methyl-D-galactoside, b-methyl-D-glucoside, D-alanine, D-arabitol, D-aspartic acid, D-cellobiose, dextrin, D-fructose, D-galactose, D-gluconic acid, D-glucosamine, dihydroxyacetone, DL-malic acid, D-mannitol, D-mannose, D-melezitose, D-melibiose, D-raffinose, D-ribose, D-serine, D-threonine, D-trehalose, D-xylose, g-amino-N-butyric acid, g-cyclodextrin, gelatin, gentiobiose, glycogen, glycyl-L-aspartic acid, glycyl-L-glutamic acid, glycyl-L-proline, glyoxylic acid, i-erythritol, inosine, L-alanine, L-alanyl-glycine, L-arabinose, L-asparagine, L-aspartic acid, L-galactonic acid-g-lactone, L-glutamic acid, L-glutamine, L-histidine, L-proline, L-rhamnose, L-serine, L-threonine, maltitol, maltose, maltotriose, mannose, N-acetyl-D-glucosamine, oxalic acid, palatinose, pectin, proline, salicin, stachyose, sucrose, trehalose, turanose, tyramine, uridine, and xylose.

In some embodiments of the methods, the formulation comprises the purified microbial population at a concentration of at least about 1×102 CFU/ml or spores/ml in a liquid formulation or about 1×102 CFU/gm or spores/ml in a non-liquid formulation.

In some embodiments of the methods for preparing an agricultural seed composition, the trait of agronomic importance is selected from the group consisting of: increased root biomass, increased root length, increased height, increased shoot length, increased leaf number, increased water use efficiency, increased tolerance to low nitrogen stress, increased nitrogen use efficiency, increased overall biomass, increased grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, a detectable modulation in the transcriptome, and a detectable modulation in the proteome.

In some embodiments of the methods, at least one of the endophytes is capable of localizing in a plant element of a plant grown from the seed, the plant element selected from the group consisting of: whole plant, seedling, meristematic tissue, ground tissue, vascular tissue, dermal tissue, seed, leaf, root, shoot, stem, flower, fruit, stolon, bulb, tuber, corm, keikis, and bud.

In some embodiments of the methods, at least one of the endophytes is capable of colonizing a plant element of a plant grown from the seed, the plant element selected from the group consisting of: whole plant, seedling, meristematic tissue, ground tissue, vascular tissue, dermal tissue, seed, leaf, root, shoot, stem, flower, fruit, stolon, bulb, tuber, corm, keikis, and bud.

In some embodiments of the methods, the formulation further comprises one or more of the following: a stabilizer, or a preservative, or a carrier, or a surfactant, or an anticomplex agent, or any combination thereof. In some embodiments of the methods, the formulation further comprises one or more of the following: fungicide, nematicide, bactericide, insecticide, and herbicide.

In some embodiments of the methods, the seed is a transgenic seed.

The invention also features a plant derived from one of the methods for preparing an agricultural seed composition, wherein the plant comprises in at least one of its plant elements the endophytes. In some embodiments, the invention also features progeny of the plant derived from one of the methods for preparing an agricultural seed composition wherein the progeny comprises in at least one of its plant elements the endophytes.

In some embodiments of any of the methods, the endophyte expresses one or more genes encoding a protein whose amino acid sequence is at least 95%, at least 96%, at least 97%, at least 98%, at least 99%, or 100% identical to an amino acid sequence selected from the group consisting of SEQ ID NOs: 479, 483, 519, 532, 549, 557, 561, 562, 577, 578, 611, 626, 640, 656, 660, 666, 674, 676, 677, 678, 679, 680, 682, 683, 684; 685, 686, 688, 689, 690, 691, 692, 693, 696, 697, 698, 701, 704, 706, 710, 711, 716, 717, 718, 719, 720, 721, 722, 723, 724, 727, 728, 729, 730, 731, 732, 733, 734, 735, 737, 738, 741, 743, 744, 745, 746, 747, 748, 749, 751, 753, 756, 757, 759, 761, 762, 763, 764, 765, 766, 767, 768, 769, 771, 772, 773, 774, 775, 776, 777, 778, 779, 780, 782, 783, 784, 785, 786, 788, 790, 793, 795, 796, 797, 798, 800, 801, 802, 803, 804, 805, 806, 807, 808, 809, 810, 811, 812, 813, 815, 816, 817, 818, 819, 820, 822, 823, 824, 825, 826, 829, 830, 833, 835, 836, 837, 838, 839, 840, 841, 842, 843, 844, 846, 848, 850, 851, 853, 854, 855, 856, 857, 858, 859, 860, 864, 865, 866, 868, 869, 870, 871, 872, 873, 874, 875, 876, 877, 878, 879, 880, 881, 882, 884, 886, 887, 888, 889, 890, 891, 892, 893, 894, 895, 897, 898, 899, 901, 902, 903, 904, 905, 906, 907, 908, 910, 911, 912, 913, 914, 915, 916, 917, 918, 920, 921, 922, 923, 924, 926, 927, 928, 930, 931, 932, 933, 934, 935, 936, 937, 938, 939, 940, 941, 942, 943, 944, 945, 946, 947, 948, 949, 950, 952, 953, 954, 955, 956, 957, 958, 959, 960, 961, 962, 963, 964, 968, 969, 971, 974, 976, 978, 979, 980, 984, 985, 987, 988, 989, 992, 993, 994, 995, 996, 998, 1000, 1001, 1002, 1003, 1006, 1008, 1010, 1011, 1012, 1014, 1015, 1016, 1017, 1018, 1019, 1021, 1022, 1023, 1024, 1025, 1028, 1029, 1030, 1031, 1032, 1033, 1034, 1036, 1037, 1038, 1040, 1041, 1042, 1043, 1044, 1045, 1046, 1047, 1048, 1049, 1050, 1051, 1055, 1056, 1058, 1059, 1060, 1062, 1064, 1065, 1066, 1068, 1070, 1071, 1072, 1076, 1077, 1079, 1080, 1081, 1083, 1085, 1086, 1087, 1088, 1090, 1091, 1092, 1094, 1095, 1096, 1097, 1098, 1099, 1101, 1102, 1103, 1104, 1106, 1107, 1108, 1110, 1111, 1112, 1113, 1114, 1115, 1116, 1117, 1118, 1119, 1121, 1122, 1123, 1124, 1126, 1127, 1129, 1130, 1131, 1132, 1133, 1134, 1136, 1137, 1138, 1139, 1140, 1142, 1143, 1144, 1145, 1146, 1147, 1148, 1149, 1151, 1153, 1155, 1156, 1157, 1158, 1159, 1160, 1161, 1162, 1163, 1165, 1166, 1167, 1168, 1169, 1170, 1171, 1172, 1174, 1176, 1178, 1179, 1180, 1181, 1182, 1183, 1184, 1185, 1186, 1188, 1189, 1190, 1191, 1192, 1193, 1194, 1196, 1197, 1198, 1199, 1200, 1201, 1203, 1205, 1206, 1207, 1208, 1209, 1210, 1211, 1213, 1214, 1216, 1217, 1218, 1219, 1221, 1222, 1223, 1225, 1226, 1228, 1229, 1230, 1231, 1232, 1233, 1235, 1237, 1238, 1239, 1241, 1242, 1243, 1244, 1245, 1246, 1247, 1248, 1249, 1250, 1251, 1252, 1253, 1255, 1256, 1257, 1258, 1259, 1260, 1261, 1262, 1263, 1264, 1265, 1266, 1267, 1268, 1269, 1270, 1271, 1272, 1273, 1274, 1275, 1276, 1277, 1279, 1280, 1281, 1282, 1283, 1284, 1285, 1286, 1287, 1288, 1290, 1292, 1293, 1296, 1297, 1298, 1300, 1301, 1303, 1304, 1306, 1307, 1308, 1309, 1311, 1312, 1313, 1314, 1317, 1319, 1320, 1321, 1322, 1323, 1324, 1325, 1326, 1327, 1328, 1330, 1331, 1333, 1334, 1335, 1336, 1337, 1338, 1339, 1340, 1341, 1342, 1343, 1344, 1345, 1346, 1347, 1348, 1350, 1351, 1352, 1353, 1355, 1356, 1357, 1358, 1359, 1360, 1361, 1362, 1363, 1364, 1365, 1366, 1368, 1369, 1370, 1371, 1372, 1374, 1375, 1376, 1379, 1380, 1382, 1383, 1384, 1385, 1386, 1388, 1389, 1390, 1391, 1392, 1393, 1396, 1397, 1398, 1399, 1400, 1402, 1403, 1404, 1405, 1406, 1407, 1408, 1409, 1410, 1411, 1412, 1413, 1414, 1415, 1416, 1417, 1418, 1419, 1420, 1421, 1422, 1424, 1425, 1426, 1427, 1428, 1430, 1431, 1432, 1433, 1437, 1438, 1439, 1440, 1441, 1442, 1443, 1444, 1445, 1446, 1447, 1448, 1449, 1450, 1452, 1453, 1456, 1459, 1466, 1467, 1469, 1471, 1478, 1479, 1482, 1483, 1484, 1485, 1487, 1488, 1489, 1490, 1495, 1497, 1498, 1499, 1500, 1501, 1504, 1505, 1506, 1508, 1511, 1513, 1514, 1516, 1520, 1526, 1529, 1534, 1535, 1537, 1538, 1540, 1545, 1547, 1548, 1549, 1550, 1551, 1552, 1553, 1554, 1556, 1559, 1561, 1562, 1565, 1566, 1568, 1569, 1570, 1571, 1573, 1574, 1575, 1576, 1577, 1578, 1579, 1580, 1581, 1582, 1583, 1585, 1588, 1589, 1591, 1592, 1593, 1594, 1595, 1596, 1597, 1598, 1601, 1603, 1604, 1605, 1607, 1608, 1609, 1611, 1612, 1613, 1614, 1615, 1616, 1617, 1618, 1619, 1620, 1622, 1624, 1625, 1626, 1627, 1628, 1629, 1630, 1632, 1633, 1636, 1637, 1638, 1639, 1640, 1641, 1642, 1643, 1644, 1646, 1647, 1648, 1650, 1651, 1652, 1654, 1657, 1659, 1660, 1661, 1664, 1665, 1666, 1667, 1668, 1671, 1673, 1675, 1676, 1678, 1679, 1681, 1684, 1685, 1686, 1689, 1690, 1692, 1693, 1694, 1695, 1696, 1697, 1698, 1701, 1705, 1706, 1707, 1709, 1711, 1712, 1713, 1714, 1716, 1717, 1718, 1720, 1721, 1723, 1724, 1725, 1726, 1728, 1729, 1731, 1732, 1734, 1735, 1736, 1737, 1738, 1739, 1740, 1741, 1743, 1744, 1745, 1746, 1747, 1750, 1751, 1753, 1754, 1755, 1760, 1761, 1762, 1763, 1764, 1765, 1767, 1770, 1771, 1772, 1775, 1776, 1777, 1778, 1779, 1780, 1781, 1782, 1786, 1787, 1788, 1789, 1791, 1792, 1793, 1794, 1795, 1797, 1798, 1799, 1800, 1801, 1803, 1804, 1805, 1806, 1809, 1810, 1811, 1814, 1815, 1818, 1819, 1820, 1821, 1822, 1823, 1824, 1825, 1826, 1828, 1830, 1831, 1833, 1835, 1836, 1837, 1838, 1839, 1840, 1841, 1842, 1843, 1846, 1851, 1852, 1854, 1857, 1858, 1860, 1861, 1862, 1863, 1864, 1866, 1868, 1869, 1870, 1872, 1873, 1874, 1875, 1876, 1878, 1879, 1880, 1881, 1883, 1884, 1885, 1887, 1888, 1892, 1893, 1894, 1896, 1898, 1899, 1900, 1901, 1902, 1903, 1904, 1905, 1906, 1907, 1910, 1911, 1913, 1915, 1916, 1917, 1918, 1920, 1921, 1924, 1925, 1926, 1927, 1928, 1930, 1932, 1933, 1934, 1935, 1938, 1939, 1940, 1942, 1943, 1945, 1946, 1948, 1949, 1950, 1951, 1953, 1954, 1955, 1959, 1960, 1961, 1962, 1963, 1965, 1966, 1967, 1970, 1971, 1973, 1975, 1976, 1977, 1979, 1981, 1982, 1983, 1984, 1985, 1986, 1988, 1990, 1994, 1995, 1996, 1998, 1999, 2000, 2001; 2002, 2003, 2006, 2007, 2008, 2009, 2010, 2011, 2013, 2014, 2015, 2016, 2017, 2018, 2019, 2020, 2021, 2022, 2024, 2025, 2026, 2027, 2028, 2029, 2030, 2031, 2032, 2034, 2035, 2036, 2037, 2038, 2039, 2040, 2041, 2042, 2043, 2044, 2045, 2046, 2047, 2048, 2049, 2050, 2052, 2054, 2055, 2059, 2060, 2062, 2065, 2066, 2067, 2068, 2069, 2070, 2071, 2074, 2076, 2077, 2080, 2081, 2082, 2083, 2085, 2086, 2087, 2088, 2089, 2090, 2091, 2092, 2093, 2095, 2096, 2097, 2098, 2100, 2101, 2102, 2103, 2104, 2105, 2108, 2109, 2110, 2112, 2113, 2115, 2116, 2117, 2118, 2119, 2120, 2121, 2125, 2127, 2128, 2129, 2131, 2132, 2134, 2135, 2136, 2138, 2140, 2141, 2142, 2143, 2145, 2146, 2147, 2148, 2149, 2150, 2153, 2154, 2155, 2156, 2158, 2159, 2160, 2162, 2163, 2165, 2166, 2167, 2168, 2169, 2170, 2171, 2172, 2174, 2176, 2177, 2179; 2180, 2181, 2182, 2183, 2184, 2185, 2186, 2188, 2190, 2191, 2192, 2193, 2194, 2195, 2196, 2197, 2198, 2200, 2202, 2204, 2205, 2206, 2207, 2208, 2210, 2211, 2212, 2214, 2215, 2216, 2217, 2218, 2219, 2220, 2221, 2222, 2223, 2225, 2226, 2227, 2228, 2229, 2230, 2231, 2232, 2233, 2234, 2235, 2236, 2238, 2239, 2241, 2242, 2243, 2244, 2245, 2246, 2248, 2249, 2251, 2253, 2254, 2255, 2257, 2258, 2259, 2261, 2262, 2265, 2267, 2268, 2269, and 2270.

In some embodiments of the methods, protein expression is modulated in response to the first endophyte contacting a plant element. In some embodiments, protein expression is upregulated in response to the first endophyte contacting a plant element. In some embodiments, the amino acid sequence of the upregulated protein is at least 95%, at least 96%, at least 97%, at least 98%, at least 99%, or 100% identical to an amino acid sequence selected from the group consisting of SEQ ID NOs: 549, 640, 656, 676, 684, 690, 937, 1456, 1467, 1479, 1484, 1488, 1490, 1498, 1499, 1500, 1504, 1505, 1508, 1513, 1529, 1534, 1538, 1540, 1547, 1551, 1554, 1561, 1566, 1568, 1570, 1571, 1574, 1578, 1581, 1583, 1591, 1592, 1593, 1597, 1598, 1604, 1605, 1609, 1615, 1616, 1619, 1622, 1624, 1626, 1629, 1630, 1632, 1636, 1638, 1642, 1643, 1647, 1650, 1651, 1652, 1659, 1661, 1664, 1666, 1671, 1675, 1676, 1678, 1684, 1685, 1689, 1692, 1694, 1695, 1696, 1701, 1706, 1709, 1711, 1712, 1718, 1723, 1725, 1728, 1729, 1732, 1737, 1738, 1740, 1741, 1744, 1746, 1747, 1751, 1755, 1761, 1763, 1771, 1772, 1775, 1778, 1779, 1782, 1787, 1788, 1791, 1792, 1797, 1798, 1799, 1800, 1805, 1819, 1824, 1828, 1835, 1840, 1842, 1843, 1846, 1854, 1860, 1862, 1868, 1875, 1892, 1893, 1900, 1901, 1910, 1918, 1924, 1925, 1926, 1928, 1932, 1933, 1934, 1938, 1943, 1946, 1949, 1950, 1953, 1963, 1967, 1971, 1973, 1975, 1985, 1990, 1994, 1998, 2000, 2003, 2006, 2010, 2013, 2016, 2018, 2021, 2025, 2027, 2028, 2030, 2034, 2035, 2036, 2048, 2050, 2052, 2054, 2059, 2062, 2065, 2066, 2067, 2068, 2074, 2080, 2091, 2092, 2093, 2095, 2097, 2098, 2100, 2101, 2104, 2108, 2110, 2112, 2117, 2119, 2125, 2131, 2134, 2135, 2145, 2149, 2150, 2156, 2159, 2162, 2168, 2181, 2185, 2193, 2195, 2196, 2206, 2211, 2216, 2217, 2219, 2220, 2221, 2223, 2231, 2236, 2239, 2242, 2243, 2248, 2255, 2257, 2258, 2259, or 2262.

In some embodiments of the methods, protein expression is repressed in response to the first endophyte contacting a plant element. In some embodiments, the repressed protein amino acid sequence is at least 95%, at least 96%, at least 97%, at least 98%, at least 99%, or 100% identical to a nucleic acid sequence selected from the group consisting of SEQ ID NOs: 479, 483, 519, 532, 557, 626, 674, 678, 680, 683, 685, 688, 690, 696, 697, 701, 704, 706, 710, 711, 717, 720, 722, 723, 724, 728, 729, 730, 732, 733, 734, 737, 741, 744, 745, 748, 749, 751, 753, 756, 757, 761, 764, 766, 768, 769, 772, 773, 774, 778, 779, 782, 783, 784, 788, 790, 793, 795, 796, 797, 800, 802, 803, 806, 807, 808, 810, 812, 817, 818, 819, 820, 822, 825, 826, 833, 836, 837, 839, 841, 846, 848, 851, 853, 854, 855, 856, 857, 860, 864, 865, 866, 870, 872, 874; 876, 878, 879, 880, 881, 882, 884, 886, 887, 890, 891, 893, 894, 895, 898, 901, 903, 905, 907, 908, 910, 911, 912, 913, 915, 917, 918, 921, 924, 926, 927, 928, 933, 934, 935, 936, 937, 938, 940, 942, 944, 945, 946, 947, 950, 952, 954, 955, 957, 960, 961, 962, 963, 964, 968, 971, 976, 978, 979, 985, 987, 989, 992, 1000, 1001, 1002, 1003, 1006, 1008, 1012, 1014, 1018, 1019, 1021, 1022, 1024, 1025, 1028, 1031, 1032, 1034, 1037, 1038, 1040, 1042, 1043, 1046, 1047, 1050, 1051, 1056, 1059, 1064, 1065, 1068, 1070, 1072, 1077, 1079, 1083, 1086, 1087, 1091, 1094, 1095, 1098, 1102, 1103, 1104, 1110, 1111, 1112, 1113, 1114, 1116, 1117, 1118, 1121, 1126, 1130, 1132, 1133, 1134, 1136, 1139, 1143, 1146, 1147, 1151, 1155, 1156, 1158, 1159, 1160, 1162, 1163, 1165, 1168, 1170, 1172, 1174, 1176, 1180, 1182, 1183, 1186, 1188, 1192, 1193, 1194, 1196, 1197, 1198, 1209, 1214, 1217, 1218, 1219, 1221, 1222, 1223, 1225, 1226, 1230, 1237, 1242, 1244, 1249, 1251, 1253, 1256, 1260, 1261, 1262, 1264, 1270, 1272, 1274, 1276, 1279, 1280, 1283, 1284, 1285, 1286, 1288, 1290, 1292, 1298, 1300, 1303, 1307, 1309, 1311, 1312, 1313, 1320, 1321, 1324, 1325, 1328, 1330, 1331, 1333, 1336, 1337, 1339, 1340, 1344, 1346, 1352, 1353, 1355, 1357, 1358, 1359, 1360, 1361, 1363, 1364, 1365, 1370, 1375, 1376, 1379, 1380, 1383, 1384, 1386, 1390, 1391, 1392, 1393, 1396, 1399, 1400, 1402, 1405, 1408, 1411, 1412, 1418, 1420, 1422, 1427, 1428, 1431, 1433, 1438, 1439, 1440, 1442, 1444, 1445, 1449, or 1450.

In some embodiments of the methods, the protein is expressed with at least a two-fold difference, at least a three-fold difference, at least a four-fold difference, at least a five-fold difference, at least a six-fold difference, at least a seven-fold difference, at least an eight-fold difference, at least a nine-fold difference, at least a ten-fold difference or more in expression level as compared to the protein expression level of a reference microorganism. In some embodiments, the difference in expression level of the protein is positive. In some embodiments, the difference in expression level of the protein is negative.

In some embodiments of the methods, the protein is involved in at least one KEGG pathway selected from the group consisting of: endocytosis, purine metabolism, inositol phosphate metabolism, and peroxisome. In some embodiments of the methods, the protein is involved in at least one KEGG pathway selected from the group consisting of: ko00403 (indole diterpene alkaloid biosynthesis), ko00522 (biosynthesis of 12-, 14- and 16-membered macrolides), ko00550 (peptidoglycan biosynthesis), ko00601 (glycosphingolipid biosynthesis—lacto and neolacto series), ko0901 (indole alkaloid biosynthesis), ko01052 (type I polyketide structures), ko010503 (biosynthesis of siderophore group nonribosomal peptides), ko01501 (beta-Lactam resistance), and ko04071 (sphingolipid signaling pathway).

In some embodiments of any of the methods, the plant, crop, seedling, or plant grown from the seed expresses one or more genes whose nucleic acid sequence is at least 95%, at least 96%, at least 97%, at least 98%, at least 99%, or 100% identical to a nucleic acid sequence selected from the group consisting of SEQ ID NOs: 4127, 4128, 4129, 4130, 4131, 4132, 4133, 4134, 4135, 4136, 4137, 4138, 4139, 4140, 4141, 4142, 4143, 4144, 4145, 4146, 4147, 4148, 4149, 4150, 4151, 4152, 4153, 4154, 4155, 4156, 4157, 4158, 4159, 4160, 4161, 4162, 4163, 4164, 4165, 4166, 4167, 4168, 4169, 4170, 4171, 4172, 4173, 4174, 4175, 4176, 4177, 4178, 4179, 4180, 4181, 4182, 4183, 4184, 4185, 4186, 4187, 4188, 4189, 4190, 4191, 4192, 4193, 4194, 4195, 4196, 4197, 4198, 4199, 4200, 4201, 4202, 4203, 4204, 4205, 4206, 4207, 4208, 4209, 4210, 4211, 4212, 4213, 4214, 4215, 4216, 4217, 4218, 4219, 4220, 4221, 4222, 4223, 4224, 4225, 4226, 4227, 4228, 4229, 4230, 4231, 4232, 4233, 4234, 4235, 4236, 4237, 4238, 4239, 4240, 4241, 4242, 4243, 4244, 4245, 4246, 4247, 4248, 4249, 4250, 4251, 4252, 4253, 4254, 4255, 4256, 4257, 4258, 4259, 4260, 4261, 4262, 4263, 4264, 4265, 4266, 4267, 4268, or 4269.

In some embodiments, the one or more plant genes are modulated in response to the first endophyte contacting the plant or plant element as compared to a reference microorganism contacting the plant or plant element. In some embodiments, the one or more plant genes are upregulated in response to the first endophyte contacting a plant element as compared to a reference microorganism contacting the plant or plant element. In some embodiments, the upregulated genes nucleic acid sequence is at least 95%, at least 96%, at least 97%, at least 98%, at least 99%, or 100% identical to a nucleic acid sequence selected from the group consisting of SEQ ID NOs: 4131, 4140, 4142, 4153, 4162, 4167, 4181, 4183, 4184, 4195, 4199, 4201, 4206, 4213, 4222, 4223, 4250, 4253, or 4269.

In some embodiments, the transcription of one or more genes are repressed in response to the first endophyte contacting a plant element as compared to a reference microorganism contacting the plant or plant element. In some embodiments, the repressed genes nucleic acid sequence is at least 95%, at least 96%, at least 97%, at least 98%, at least 99%, or 100% identical to a nucleic acid sequence selected from the group consisting of SEQ ID NOs: 4150.

In some embodiments, the one or more genes are expressed with at least a 0.5-fold difference, at least a 0.6-fold difference, at least a 0.7-fold difference, at least a 0.8-fold difference, at least a 0.9-fold difference, at least a 1.0-fold difference, at least a 1.1-fold difference, at least a 1.2-fold difference, at least a 1.3-fold difference or more in expression level as compared to the gene expression level of a reference microorganism. In some embodiments, the difference in expression level is positive. In some embodiments, the difference in expression level is negative.

In some embodiments, the one or more genes has at least one gene function selected from the group consisting of: cell wall modification, defense response, oxidation-reduction process, biological process, regulation of transcription, metabolic process; glucosinolate biosynthetic process, response to karrikin, protein phosphorylation, protein folding, response to chitin, proteolysis, response to auxin stimulus, DNA-dependent regulation of transcription, N-terminal protein myristoylation, response to oxidative stress, cellular component, leaf senescence, resistance gene-dependent defense response signaling pathway, zinc ion binding, response to cold, malate metabolic process, transport, catalytic activity, response to ozone, VQ motif, regulation of systemic acquired resistance, potassium ion transport, anaerobic respiration, multicellular organismal development, response to heat, methyltransferase activity, response to wounding, oxidation-reduction process, monooxygenase activity, oxidation-reduction process, carbohydrate metabolic process, exocytosis, nuclear-transcribed mRNA poly (A) tail shortening, sodium ion transport, glycerol metabolic process, on willebrand factor A3, response to water deprivation, response to salt stress, and chlorophyll biosynthetic process. In some embodiments, the gene has a gene ontology (GO) identifier selected from the group consisting of: GO:0003824, GO, catalytic activity; GO:0006355, GO, regulation of transcription, DNA-dependent; GO:0009870, GO, defense response signaling pathway, resistance gene-dependent; GO:0008150, GO, biological_process;

GO:0010200, GO, response to chitin; GO:0006508, GO, proteolysis; GO:0010193, GO, response to ozone; GO:0006979, GO, response to oxidative stress; and GO:0005975, GO, carbohydrate metabolic process.

In some embodiments, the gene function is selected from the following group: single-stranded DNA specific endodeoxyribonuclease activity, sequence-specific DNA binding transcription factor activity, NAD+ ADP-ribosyltransferase activity, metalloendopeptidase activity, DNA catabolic process, cellular iron ion homeostasis, response to osmotic stress, metallopeptidase activity, zinc ion binding, response to wounding, camalexin biosynthetic process, endoribonuclease activity, producing 5'-phosphomonoesters, cellular response to heat, T/G mismatch-specific endonuclease activity, polyamine oxidase activity, flavin adenine dinucleotide binding, cellular heat acclimation, cellular response to ethylene stimulus, cellular response to nitric oxide, and reactive oxygen species metabolic process.

In some embodiments, the endophyte comprises an ITS rRNA nucleic acid sequence at least 95%, at least 96%, at least 97%, at least 98%, at least 99%, or 100% identical to the nucleic acid sequence of SEQ ID NO: 344.

In some embodiments of any of the methods, the endophyte expresses one or more genes encoding a protein whose amino acid sequence is at least 95%, at least 96%, at least 97%, at least 98%, at least 99%, or 100% identical to an amino acid sequence selected from the group consisting of SEQ ID NOs: 477-501, 505, 514, 518, 521, 528, 530, 531, 550, 566, 567, 572, 579, 580, 581, 587, 593, 600, 602, 614, 623, 630, 635, 643, 645, 652, 657, 661, 662, 667, 670, 672, 673, 4510-4535, 4540, 4541, 4542, 4547, 4555, 4558, 4560, 4569, 4570, 4571, 4572, 4577, 4582, 4592, 4594, 4602, 4608, 4609, 4622, 4626, 4641, 4643, 4653, 4654, 4742-4766, 4734, 4739, 4740, 477, 478, 480, 482, 484, 485, 487, 489, 494, 496, 497, 501, 530, 567, 587, 602, 614, 633, 645, 649, 651, 652, 658, 665, 666, 667, 673, 874, 934, 1013, 1249, 1342, 2252, 2272, 2273, 2281, 2282, 2284, 2285, 2286, 2287, 2289; 2290, 2291, 2292, 2293, 2296, 4510, 4514, 4515, 4518, 4520, 4521, 4525, 4526, 4527, 4529, 4532, 4538, 4539, 4540, 4555, 4559, 4560, 4562, 4569, 4570, 4571, 4572, 4577, 4581, 4582, 4594, 4595, 4597, 4608, 4615, 4618, 4623, 4624, 4626, 4630, 4632, 4635, 4641, 4642, 4646, 4650, 4658, 4659, 4661, 4662, 4663, 4666, 4667, 4668, 4670, 4799, 4801, 4802, 4803, 4804, 4805, 4826, 4827, 4828, 4829, 4830, 4831, 4832, 4833, 4834, 4835, 4836, 4837, 4838, 4839, 4840, 4841, 4863, 4864, 4865, 4866, 4867, 4868, 4869, 4870, 4871, 4872, 4873, 4874, 4875, 4876, 4877, 4878, 4879, 4880, 4881, 4882, 4883, 4884, 4885, 4886, 4887, 4888, 4889, 4890, 4891, 4892, 4893, 4894, 4917, 4918, 4919, 4920, 4921, 4922, 4923, 4924, 4925, 4939, 4940, 4941, 4943, 4947, 4948, 4950, 4951, 4955, 4956, 4957, 2315, 2320, 2322, 2326, 2349, 2350, 2352, 2377, 2382, 2390, 2407, 2422, 2436, 2443, 2457, 2463, 2464, 2470, 2477, 2483, 2721, 2968, 3093, 3185, 4096, 4097, 4098, 4099, 4100, 4101, 4102, 4103, 4104, 4105, 4106, 4107, 4108, 4109, 4110, 4111, 4112, 4113, 4114, 4115, 4116, 4117, 4118, 4119, 4120, 4121, 4122, 4123, 4124, 4125, 4126, 4346, 4353, 4362, 4369, 4386, 4391, 4394, 4408, 4410, 4413, 4415, 4422, 4423, 4432, 4433, 4442, 4469, 4487, 4489, 4491, 4493, 4494, 4495, 4496, 4497, 4498, 4499, 4500, 4501, 4502, 4503, 4504, 4505, 4506, 4507, 4508, 4509, 4343, 4484, 4485, 4486, 4488, 4490, and 4492. In some embodiments of any of the methods, the endophyte expresses one or more genes involved in starch and sucrose metabolism, cell wall degradation, or protection from oxidative stress.

In some embodiments, the protein is expressed with at least a two-fold difference, at least a three-fold difference, at least a four-fold difference, at least a five-fold difference, at least a six-fold difference, at least a seven-fold difference, at least an eight-fold difference, at least a nine-fold difference, at least a ten-fold difference or more in expression level as compared to the protein expression level of a reference microorganism. In some embodiments, the difference in expression level is positive. In some embodiments, the difference in expression level is negative.

In some embodiments, the endophyte comprises an ITS rRNA nucleic acid sequence at least 95%, at least 96%, at least 97%, at least 98%, at least 99%, or 100% identical to a nucleic acid sequence selected from the group consisting of SEQ ID NOs: 344 and 447. In some embodiments, the endophyte comprises a 16S rRNA nucleic acid sequence at least 95%, at least 96%, at least 97%, at least 98%, at least 99%, or 100% identical to a nucleic acid sequence selected from the group consisting of SEQ ID NOs: 439 or 441.

In some embodiments of any of the methods, the endophyte expresses one or more genes encoding a protein whose amino acid sequence is at least 95%, at least 96%, at least 97%, at least 98%, at least 99%, or 100% identical to an amino acid sequence selected from the group consisting of SEQ ID NOs: 479, 483, 519, 532, 549, 557, 561, 562, 577, 578, 611, 626, 640, 656, 660, 666, 674, 676, 677, 678, 679, 680, 682, 683, 684, 685, 686, 688, 689, 690, 691, 692, 693, 696, 697, 698, 701, 704, 706, 710, 711, 716, 717, 718, 719, 720, 721, 722, 723, 724, 727, 728, 729, 730, 731, 732, 733, 734, 735, 737, 738, 741, 743, 744, 745, 746, 747, 748, 749; 751, 753, 756, 757, 759, 761, 762, 763, 764, 765, 766, 767, 768, 769, 771, 772, 773, 774, 775, 776, 777, 778, 779, 780, 782, 783, 784, 785, 786, 788, 790, 793, 795, 796, 797, 798, 800, 801, 802, 803, 804, 805, 806, 807, 808, 809, 810, 811, 812, 813, 815, 816, 817, 818, 819, 820, 822, 823, 824, 825, 826, 829, 830, 833, 835, 836, 837, 838, 839, 840, 841, 842, 843, 844, 846, 848, 850, 851, 853, 854, 855, 856, 857, 858, 859, 860, 864, 865, 866, 868, 869, 870, 871, 872, 873, 874, 875, 876, 877, 878, 879, 880, 881, 882, 884, 886, 887, 888, 889, 890, 891, 892, 893, 894, 895, 897, 898, 899, 901, 902, 903, 904, 905, 906, 907, 908, 910, 911, 912, 913, 914, 915, 916, 917, 918, 920, 921, 922, 923, 924, 926, 927, 928, 930, 931, 932, 933, 934, 935, 936, 937, 938, 939, 940, 941, 942, 943, 944, 945, 946, 947, 948, 949, 950, 952, 953, 954, 955, 956, 957, 958, 959, 960, 961, 962, 963, 964, 968, 969, 971, 974, 976, 978, 979, 980, 984, 985, 987, 988, 989, 992, 993, 994, 995, 996, 998, 1000, 1001, 1002, 1003, 1006, 1008, 1010, 1011, 1012, 1014, 1015, 1016, 1017, 1018, 1019, 1021, 1022, 1023, 1024, 1025, 1028, 1029, 1030, 1031, 1032, 1033, 1034, 1036, 1037, 1038, 1040, 1041, 1042, 1043, 1044, 1045, 1046, 1047, 1048, 1049, 1050, 1051, 1055, 1056, 1058, 1059, 1060, 1062, 1064, 1065, 1066, 1068, 1070, 1071, 1072, 1076, 1077, 1079, 1080, 1081, 1083, 1085, 1086, 1087, 1088, 1090, 1091, 1092, 1094, 1095, 1096, 1097, 1098, 1099, 1101, 1102, 1103, 1104, 1106, 1107, 1108, 1110, 1111, 1112, 1113, 1114, 1115, 1116, 1117, 1118, 1119, 1121, 1122, 1123, 1124, 1126, 1127, 1129, 1130, 1131, 1132, 1133, 1134, 1136, 1137, 1138, 1139, 1140, 1142, 1143, 1144, 1145, 1146, 1147, 1148, 1149, 1151, 1153, 1155, 1156, 1157, 1158, 1159, 1160, 1161, 1162, 1163, 1165, 1166, 1167, 1168, 1169, 1170, 1171, 1172, 1174, 1176, 1178, 1179, 1180, 1181, 1182, 1183, 1184, 1185, 1186, 1188, 1189, 1190, 1191, 1192, 1193, 1194, 1196, 1197, 1198, 1199, 1200, 1201, 1203, 1205, 1206, 1207, 1208, 1209, 1210, 1211, 1213, 1214, 1216, 1217, 1218, 1219, 1221, 1222, 1223, 1225, 1226, 1228, 1229, 1230, 1231, 1232, 1233, 1235, 1237, 1238, 1239, 1241, 1242, 1243, 1244, 1245, 1246, 1247, 1248, 1249, 1250, 1251, 1252, 1253, 1255, 1256, 1257, 1258, 1259, 1260, 1261, 1262, 1263, 1264, 1265, 1266, 1267, 1268, 1269, 1270, 1271, 1272, 1273, 1274, 1275, 1276, 1277, 1279, 1280, 1281, 1282, 1283, 1284, 1285, 1286, 1287, 1288, 1290, 1292, 1293, 1296, 1297, 1298, 1300, 1301, 1303, 1304, 1306, 1307, 1308, 1309, 1311, 1312, 1313, 1314, 1317, 1319, 1320, 1321, 1322, 1323, 1324, 1325, 1326, 1327, 1328, 1330, 1331, 1333, 1334, 1335, 1336, 1337, 1338, 1339, 1340, 1341, 1342, 1343, 1344, 1345, 1346, 1347, 1348, 1350, 1351, 1352, 1353, 1355, 1356, 1357, 1358, 1359, 1360, 1361, 1362, 1363, 1364, 1365, 1366, 1368, 1369, 1370, 1371, 1372, 1374, 1375, 1376, 1379, 1380, 1382, 1383, 1384, 1385, 1386, 1388, 1389, 1390, 1391, 1392, 1393, 1396, 1397, 1398, 1399, 1400, 1402, 1403, 1404, 1405, 1406, 1407, 1408, 1409, 1410, 1411, 1412, 1413, 1414, 1415, 1416, 1417, 1418, 1419, 1420, 1421, 1422, 1424, 1425, 1426, 1427, 1428, 1430, 1431, 1432, 1433, 1437, 1438, 1439, 1440, 1441, 1442, 1443, 1444, 1445, 1446, 1447, 1448, 1449, 1450, 1452, 1453, 1456, 1459, 1466, 1467, 1469, 1471, 1478, 1479, 1482, 1483, 1484, 1485, 1487, 1488, 1489, 1490, 1495, 1497, 1498, 1499, 1500, 1501, 1504, 1505, 1506, 1508, 1511, 1513, 1514, 1516, 1520, 1526, 1529, 1534, 1535, 1537, 1538, 1540, 1545, 1547, 1548, 1549, 1550, 1551, 1552, 1553, 1554, 1556, 1559, 1561, 1562, 1565, 1566, 1568, 1569, 1570, 1571, 1573, 1574, 1575, 1576, 1577, 1578, 1579, 1580, 1581, 1582, 1583, 1585, 1588, 1589, 1591, 1592, 1593, 1594, 1595, 1596, 1597, 1598, 1601, 1603, 1604, 1605, 1607, 1608, 1609, 1611, 1612, 1613, 1614, 1615, 1616, 1617, 1618, 1619, 1620, 1622, 1624, 1625, 1626, 1627, 1628, 1629, 1630, 1632, 1633, 1636, 1637, 1638, 1639, 1640, 1641, 1642, 1643, 1644, 1646, 1647, 1648, 1650, 1651, 1652, 1654, 1657, 1659, 1660, 1661, 1664, 1665, 1666, 1667, 1668, 1671, 1673, 1675, 1676, 1678, 1679, 1681, 1684, 1685, 1686, 1689, 1690, 1692, 1693, 1694, 1695, 1696, 1697, 1698, 1701, 1705, 1706, 1707, 1709, 1711, 1712, 1713, 1714, 1716, 1717, 1718, 1720, 1721, 1723, 1724, 1725, 1726, 1728, 1729, 1731, 1732, 1734, 1735, 1736, 1737, 1738, 1739, 1740, 1741, 1743, 1744, 1745, 1746, 1747, 1750, 1751, 1753, 1754, 1755, 1760, 1761, 1762, 1763, 1764, 1765, 1767, 1770, 1771, 1772, 1775, 1776, 1777, 1778, 1779, 1780, 1781, 1782, 1786, 1787, 1788, 1789, 1791, 1792, 1793, 1794, 1795, 1797, 1798, 1799, 1800, 1801, 1803, 1804, 1805, 1806, 1809, 1810, 1811, 1814, 1815, 1818, 1819, 1820, 1821, 1822, 1823, 1824, 1825, 1826, 1828, 1830, 1831, 1833, 1835, 1836, 1837, 1838, 1839, 1840, 1841, 1842, 1843, 1846, 1851, 1852, 1854, 1857, 1858, 1860, 1861, 1862, 1863, 1864, 1866, 1868, 1869, 1870, 1872, 1873, 1874, 1875, 1876, 1878, 1879, 1880, 1881, 1883, 1884, 1885, 1887, 1888, 1892, 1893, 1894, 1896, 1898, 1899, 1900, 1901, 1902, 1903, 1904, 1905, 1906, 1907, 1910, 1911, 1913, 1915, 1916, 1917, 1918, 1920, 1921, 1924, 1925, 1926, 1927, 1928, 1930, 1932, 1933, 1934, 1935, 1938, 1939, 1940, 1942, 1943, 1945, 1946, 1948, 1949, 1950, 1951, 1953, 1954, 1955, 1959, 1960, 1961, 1962, 1963, 1965, 1966, 1967, 1970, 1971, 1973, 1975, 1976, 1977, 1979, 1981, 1982, 1983, 1984, 1985, 1986, 1988, 1990, 1994, 1995, 1996, 1998, 1999, 2000, 2001, 2002, 2003, 2006, 2007, 2008, 2009, 2010, 2011, 2013, 2014, 2015, 2016, 2017, 2018, 2019, 2020, 2021, 2022, 2024, 2025, 2026, 2027, 2028, 2029, 2030, 2031, 2032, 2034, 2035, 2036, 2037, 2038, 2039, 2040, 2041, 2042, 2043, 2044, 2045, 2046, 2047, 2048, 2049, 2050, 2052, 2054, 2055, 2059, 2060, 2062, 2065, 2066, 2067, 2068, 2069, 2070, 2071, 2074, 2076, 2077, 2080, 2081, 2082, 2083, 2085, 2086, 2087, 2088, 2089, 2090, 2091, 2092, 2093, 2095, 2096, 2097, 2098, 2100, 2101, 2102, 2103, 2104, 2105, 2108, 2109, 2110, 2112, 2113, 2115, 2116, 2117, 2118, 2119, 2120, 2121, 2125, 2127, 2128, 2129, 2131, 2132, 2134, 2135, 2136, 2138, 2140, 2141, 2142, 2143, 2145, 2146, 2147, 2148, 2149, 2150, 2153, 2154, 2155, 2156, 2158, 2159, 2160, 2162, 2163, 2165, 2166, 2167, 2168, 2169, 2170, 2171, 2172, 2174, 2176, 2177, 2179, 2180, 2181, 2182, 2183, 2184, 2185, 2186, 2188, 2190, 2191, 2192, 2193, 2194, 2195, 2196, 2197, 2198, 2200, 2202, 2204, 2205, 2206, 2207, 2208, 2210, 2211, 2212, 2214, 2215, 2216, 2217, 2218, 2219, 2220, 2221, 2222, 2223, 2225, 2226, 2227, 2228, 2229, 2230, 2231, 2232, 2233, 2234, 2235, 2236, 2238, 2239, 2241, 2242, 2243, 2244, 2245, 2246, 2248, 2249, 2251, 2253, 2254, 2255, 2257, 2258, 2259, 2261, 2262, 2265, 2267, 2268, 2269, and 2270.

In some embodiments of any of the methods, expression of the protein is modulated in response to the first endophyte contacting a plant element.

In some embodiments, expression of the protein is upregulated in response to the first endophyte contacting a plant element. In some embodiments, the amino acid sequence of the upregulated protein is at least 95%, at least 96%, at least 97%, at least 98%, at least 99%, or 100% identical to an amino acid sequence selected from the group consisting of SEQ ID NOs: 549, 640, 656, 676, 684, 690, 937, 1456, 1467, 1479, 1484, 1488, 1490, 1498, 1499, 1500, 1504, 1505, 1508, 1513, 1529, 1534, 1538, 1540, 1547, 1551, 1554, 1561, 1566, 1568, 1570, 1571, 1574, 1578, 1581, 1583, 1591, 1592, 1593, 1597, 1598, 1604, 1605, 1609, 1615, 1616, 1619, 1622, 1624, 1626, 1629, 1630, 1632, 1636, 1638, 1642, 1643, 1647, 1650, 1651, 1652, 1659, 1661, 1664, 1666, 1671, 1675, 1676, 1678, 1684, 1685, 1689, 1692, 1694, 1695, 1696, 1701, 1706, 1709, 1711, 1712, 1718, 1723, 1725, 1728, 1729, 1732, 1737, 1738, 1740, 1741, 1744, 1746, 1747, 1751, 1755, 1761, 1763, 1771, 1772, 1775, 1778, 1779, 1782, 1787, 1788, 1791, 1792, 1797, 1798, 1799, 1800, 1805, 1819, 1824, 1828, 1835, 1840, 1842, 1843, 1846, 1854, 1860, 1862, 1868, 1875, 1892, 1893, 1900, 1901, 1910, 1918, 1924, 1925, 1926, 1928, 1932, 1933, 1934, 1938, 1943, 1946, 1949, 1950, 1953, 1963, 1967, 1971, 1973, 1975, 1985, 1990, 1994, 1998, 2000, 2003, 2006, 2010, 2013, 2016, 2018, 2021, 2025, 2027, 2028, 2030, 2034, 2035, 2036, 2048, 2050, 2052, 2054, 2059, 2062, 2065, 2066, 2067, 2068, 2074, 2080, 2091, 2092, 2093, 2095, 2097, 2098, 2100, 2101, 2104, 2108, 2110, 2112, 2117, 2119, 2125, 2131, 2134, 2135, 2145, 2149, 2150, 2156, 2159, 2162, 2168, 2181, 2185, 2193, 2195, 2196, 2206, 2211, 2216, 2217, 2219, 2220, 2221, 2223, 2231, 2236, 2239, 2242, 2243, 2248, 2255, 2257, 2258, 2259, or 2262.

In some embodiments, expression of the protein is repressed in response to the first endophyte contacting a plant element. In some embodiments, the repressed protein amino acid sequence is at least 95%, at least 96%, at least 97%, at least 98%, at least 99%, or 100% identical to a nucleic acid sequence selected from the group consisting of SEQ ID NOs: 479, 483, 519, 532, 557, 626, 674, 678, 680, 683, 685, 688, 690, 696, 697, 701, 704, 706, 710, 711, 717, 720, 722, 723, 724, 728, 729, 730, 732, 733, 734, 737, 741, 744, 745, 748, 749, 751, 753, 756, 757, 761, 764, 766, 768, 769, 772, 773, 774, 778, 779, 782, 783, 784, 788, 790, 793, 795, 796, 797, 800, 802, 803, 806, 807, 808, 810, 812, 817, 818, 819, 820, 822, 825, 826, 833, 836, 837, 839, 841, 846, 848, 851, 853, 854, 855, 856, 857, 860, 864, 865, 866, 870, 872, 874, 876, 878, 879, 880, 881, 882, 884, 886, 887, 890, 891, 893, 894, 895, 898, 901, 903, 905, 907, 908, 910, 911, 912, 913, 915, 917, 918, 921, 924, 926, 927, 928, 933, 934, 935, 936, 937, 938, 940, 942, 944, 945, 946, 947, 950, 952, 954, 955, 957, 960, 961, 962, 963, 964, 968, 971, 976, 978, 979, 985, 987, 989, 992, 1000, 1001, 1002, 1003, 1006, 1008, 1012, 1014, 1018, 1019, 1021, 1022, 1024, 1025, 1028, 1031, 1032, 1034, 1037, 1038, 1040, 1042, 1043, 1046, 1047, 1050, 1051, 1056, 1059, 1064, 1065, 1068, 1070, 1072, 1077, 1079, 1083, 1086, 1087, 1091, 1094, 1095, 1098, 1102, 1103, 1104, 1110, 1111, 1112, 1113, 1114, 1116, 1117, 1118, 1121, 1126, 1130, 1132, 1133, 1134, 1136, 1139, 1143, 1146, 1147, 1151, 1155, 1156, 1158, 1159, 1160, 1162, 1163, 1165, 1168, 1170, 1172, 1174, 1176, 1180, 1182, 1183, 1186, 1188, 1192, 1193, 1194, 1196, 1197, 1198, 1209, 1214, 1217, 1218, 1219, 1221, 1222, 1223, 1225, 1226, 1230, 1237, 1242, 1244, 1249, 1251, 1253, 1256, 1260, 1261, 1262, 1264, 1270, 1272, 1274, 1276, 1279, 1280, 1283, 1284, 1285, 1286, 1288, 1290, 1292, 1298, 1300, 1303, 1307, 1309, 1311, 1312, 1313, 1320, 1321, 1324, 1325, 1328, 1330, 1331, 1333, 1336, 1337, 1339, 1340, 1344, 1346, 1352, 1353, 1355, 1357, 1358, 1359, 1360, 1361, 1363, 1364, 1365, 1370, 1375, 1376, 1379, 1380, 1383, 1384, 1386, 1390, 1391, 1392, 1393, 1396, 1399, 1400, 1402, 1405, 1408, 1411, 1412, 1418, 1420, 1422, 1427, 1428, 1431, 1433, 1438, 1439, 1440, 1442, 1444, 1445, 1449, or 1450.

In some embodiments, the protein is expressed with at least a two-fold difference, at least a three-fold difference, at least a four-fold difference, at least a five-fold difference, at least a six-fold difference, at least a seven-fold difference, at least an eight-fold difference, at least a nine-fold difference, at least a ten-fold difference or more in expression level as compared to the protein expression level of a reference microorganism. In some embodiments of any of the methods, the difference in expression level is positive. In some embodiments, the difference in expression level is negative.

In some embodiments, the protein is involved in at least one KEGG pathway selected from the group consisting of: endocytosis, purine metabolism, inositol phosphate metabolism, and peroxisome. In some embodiments, the protein is involved in at least one KEGG pathway selected from the group consisting of: ko00403 (indole diterpene alkaloid biosynthesis), ko00522 (biosynthesis of 12-, 14- and 16-membered macrolides), ko00550 (peptidoglycan biosynthesis), ko00601 (glycosphingolipid biosynthesis—lacto and neolacto series), ko0901 (indole alkaloid biosynthesis), ko01052 (type I polyketide structures), ko010503 (biosynthesis of siderophore group nonribosomal peptides), ko01501 (beta-Lactam resistance), and ko04071 (sphingolipid signaling pathway).

In some embodiments of any of the plants, formulations, synthetic combinations, or other compositions of the invention, the plant, crop, seedling, or plant grown from the seed expresses one or more genes whose nucleic acid sequence is at least 95%, at least 96%, at least 97%, at least 98%, at least 99%, or 100% identical to a nucleic acid sequence selected from the group consisting of SEQ ID NOs: 4127, 4128, 4129, 4130, 4131, 4132, 4133, 4134, 4135, 4136, 4137, 4138, 4139, 4140, 4141, 4142, 4143, 4144, 4145, 4146, 4147, 4148, 4149, 4150, 4151, 4152, 4153, 4154, 4155, 4156, 4157, 4158, 4159, 4160, 4161, 4162, 4163, 4164, 4165, 4166, 4167, 4168, 4169, 4170, 4171, 4172, 4173, 4174, 4175, 4176, 4177, 4178, 4179, 4180, 4181, 4182, 4183, 4184, 4185, 4186, 4187, 4188, 4189, 4190, 4191, 4192, 4193, 4194, 4195, 4196, 4197, 4198, 4199, 4200, 4201, 4202, 4203, 4204, 4205, 4206, 4207, 4208, 4209, 4210, 4211, 4212, 4213, 4214, 4215, 4216, 4217, 4218, 4219, 4220, 4221, 4222, 4223, 4224, 4225, 4226, 4227, 4228, 4229, 4230, 4231, 4232, 4233, 4234, 4235, 4236, 4237, 4238, 4239, 4240, 4241, 4242, 4243, 4244, 4245, 4246, 4247, 4248, 4249, 4250, 4251, 4252, 4253, 4254, 4255, 4256, 4257, 4258, 4259, 4260, 4261, 4262, 4263, 4264, 4265, 4266, 4267, 4268, or 4269.

In some embodiments, the one or more plant genes are modulated in response to the first endophyte contacting the plant or plant element as compared to a reference microorganism contacting the plant or plant element.

In some embodiments, the one or more plant genes are upregulated in response to the first endophyte contacting a plant element as compared to a reference microorganism contacting the plant or plant element. In some embodiments, the upregulated gene's nucleic acid sequence is at least 95%, at least 96%, at least 97%, at least 98%, at least 99%, or 100% identical to a nucleic acid sequence selected from the group consisting of SEQ ID NOs: 4131, 4140, 4142, 4153, 4162, 4167, 4181, 4183, 4184, 4195, 4199, 4201, 4206, 4213, 4222, 4223, 4250, 4253, or 4269.

In some embodiments, the transcription of one or more genes are repressed in response to the first endophyte contacting a plant element as compared to a reference microorganism contacting the plant or plant element. In some embodiments, the repressed genes nucleic acid sequence is at least 95%, at least 96%, at least 97%, at least 98%, at least 99%, or 100% identical to a nucleic acid sequence selected from the group consisting of SEQ ID NOs: 4150.

In some embodiments, the one or more genes are expressed with at least a 0.5-fold difference, at least a 0.6-fold difference, at least a 0.7-fold difference, at least a 0.8-fold difference, at least a 0.9-fold difference, at least a 1.0-fold difference, at least a 1.1-fold difference, at least a 1.2-fold difference, at least a 1.3-fold difference or more in expression level as compared to the gene expression level of a reference microorganism. In some embodiments, the difference in expression level is positive. In some embodiments, the difference in expression level is negative.

In some embodiments, the one or more genes has at least one gene function selected from the group consisting of: cell wall modification, defense response, oxidation-reduction process, biological process, regulation of transcription, metabolic process, glucosinolate biosynthetic process, response to karrikin, protein phosphorylation, protein folding, response to chitin, proteolysis, response to auxin stimulus, DNA-dependent regulation of transcription, N-terminal protein myristoylation, response to oxidative stress, cellular component, leaf senescence, resistance gene-dependent defense response signaling pathway, zinc ion binding, response to cold, malate metabolic process, transport, catalytic activity, response to ozone, VQ motif, regulation of systemic acquired resistance, potassium ion transport, anaerobic respiration, multicellular organismal development, response to heat, methyltransferase activity, response to wounding, oxidation-reduction process, monooxygenase activity, oxidation-reduction process, carbohydrate metabolic process, exocytosis, nuclear-transcribed mRNA poly (A) tail shortening, sodium ion transport, glycerol metabolic process, on willebrand factor A3, response to water deprivation, response to salt stress, and chlorophyll biosynthetic process. In some embodiments, the gene has a gene ontology (GO) identifier selected from the group consisting of: GO:0003824, GO, catalytic activity; GO:0006355, GO, regulation of transcription, DNA-dependent; GO:0009870, GO, defense response signaling pathway, resistance gene-dependent; GO:0008150, GO, biological_process; GO:0010200, GO, response to chitin; GO:0006508, GO, proteolysis; GO:0010193, GO, response to ozone; GO:0006979, GO, response to oxidative stress; and GO:0005975, GO, carbohydrate metabolic process.

In some embodiments, the gene function is selected from the following group: single-stranded DNA specific endodeoxyribonuclease activity, sequence-specific DNA binding transcription factor activity, NAD+ ADP-ribosyltransferase activity, metalloendopeptidase activity, DNA catabolic process, cellular iron ion homeostasis, response to osmotic stress, metallopeptidase activity, zinc ion binding, response to wounding, camalexin biosynthetic process, endoribonuclease activity, producing 5'-phosphomonoesters, cellular response to heat, T/G mismatch-specific endonuclease activity, polyamine oxidase activity, flavin adenine dinucleotide binding, cellular heat acclimation, cellular response to ethylene stimulus, cellular response to nitric oxide, and reactive oxygen species metabolic process.

In some embodiments, the endophyte comprises an ITS rRNA nucleic acid sequence at least 95%, at least 96%, at least 97%, at least 98%, at least 99%, or 100% identical to the nucleic acid sequence of SEQ ID NO: 344.

In some embodiments of any of the plants, formulations, synthetic combinations, or other compositions of the invention, the endophyte expresses one or more genes encoding a protein whose amino acid sequence is at least 95%, at least 96%, at least 97%, at least 98%, at least 99%, or 100% identical to an amino acid sequence selected from the group consisting of SEQ ID NOs: 477-501, 505, 514, 518, 521, 528, 530, 531, 550, 566, 567, 572, 579, 580, 581, 587, 593, 600, 602, 614, 623, 630, 635, 643, 645, 652, 657, 661, 662, 667, 670, 672, 673, 4510-4535, 4540, 4541, 4542, 4547, 4555, 4558, 4560, 4569, 4570, 4571, 4572, 4577, 4582, 4592, 4594, 4602, 4608, 4609, 4622, 4626, 4641, 4643, 4653, 4654, 4742-4766, 4734, 4739, 4740, 477, 478, 480, 482, 484, 485, 487, 489, 494, 496, 497, 501, 530, 567, 587, 602, 614; 633, 645, 649, 651, 652, 658, 665, 666, 667, 673, 874, 934, 1013, 1249, 1342, 2252, 2272, 2273, 2281, 2282, 2284, 2285, 2286, 2287, 2289, 2290, 2291, 2292, 2293, 2296, 4510, 4514, 4515, 4518, 4520, 4521, 4525, 4526, 4527, 4529, 4532, 4538, 4539, 4540, 4555, 4559, 4560, 4562, 4569, 4570, 4571, 4572, 4577, 4581, 4582, 4594, 4595, 4597, 4608, 4615, 4618, 4623, 4624, 4626, 4630, 4632, 4635, 4641, 4642, 4646, 4650, 4658, 4659, 4661, 4662, 4663, 4666, 4667, 4668, 4670, 4799, 4801, 4802, 4803, 4804, 4805, 4826, 4827, 4828, 4829, 4830, 4831, 4832, 4833, 4834, 4835, 4836, 4837, 4838, 4839, 4840, 4841, 4863, 4864, 4865, 4866, 4867, 4868, 4869, 4870, 4871, 4872, 4873, 4874, 4875, 4876, 4877, 4878, 4879, 4880, 4881, 4882, 4883, 4884, 4885, 4886, 4887, 4888, 4889, 4890, 4891, 4892, 4893, 4894, 4917, 4918, 4919, 4920, 4921, 4922, 4923, 4924, 4925, 4939, 4940, 4941, 4943, 4947, 4948, 4950, 4951, 4955, 4956, 4957, 2315, 2320, 2322, 2326, 2349, 2350, 2352, 2377, 2382, 2390, 2407, 2422, 2436, 2443, 2457, 2463, 2464, 2470, 2477, 2483, 2721, 2968, 3093, 3185, 4096, 4097, 4098, 4099, 4100, 4101, 4102, 4103, 4104, 4105, 4106, 4107, 4108, 4109, 4110, 4111, 4112, 4113, 4114, 4115, 4116, 4117, 4118, 4119, 4120, 4121, 4122, 4123, 4124, 4125, 4126, 4346, 4353, 4362, 4369, 4386, 4391, 4394, 4408, 4410, 4413, 4415, 4422, 4423, 4432, 4433, 4442, 4469, 4487, 4489, 4491, 4493, 4494, 4495, 4496, 4497, 4498, 4499, 4500, 4501, 4502, 4503, 4504, 4505, 4506, 4507, 4508, 4509, 4343, 4484, 4485, 4486, 4488, 4490, and 4492.

In some embodiments of any of the plants, formulations, synthetic combinations, or other compositions of the invention, the endophyte expresses one or more genes involved in starch and sucrose metabolism, cell wall degradation, or protection from oxidative stress. In some embodiments, the protein is expressed with at least a two-fold difference, at least a three-fold difference, at least a four-fold difference, at least a five-fold difference, at least a six-fold difference, at least a seven-fold difference, at least an eight-fold difference, at least a nine-fold difference, at least a ten-fold difference or more in expression level as compared to the protein expression level of a reference microorganism. In some embodiments, the difference in expression level is positive.

In some embodiments, the difference in expression level is negative. In some embodiments, the endophyte comprises an ITS rRNA nucleic acid sequence at least 95%, at least 96%, at least 97%, at least 98%, at least 99%, or 100% identical to a nucleic acid sequence selected from the group consisting of SEQ ID NOs: 344 and 447. In some embodiments, the wherein the endophyte comprises a 16S rRNA nucleic acid sequence at least 95%, at least 96%, at least 97%, at least 98%, at least 99%, or 100% identical to a nucleic acid sequence selected from the group consisting of SEQ ID NOs: 439 or 441.

Therefore, in a first aspect, inventions described herein provide a synthetic combination of a plant element of a first plant and a preparation of an endophyte that is coated onto the surface of the plant element of the first plant such that the endophyte is present at a higher level on the surface of the plant element than is present on the surface of an uncoated reference plant element, wherein the endophyte is isolated from the inside of the plant element of a second plant. In some embodiments, a synthetic combination comprises a plant element of a first plant and a preparation of one or more endophytes. In some embodiments, the one or more endophytes are selected from the group consisting of fungi, bacteria, and combinations thereof. In some embodiments, the one or more endophytes of the synthetic combination are fungi. In some embodiments, at least 1, 2, 3, 4, 5, 6, 7, 8, 9 or 10 or more endophytes of the synthetic combination are fungi. In some embodiments, one or more endophytes of the synthetic combination are bacteria. In some embodiments, at least 1, 2, 3, 4, 5, 6, 7, 8, 9 or 10 or more endophytes of the synthetic combination are bacteria. In some embodiments, one or more endophytes of the synthetic combination comprise both fungi and bacteria. In some embodiments, one or more endophytes of the synthetic combination comprise at least one fungus and at least one bacterium. In some embodiments, one or more endophytes of the synthetic combination comprise at least 1, 2, 3, 4, 5, 6, 7, 8, 9 or 10 or more bacteria, at least 1, 2, 3, 4, 5, 6, 7, 8, 9 or 10 or more fungi, and combinations thereof.

In some embodiments, the endophyte comprises a taxon that is present in at least two species that are selected from cereal, fruit and vegetable, wild grassland and oilseed plants. In some embodiments, the endophyte comprises a nucleic acid that is at least 97% identical, for example, at least 98% identical, at least 99% identical, at least 99.5% identical, or 100% identical to the nucleic acid sequence selected from the groups provided in Table 1, Table 2, Table 7, and Table 8.

In some embodiments, the isolated endophyte is cultured, for example, prior to being coated onto the surface of the plant element. The endophyte can be cultured in a synthetic or semi-synthetic medium.

The isolated endophyte can be associated with the surface of the seed of the first plant. In some embodiments, the endophyte is not associated with the surface of the plant element of the first plant.

The present invention contemplates a synthetic combination in which the first plant and the second plant are the same species. In a particular embodiment, the first plant and the second plant are the same cultivar. The synthetic combination may also make use of an endophyte that is isolated from a plant that is a different species from the first plant.

In some embodiments, the plant element of the first plant is from a monocotyledonous plant. For example, the plant element of the first plant is from a cereal plant. The plant element of the first plant can be selected from the group consisting of maize, wheat, barley, onion, rice, or sorghum. In an alternative embodiment, the seed of the first plant is from a dicotyledonous plant. The plant element of the first plant can be selected from the group consisting of cotton, *Brassica napus*, tomato, pepper, cabbage, lettuce, melon, strawberry, turnip, watermelon, peanut or soybean. In a particular embodiment, the plant is not a cotton plant. In still another embodiment, the plant is not a soybean. In another embodiment, the plant is not maize. In yet another embodiment, the plant is not wheat.

In some embodiments, the plant element of the first plant can be from a genetically modified plant. In another embodiment, the plant element of the first plant can be a hybrid plant element.

The synthetic combination can comprise a plant element of the first plant that is surface-sterilized prior to combining with the endophytes.

As stated above, the endophyte used in the synthetic combination is derived from within the plant element of a second plant. In some embodiments, the second plant is a monocotyledonous plant or tissue thereof. In a particular embodiment, the second plant is a cereal plant or tissue thereof. In some embodiments, the second plant is selected from the group consisting of a maize plant, a barley plant, a wheat plant, an onion plant, a rice plant, or a sorghum plant. In some embodiments, the plant element is a seed that is a naked grain (i.e., without hulls or fruit cases). In an alternative embodiment, the second plant is a dicotyledonous plant. For example, the second plant can be selected from the group consisting of a cotton plant, a *Brassica Napus* plant, a tomato plant, a pepper plant, a cabbage plant, a lettuce plant, a melon plant, a strawberry plant, a turnip plant, a watermelon plant, a peanut plant or a soybean plant.

In some embodiments, the endophyte is coated on the surface of the plant element of the first plant in an amount effective to confer in the plant element or resulting plant thereof an improved agronomic trait. For example, in one embodiment, the agronomic trait is selected from the group consisting of: improved leaf biomass, improved vigor, improved fruit mass, improved grain yield, improved root mass, increased flower number, increased plant height, earlier flowering, and enhanced germination rate. Alternatively, or in addition, the agronomic trait is selected from the group consisting of: improved resistance to drought, improved water use efficiency, improved nitrogen use efficiency, improved nitrogen uptake, improved resistance to salt stress, improved resistance to heat, improved resistance to cold, improved metal tolerance, and improved nutritional content, improved uptake of micronutrients including metal ions, improved uptake of phosphorus and improved uptake of potassium. In some embodiments, the agronomic trait is selected from the group consisting of: improved nematode resistance, improved fungal pathogen resistance, improved pathogen resistance, improved herbivore resistance, improved viral pathogen resistance.

In some embodiments, the seed of the first plant is coated with at least 1 CFU or spores of the endophyte per seed, for example, at least 2 CFU or spores, at least 5 CFU or spores, at least 10 CFU or spores, at least 30 CFU or spores, at least 100 CFU or spores, at least 300 CFU or spores, at least 1,000 CFU or spores, at least 3,000 CFU or spores, at least 10,000 CFU or spores, at least 30,000 CFU or spores or more per seed.

The synthetic combination can additionally comprise a seed coating composition. The seed coating composition can comprise an agent selected from the group consisting of: a fungicide, an antibacterial agent, an herbicide, a nematicide, an insecticide, a plant growth regulator, a rodenticide, a nutrient, and combinations thereof. The seed coating composition can further comprise an agent selected from the group consisting of an agriculturally acceptable carrier, a tackifier, a microbial stabilizer, and combinations thereof. In some embodiments, the seed coating composition can contain a second microbial preparation, including but not limited to a rhizobial bacterial preparation.

The present invention contemplates the use of endophytes that are unmodified, as well as those that are modified. In some embodiments, the endophyte is a recombinant endophyte. In one particular embodiment, the endophyte is modified prior to coating onto the surface of the seed such that it has enhanced compatibility with an antimicrobial agent when compared with the unmodified. For example, the endophyte can be modified such that it has enhanced compatibility with an antibacterial agent. In an alternative embodiment, the endophyte has enhanced compatibility with an antifungal agent. The endophyte can be modified such that it exhibits at least 3 fold greater, for example, at least 5 fold greater, at least 10 fold greater, at least 20 fold greater, at least 30 fold greater or more resistance to an antimicrobial agent when compared with the unmodified endophyte. The endophyte can be substantially purified from any other microbial entity. In one embodiment, the antimicrobial agent is an antibacterial agent. In another embodiment, the antimicrobial agent is an antifungal agent.

In one particular embodiment, the antimicrobial agent is glyphosate. For example, the modified endophyte exhibits at least 3 fold greater, for example, at least 5 fold greater, at least 10 fold greater, at least 20 fold greater, at least 30 fold greater or more resistance to the antimicrobial agent when compared with the unmodified endophyte. In the alternative, the modified endophyte has a doubling time in growth medium containing at least 1 mM glyphosate, for example, at least 2 mM glyphosate, at least 5 mM glyphosate, at least 10 mM glyphosate, at least 15 mM glyphosate or more, that is no more than 250%, for example, no more than 200%, no more than 175%, no more than 150%, or no more than 125%, of the doubling time of the endophyte in the same growth medium containing no glyphosate. In still another embodiment, the modified endophyte has a doubling time in a plant tissue containing at least 10 ppm glyphosate, for example, at least 15 ppm glyphosate, at least 20 ppm glyphosate, at least 30 ppm glyphosate, at least 40 ppm glyphosate or more, that is no more than 250%, for example, no more than 200%, no more than 175%, no more than 150%, or no more than 125%, of the doubling time of the unmodified endophyte in a reference plant tissue containing no glyphosate.

The present invention also contemplates the use of multiple endophytes. For example, in some embodiments, the synthetic combination described above can comprise a plurality of purified endophytes, for example, 2, 3, 4 or more different types of endophytes.

In another aspect, the present invention provides for a method for improving a trait in an agricultural plant, the method comprising: Providing an agricultural plant, contacting the plant with a formulation comprising a endophytic microbial entity comprising a nucleic acid sequence that is at least 97% identical, at least 98% identical, at least 99% identical, at least 99.5% identical, or 100% identical, to the nucleic acid sequence selected from the groups provided in Table 1, Table 2, Table 7, and Table 8 that is present in the formulation in an amount effective to colonize the plant and allowing the plant to grow under conditions that allow the endophytic microbial entity to colonize the plant.

Also described herein are preparations comprising a population of isolated modified endophytes described above. Preparations described herein further comprise an agriculturally acceptable carrier, and the preparation comprises an amount of endophytes sufficient to improve an agronomic trait of the population of seeds. For example, in one embodiment, the agronomic trait is selected from the group consisting of: improved leaf biomass, improved vigor, improved fruit mass, improved grain yield, improved root mass, increased flower number, increased plant height, earlier flowering, enhanced germination rate and combinations thereof. Alternatively, or in addition, the agronomic trait is selected from the group consisting of: improved resistance to drought, improved water use efficiency, improved nitrogen use efficiency, improved nitrogen uptake, improved resistance to salt stress, improved resistance to heat, improved resistance to cold, improved metal tolerance, improved nutritional content, improved uptake of micronutrients including metal ions, improved uptake of phosphorus, improved uptake of potassium and combinations thereof. In some embodiments, the agronomic trait is selected from the group consisting of: improved nematode resistance, improved fungal pathogen resistance, improved pathogen resistance, improved herbivore resistance, improved viral pathogen resistance, and combinations thereof. In some embodiments, the preparation is substantially stable at temperatures between about 2° C. and about 45° C. for at least about thirty days.

Preparations can be conveniently formulated to provide the ideal number of endophytes onto a seed to produce synthetic combinations described above. In some embodiments, a preparation is formulated to provide at least 100 endophytes, for example, at least 300 endophyte, 1,000 endophytes, 3,000 endophytes, 10,000 endophytes or more per seed. In some embodiments, a preparation is formulated to provide a population of plants that demonstrates a substantially homogenous growth rate when introduced into agricultural production. Inventions described herein also contemplate a preparation comprising two or more different purified endophytes.

Also described herein are commodity plant products comprising a plant or part of a plant (including a seed) and further comprising the modified endophyte described above that is present in a detectable level, for example, as detected by the presence of its nucleic acid by PCR.

In another aspect of the present invention, a seed comprising synthetic combinations described herein is provided. In still another aspect, disclosed is a substantially uniform population of seeds comprising a plurality of such seeds. In one embodiment, at least 10%, at least 20%, at least 30%, at least 40%, at least 50%, at least 60%, at least 70%, at least 75%, at least 80%, at least 90%, at least 95% or more of the seeds in the population, contains a viable endophyte or endophytes disposed on the surface of the seeds. In a particular embodiment, at least 10%, at least 20%, at least 30%, at least 40%, at least 50%, at least 60%, at least 70%, at least 75%, at least 80%, at least 90%, at least 95% or more of the seeds in the population contains at least 10 CFU or spores, for example, at least 30 CFU or spores, at least 100 CFU or spores, at least 300 CFU or spores, at least 1,000 CFU or spores, at least 3,000 CFU or spores, at least 10,000 CFU or spores or more, of the endophyte or endophytes coated onto the surface of the seed.

In still another aspect, the present invention discloses a substantially uniform population of plants produced by growing the population of seeds described above. In one embodiment, at least 75%, at least 80%, at least 90%, at least 95% or more of the plants comprise in one or more tissues an effective amount of the endophyte or endophytes. In another embodiment, at least 10%, 20%, 30%, 40%, 50%, 60%, 70%, 75%, at least 80%, at least 90%, at least 95% or more of the plants comprise a microbe population that is substantially similar.

In another aspect, described herein is an agricultural field, including a greenhouse comprising the population of plants described above. In on embodiment, the agricultural field comprises at least 100 plants. In another embodiment, the population occupies at least about 100 square feet of space, wherein at least about 10%, 20%, 30%, 40%, 50%, 60%, 70%, 80%, 90% or more than 90% of the population comprises an effective amount of the microbe. In another embodiment, the population occupies at least about 100 square feet of space, wherein at least about 10%, 20%, 30%, 40%, 50%, 60%, 70%, 80%, 90% or more than 90% of the population comprises the microbe in reproductive tissue. In still another embodiment, the population occupies at least about 100 square feet of space, wherein at least about 10%, 20%, 30%, 40%, 50%, 60%, 70%, 80%, 90% or more than 90% of the population comprises at least 10 CFUs or spores, 100 CFUs or spores, 1,000 CFUs or spores, 10,000 CFUs or spores or more of the microbe. In yet another embodiment, the population occupies at least about 100 square feet of space, wherein at least about 10%, 20%, 30%, 40%, 50%, 60%, 70%, 80%, 90% or more than 90% of the population comprises an exogenous microbe (i.e., the endophyte) of monoclonal origin.

In another aspect, disclosed is a method of producing a commodity plant product, comprising obtaining a plant or plant tissue from the synthetic combination described above, and producing the commodity plant product therefrom. The commodity plant product can be produced from the seed, or the plant (or a part of the plant) grown from the seed. The commodity plant product can also be produced from the progeny of such plant or plant part. The commodity plant product can be is selected from the group consisting of grain, flour, starch, seed oil, syrup, meal, flour, oil, film, packaging, nutraceutical product, an animal feed, a fish fodder, a cereal product, a processed human-food product, a sugar or an alcohol and protein.

BRIEF DESCRIPTION OF THE DRAWINGS

The drawings are for illustration purposes only not for limitation.

DETAILED DESCRIPTION

Definitions

Figure 1:
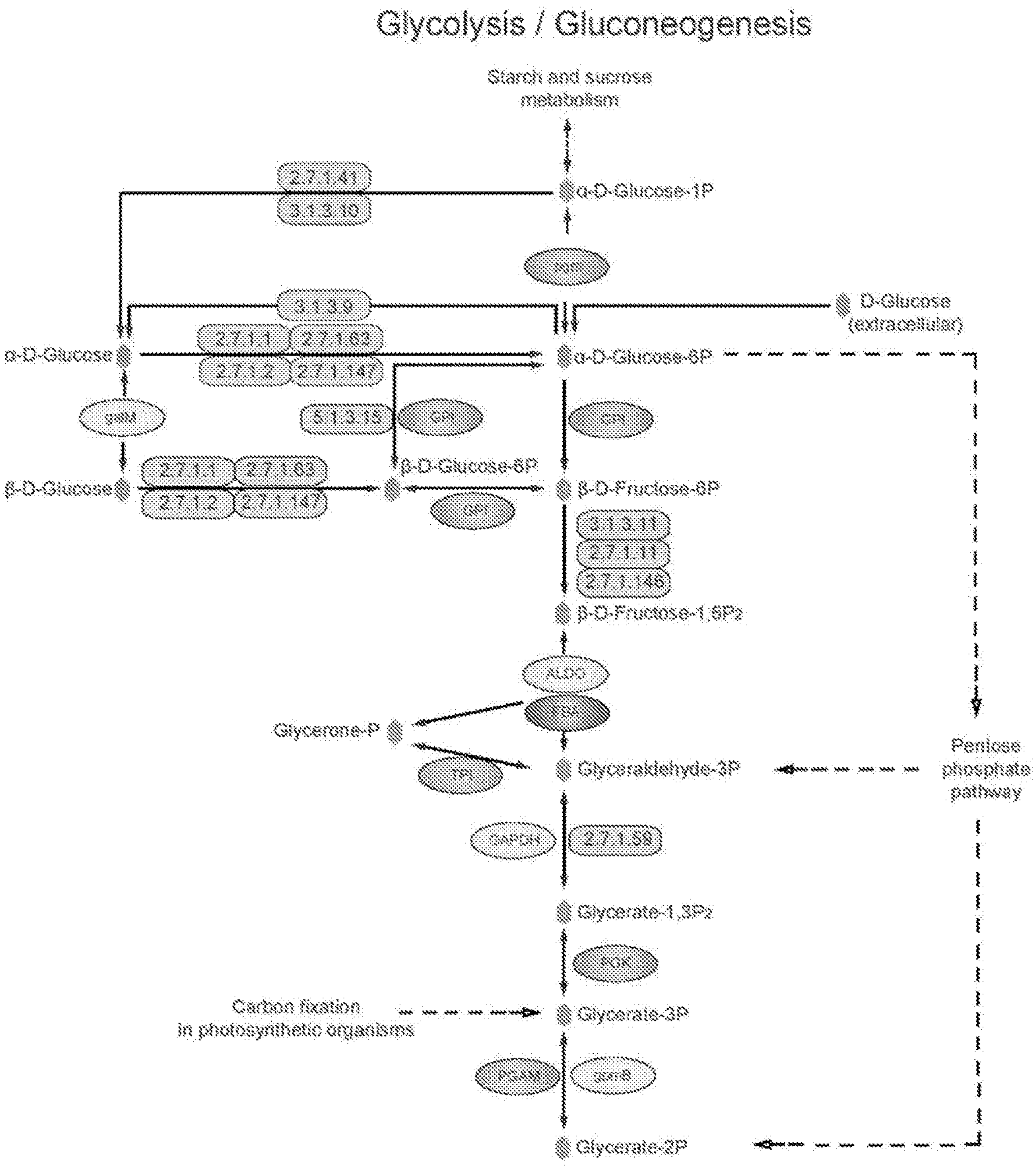
FIG. 1 depicts an exemplary schematic of a KEGG pathway for Glycolysis/Gluconeogenesis. The secreted proteome of a beneficial and neutral *Agrobacterium* were contrasted, and KEGG IDs that were enriched are depicted. 5AY represents beneficial SYM01004 (SEQ ID NO: 441). 5BY represents neutral SYM00091 (SEQ ID NO: 427). Light grey ovals represent proteins corresponding to 5AY. Dark grey ovals represent proteins corresponding to 5BY. Medium grey ovals represent proteins corresponding with both 5AY and 5BY. P-value=1.36e−8
Figure 2:
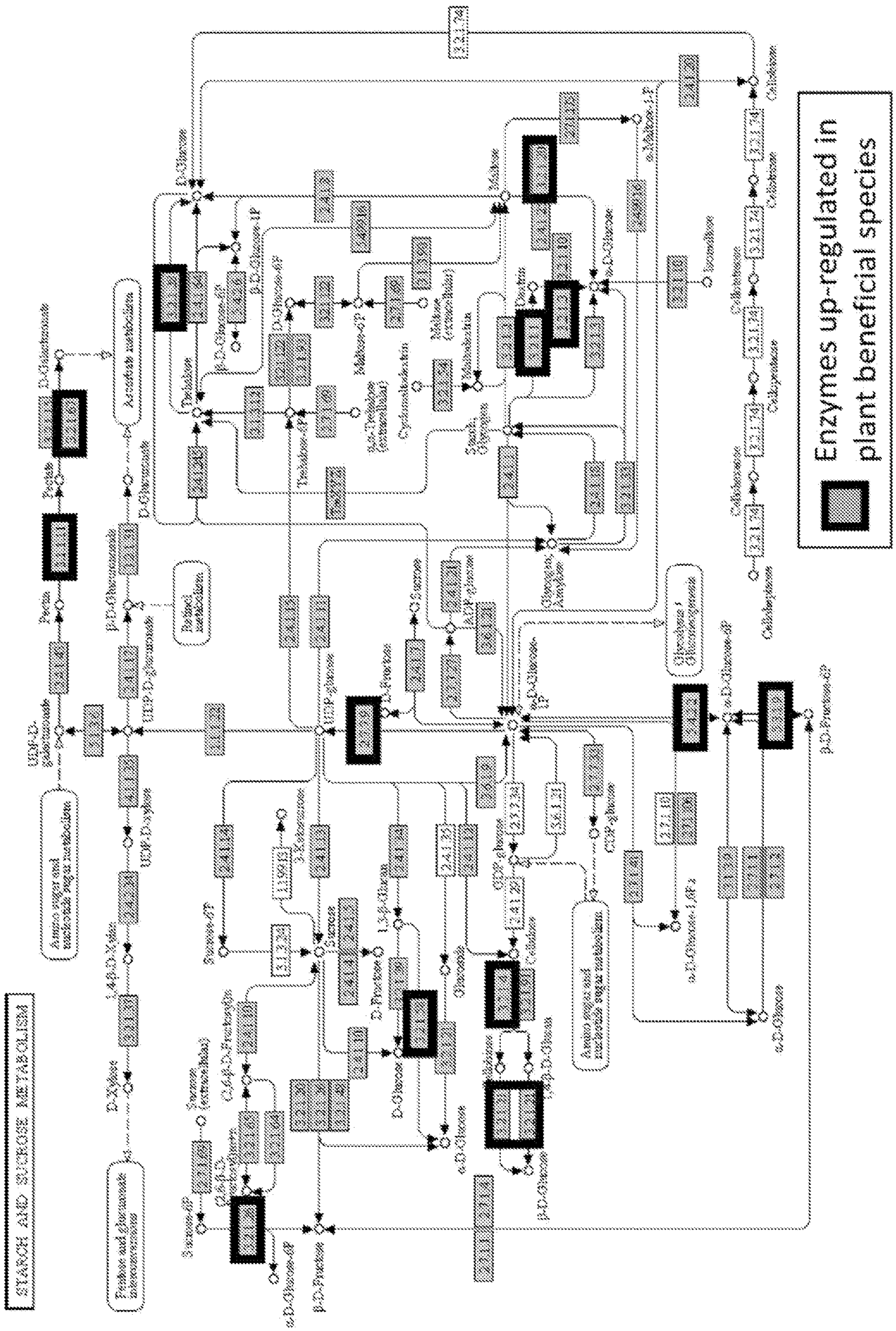
FIG. 2 depicts an exemplary schematic of a KEGG pathway for starch and sucrose metabolism. The secreted proteome of a beneficial and neutral bacteria and fungi were contrasted, and KEGG IDs that were enriched are depicted.

In order for the present invention to be more readily understood, certain terms are first defined below. Additional definitions for the following terms and other terms are set forth throughout the specification.

As used herein, an "agricultural seed" is a seed used to grow a plant typically used in agriculture (an "agricultural plant"). The seed may be of a monocot or dicot plant, and may w be planted for the production of an agricultural product, for example grain, food, feed, fiber, fuel, etc. As used herein, an agricultural seed is a seed that is prepared for planting, for example, in farms for growing.

An "endophyte" or "endophytic entity" or "endophytic microbe" is a symbiotic organism (e.g., a microorganism, e.g., a bacterium, e.g., a fungi) capable of living within a plant or is otherwise associated therewith, and does not cause disease or harm the plant otherwise, and confers one or more beneficial properties to the host plant. In some embodiments, an endophyte is a microorganism. In some embodiments, an endophyte is a microorganism that is associated with one or more host plant tissues and is in a symbiotic, e.g., beneficial relationship with said host plant tissues. In some embodiments, an endophyte is a microorganism, e.g., a bacterial or fungal organism, that confers an increase in yield, an increase in biomass, an increase in stress resistance, an increase in fitness, or combinations thereof, in its host plant. Endophytes may occupy the intracellular or extracellular spaces of plant tissue, including the leaves, stems, flowers, fruits, seeds, roots and combinations thereof. As used herein, the term "endophytic component" refers to a composition and/or structure that is part of the endophyte.

As used herein, the term "microbe" or "microorganism" refers to any species or taxon of microorganism, including, but not limited to, archaea, bacteria, microalgae, fungi (including mold and yeast species), mycoplasmas, microspores, nanobacteria, oomycetes, and protozoa. In some embodiments, a microbe or microorganism is an endophyte. In some embodiments, a microbe is an endophyte. In some embodiments, a microbe or microorganism encompasses individual cells (e.g., unicellular microorganisms) or more than one cell (e.g., multi-cellular microorganism). A "population of microorganisms" may thus refer to a multiple cells of a single microorganism, in which the cells share common genetic derivation. As used herein, the term "neutral" microbe or "neutral" microorganism refers to a microorganism that is both non-beneficial and non-pathogenic to a host plant.

As used herein, the term "bacteria" or "bacterium" refers in general to any prokaryotic organism, and may reference an organism from either Kingdom Eubacteria (Bacteria), Kingdom Archaebacteria (Archae), or both.

As used herein, the term "fungus" or "fungi" refers in general to any organism from Kingdom Fungi.

A "spore" or a population of "spores" refers to bacteria or fungi that are generally viable, more resistant to environmental influences such as heat and bactericidal or fungicidal agents than other forms of the same bacteria or fungi, and typically capable of germination and out-growth. Bacteria and fungi that are "capable of forming spores" are those bacteria and fungi comprising the genes and other necessary abilities to produce spores under suitable environmental conditions.

"Internal Transcribed Spacer" (ITS) refers to the spacer DNA (non-coding DNA) situated between the small-subunit ribosomal RNA (rRNA) and large-subunit rRNA genes in the chromosome or the corresponding transcribed region in the polycistronic rRNA precursor transcript.

A "plurality of endophytes" means two or more types of endophyte entities, e.g., of simple bacteria or simple fungi, complex fungi, or combinations thereof. In some embodiments, the two or more types of endophyte entities are two or more strains of endophytes. In other embodiments, the two or more types of endophyte entities are two or more species of endophytes. In yet other embodiments, the two or more types of endophyte entities are two or more genera of endophytes. In yet other embodiments, the two or more types of endophyte entities are two or more families of endophytes. In yet other embodiments, the two or more types of endophyte entities are two or more orders of endophytes.

A "population" of endophytes refers to a plurality of cells of a single endophyte, in which the cells share common genetic derivation.

A "complex network" means a plurality of endophytes co-localized in an environment, such as on or within an agricultural plant. Preferably, a complex network includes two or more types of endophyte entities that synergistically interact, such synergistic endophytic populations capable of providing a benefit to the agricultural seed, seedling, or plant derived thereby.

The terms "pathogen" and "pathogenic" in reference to a bacterium or fungus includes any such organism that is capable of causing or affecting a disease, disorder or condition of a host comprising the organism.

A "spore" or a population of "spores" refers to bacteria or fungi that are generally viable, more resistant to environmental influences such as heat and bactericidal or fungicidal agents than other forms of the same bacteria or fungi, and typically, capable of germination and out-growth. Bacteria and fungi that are "capable of forming spores" are those bacteria and fungi comprising the genes and other necessary abilities to produce spores under suitable environmental conditions.

As used herein, a "colony-forming unit" ("CFU") is used as a measure of viable microorganisms in a sample. A CFU is an individual viable cell capable of forming on a solid medium a visible colony whose individual cells are derived by cell division from one parental cell.

The term "isolated" is intended to specifically reference an organism, cell, tissue, polynucleotide, or polypeptide that is removed from its original source and purified from additional components with which it was originally associated. For example, an endophyte may be considered isolated from a seed if it is removed from that seed source and purified so that it is isolated from any additional components with which it was originally associated. Similarly, an endophyte may be removed and purified from a plant or plant element so that it is isolated and no longer associated with its source plant or plant element.

As used herein, an isolated strain of a microbe is a strain that has been removed from its natural milieu. "Pure cultures" or "isolated cultures" are cultures in which the organisms present are only of one strain of a particular genus and species. This is in contrast to "mixed cultures," which are cultures in which more than one genus and/or species of microorganism are present. As such, the term "isolated" does not necessarily reflect the extent to which the microbe has been purified. A "substantially pure culture" of the strain of microbe refers to a culture which contains substantially no other microbes than the desired strain or strains of microbe. In other words, a substantially pure culture of a strain of microbe is substantially free of other contaminants, which can include microbial contaminants. Further, as used herein, a "biologically pure" strain is intended to mean the strain separated from materials with which it is normally associated in nature. A strain associated with other strains, or with compounds or materials that it is not normally wound with in nature, is still defined as "biologically pure." A monoculture of a particular strain is, of course, "biologically pure." As used herein, the term "enriched culture" of an isolated microbial strain refers to a microbial culture that contains more that 50%, 60%, 70%, 80%, 90%, or 95% of the isolated strain.

A "plant element" is intended to generically reference either a whole plant or a plant component, including but not limited to plant tissues, parts, and cell types. A plant element is preferably one of the following: whole plant, seedling, meristematic tissue, ground tissue, vascular tissue, dermal tissue, seed, leaf, root, shoot, stem, flower, fruit, stolon, bulb, tuber, corm, kelkis, shoot, bud. As used herein, a "plant element" is synonymous to a "portion" of a plant, and refers to any part of the plant, and can include distinct tissues and/or organs, and may be used interchangeably with the term "tissue" throughout.

Similarly, a "plant reproductive element" is intended to generically reference any part of a plant that is able to initiate other plants via either sexual or asexual reproduction of that plant, for example but not limited to: seed, seedling, root, shoot, stolon, bulb, tuber, corm, keikis, or bud.

A "population" of plants, as used herein, refers to a plurality of plants that are of the same taxonomic category, typically of the same species, and will also typically share a common genetic derivation.

As used herein, an "agricultural seed" is a seed used to grow a plant typically used in agriculture (an "agricultural plant"). The seed may be of a monocot or dicot plant, and may be planted for the production of an agricultural product, for example feed, food, fiber, fuel, etc. As used herein, an agricultural seed is a seed that is prepared for planting, for example, in farms for growing.

"Agricultural plants", or "plants of agronomic importance", include plants that are cultivated by humans for food, feed, fiber, and fuel purposes. Agricultural plants include monocotyledonous species such as: maize (*Zea mays*), common wheat (*Triticum aestivum*), spelt (*Triticum spelta*), einkorn wheat (*Triticum monococcum*), emmer wheat (*Triticum dicoccum*), durum wheat (*Triticum durum*), Asian rice (*Oryza sativa*), African rice (*Oryza glabaerreima*), wild rice (*Zizania aquatica, Zizania latifolia, Zizania palustris, Zizania texana*), barley (*Hordeum vulgare*), *Sorghum* (*Sorghum bicolor*), Finger millet (*Eleusine coracana*), Proso millet (*Panicum miliaceum*), Pearl millet (*Pennisetum glaucum*), Foxtail millet (*Setaria italica*), Oat (*Avena sativa*), Triticale (*Triticosecale*), rye (*Secale* cereal), Russian wild rye (*Psathyrostachys juncea*), bamboo (Bambuseae), or sugarcane (e.g., *Saccharum arundinaceum, Saccharum barberi, Saccharum bengalense, Saccharum edule, Saccharum munja, Saccharum officinarum, Saccharum procerum, Saccharum ravennae, Saccharum robustum, Saccharum sinense*, or *Saccharum spontaneum*); as well as dicotyledonous species such as: soybean (*Glycine max*), canola and rapeseed cultivars (*Brassica napus*), cotton (genus *Gossypium*), alfalfa (*Medicago sativa*), cassava (genus *Manihot*), potato (*Solanum tuberosum*), tomato (*Solanum lycopersicum*), pea (*Pisum sativum*), chick pea (*Cicer arietinum*), lentil (*Lens culinaris*), flax (*Linum usitatissimum*), peanut (*Arachis hypogaea*) and many varieties of vegetables.

A "host plant" includes any plant, particularly a plant of agronomic importance, which an endophyte can colonize. As used herein, an endophyte is said to "colonize" a plant or plant element when it can be stably detected within the plant or plant element over a period time; such as one or more days, weeks, months or years, in other words, a colonizing entity is not transiently associated with the plant or plant element. Such host plants are preferably plants of agronomic importance.

A "non-host target" means an organism or chemical compound that is altered in some way after contacting a host plant or host fungus that comprises an endophyte, as a result of a property conferred to the host plant or host fungus by the endophyte.

As used herein, a "hybrid plant" refers generally refers to a plant that is the product of a cross between two genetically different parental plants. A hybrid plant is generated by either a natural or artificial process of hybridization whereby the entire genome of one species, variety cultivar, breeding line or individual plant is combined intra- or interspecifically into the genome of species, variety or cultivar or line, breeding line or individual plant by crossing.

An "inbred plant", as used herein, refers to a plant or plant line that has been repeatedly crossed or inbred to achieve a high degree of genetic uniformity, and low heterozygosity, as is known in the art.

The term "isoline" is a comparative term, and references organisms that are genetically identical, but may differ in treatment. In one example, two genetically identical maize plant embryos may be separated into two different groups, one receiving a treatment (such as transformation with a heterologous polynucleotide, to create a genetically modified plant) and one control that does not receive such treatment. Any phenotypic differences between the two groups may thus be attributed solely to the treatment and not to any inherency of the plant's genetic makeup. In another example, two genetically identical seeds may be treated with a formulation that introduces an endophyte composition. Any phenotypic differences between the plants derived from those seeds may be attributed to the treatment, thus forming an isoline comparison.

Similarly, by the terms "reference plant", "reference agricultural plant" or "reference seed", it is meant an agricultural plant or seed of the same species, strain, or cultivar to which a treatment, formulation, composition or endophyte preparation as described herein is not administered/contacted. A reference agricultural plant or seed, therefore, is identical to the treated plant with the exception of the presence of the endophyte and can serve as a control for detecting the effects of the endophyte that is conferred to the plant.

A "reference environment" refers to the environment, treatment or condition of the plant in which a measurement is made. For example, production of a compound in a plant associated with an endophyte can be measured in a reference environment of drought stress, and compared with the levels of the compound in a reference agricultural plant under the same conditions of drought stress. Alternatively, the levels of a compound in plant associated with an endophyte and reference agricultural plant can be measured under identical conditions of no stress.

A "population" of plants refers to more than one plant, that are of the same taxonomic category, typically be of the same species, and will also typically share a common genetic derivation.

In some embodiments, the invention contemplates the use of microbes that are "exogenous" to a seed or plant. As used herein, a microbe is considered exogenous to the seed or plant if the plant element that is unmodified (e.g., a plant element that is not treated with the plurality of endophytes described herein) does not contain the microbe.

In some embodiments, a microbe can be "endogenous" to a seed or plant. As used herein, a microbe is considered "endogenous" to a plant or seed, if the endophyte or endophyte component is derived from, or is otherwise found in, a plant element of the plant specimen from which it is sourced. In embodiments in which an endogenous endophyte is applied, the endogenous microbe is applied in an amount that differs from the levels typically found in the plant.

In some embodiments, the present invention contemplates the synthetic compositions comprising the combination of a plant element, seedling, or whole plants and an endophyte population, in which the endophyte population is "heterologously disposed".

In some aspects, "heterologously disposed" means that the plant element, seedling, or plant does not contain detectable levels of the microbe in that same plant element, seedling, or plant. For example if said plant element or seedling or plant does not naturally have the endophyte associated with it and the endophyte is applied, the endophyte would be considered to be heterologously disposed. In some aspects, "heterologously disposed" means that the endophyte is being applied to a different plant element than that with which the endophyte is naturally associated. For example, if said plant element or seedling or plant has the endophyte normally found in the root tissue but not in the leaf tissue, and the endophyte is applied to the leaf, the endophyte would be considered to be heterologously disposed. In some aspects, "heterologously disposed" means that the endophyte being applied to a different tissue or cell layer of the plant element than that in which the microbe is naturally found. For example, if endophyte is naturally found in the mesophyll layer of leaf tissue but is being applied to the epithelial layer, the endophyte would be considered to be heterologously disposed. In some aspects, "heterologously disposed" means that the endophyte being applied is at a greater concentration, number, or amount of the plant element, seedling, or plant, than that which is naturally found in said plant element, seedling, or plant. For example, an endophyte concentration that is being applied is at least 1.5 times, between 1.5 and 2 times, 2 times, between 2 and 3 times, 3 times, between 3 and 5 times, 5 times, between 5 and 7 times, 7 times, between 7 and 10 times, 10 times greater, or even greater than 10 times higher number, amount, or concentration than that which is naturally present, the endophyte would be considered to be heterologously disposed. In some aspects, "heterologously disposed" means that the endophyte is applied to a developmental stage of the plant element, seedling, or plant in which said endophyte is not naturally associated, but may be associated at other stages. For example, if an endophyte is normally found at the flowering stage of a plant and no other stage, an endophyte applied at the seedling stage may be considered to be heterologously disposed. For the avoidance of doubt, "heterologously disposed" contemplates use of microbes that are "exogenous" to a seed or plant.

In some cases, the present invention contemplates the use of microbes that are "compatible" with agricultural chemicals, including but not limited to, a fungicide, an anti-complex compound, a bactericide, a virucide, an herbicide, a nematicide, a parasiticide, a pesticide, or any other agent widely used in agricultural which has the effect of killing or otherwise interfering with optimal growth of another organism. As used herein, a microbe is "compatible" with an agricultural chemical, when the microbe is modified, such as by genetic modification, e.g., contains a transgene that confers resistance to an herbicide, or otherwise adapted to grow in, or otherwise survive, the concentration of the agricultural chemical used in agriculture. For example, a microbe disposed on the surface of plant element is compatible with the fungicide metalaxyl if it is able to survive the concentrations that are applied on the plant element surface.

"Biomass" means the total mass or weight (fresh or dry), at a given time, of a plant tissue, plant tissues, an entire plant, or population of plants, usually given as weight per unit area. The term may also refer to all the plants or species in the community (community biomass).

Some of the compositions and methods described herein involve single endophyte strains or plurality of endophytes in an amount effective to colonize a plant. As used herein, a microbe is said to "colonize" a plant or seed when it can exist in an endophytic relationship with the plant in the plant environment, for example inside the plant or a part or tissue thereof, including the seed.

The compositions and methods herein may provide for an improved "agronomic trait" or "trait of agronomic importance" to a host plant, which may include, but not be limited to, the following: altered oil content, altered protein content, altered seed carbohydrate composition, altered seed oil composition, and altered seed protein composition, chemical tolerance, cold tolerance, delayed senescence, disease resistance, drought tolerance, ear weight, growth improvement, health enhancement, heat tolerance, herbicide tolerance, herbivore resistance, improved nitrogen fixation, improved nitrogen utilization, improved root architecture, improved water use efficiency, increased biomass, increased root length, increased seed weight, increased shoot length, increased yield, increased yield under water-limited conditions, kernel mass, kernel moisture content, metal tolerance, number of ears, number of kernels per ear, number of pods, nutrition enhancement, pathogen resistance, pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased number of pods per plant, increased length of pods per plant, reduced number of wilted leaves per plant, reduced number of severely wilted leaves per plant, and increased number of non-wilted leaves per plant, a detectable modulation in the level of a metabolite, a detectable modulation in the level of a transcript, and a detectable modulation in the proteome, compared to an isoline plant grown from a seed without said seed treatment formulation.

Additionally, "altered metabolic function" or "altered enzymatic function" may include, but not be limited to, the following: altered production of an auxin, altered nitrogen fixation, altered production of an antimicrobial compound, altered production of a siderophore, altered mineral phosphate solubilization, altered production of a cellulase, altered production of a chitinase, altered production of a xylanase, altered production of acetoin and altered ability to metabolize a carbon source.

An "increased yield" can refer to any increase in biomass or seed or fruit weight, seed size, seed number per plant, seed number per unit area, bushels per acre, tons per acre, kilo per hectare, or carbohydrate yield. Typically, the particular characteristic is designated when referring to increased yield, e.g., increased grain yield or increased seed size.

"Agronomic trait potential" is intended to mean a capability of a plant element for exhibiting a phenotype, preferably an improved agronomic trait, at some point during its life cycle, or conveying said phenotype to another plant element with which it is associated in the same plant. For example, a plant element may comprise an endophyte that will provide benefit to leaf tissue of a plant from which the plant element is grown; in such case, the plant element comprising such endophyte has the agronomic trait potential for a particular phenotype (for example, increased biomass in the plant) even if the seed itself does not display said phenotype.

By the term "capable of metabolizing" a particular carbon substrate, it is meant that the endophyte is able to utilize that carbon substrate as an energy source.

The term "synthetic combination" means a plurality of elements associated by human endeavor, in which said association is not found in nature. In some embodiments, "synthetic combination" is used to refer to a treatment formulation associated with a plant element. In some aspects of the present invention, "synthetic combination" refers to a purified population of endophytes in a treatment formulation comprising additional compositions with which said endophytes are not found associated in nature. The combination may be achieved, for example, by coating the surface of the seed of a plant, such as an agricultural plant, or host plant elements with an endophyte. In some embodiments of the present invention, "synthetic combination" refers to one or more plant elements in association with an isolated, purified population of endophytes in a treatment formulation comprising additional compositions with which said endophytes are not found associated in nature.

A "treatment formulation" refers to a mixture of chemicals that facilitate the stability, storage, and/or application of the endophyte composition(s). In some embodiments, an agriculturally compatible carrier can be used to formulate an agricultural formulation or other composition that includes a purified endophyte preparation. As used herein an "agriculturally compatible carrier" refers to any material, other than water, that can be added to a plant element without causing or having an adverse effect on the plant element (e.g., reducing seed germination) or the plant that grows from the plant element, or the like.

In some cases, the present invention contemplates the use of compositions that are "compatible" with agricultural chemicals, for example, a fungicide, an anti-complex compound, or any other agent widely used in agricultural which has the effect of killing or otherwise interfering with optimal growth of another organism.

Some compositions described herein contemplate the use of an agriculturally compatible carrier. As used herein an "agriculturally compatible carrier" is intended to refer to any material, other than water, which can be added to a seed or a seedling without causing/having an adverse effect on the seed, the plant that grows from the seed, seed germination, or the like.

As used herein, a nucleic acid has "homology" or is "homologous" to a second nucleic acid if the nucleic acid sequence has a similar sequence to the second, nucleic acid sequence. The terms "identity", "percent sequence identity" or "identical" in the context of nucleic acid sequences refer to the residues in the two sequences that are the same when aligned for maximum correspondence. There are a number of different algorithms known in the art that can be used to measure nucleotide sequence identity. For instance, polynucleotide sequences can be compared using FASTA, Gap or Bestfit, which are programs in Wisconsin Package Version 10.0, Genetics Computer Group (GCG), Madison, Wis. FASTA provides alignments and percent sequence identity of the regions of the best overlap between the query and search sequences. In some embodiments, sequences can be compared using Geneious (Biomatters, Ltd., Auckland, New Zealand). In other embodiments, polynucleotide sequences can be compared using the multiple sequence alignment algorithm MUSCLE. In some embodiments the nucleic acid sequence to be aligned is a complete gene. In some embodiments, the nucleic acid sequence to be aligned is a gene fragment. In some embodiments, if the nucleic acid sequence to be aligned is a gene fragment, the percent identity to a second nucleic acid sequence is considered X % identical if the two sequences are X % identical the length of the shortest sequence.

The term "substantial homology" or "substantial similarity," when referring to a nucleic acid or fragment thereof, indicates that, when optimally aligned with appropriate nucleotide insertions or deletions with another nucleic acid (or its complementary strand), there is nucleotide sequence identity in at least about 76%, 80%, 85%, or at least about 90%, or at least about 95%, 96%, 97%, 98% or 99% of the nucleotide bases, as measured by any well-known algorithm of sequence identity, such as FASTA, BLAST, MUSCLE or Gap, as discussed above.

As used herein, the terms "operational taxonomic unit," "OTU," "taxon," "hierarchical cluster," and "cluster" are used interchangeably. An operational taxon unit (OTU) refers to a group of one or more organisms that comprises a node in a clustering tree. The level of a cluster is determined by its hierarchical order. In some embodiments, an OTU is a group tentatively assumed to be a valid taxon for purposes of phylogenetic analysis. In other embodiments, an OTU is any of the extant taxonomic units under study. In yet another embodiment, an OTU is given a name and a rank. For example, an OTU can represent a domain, a sub-domain, a kingdom, a sub-kingdom, a phylum, a sub-phylum, a class, a sub-class, an order, a sub-order, a family, a subfamily, a genus, a subgenus, or a species. In some embodiments, OTUs can represent one or more organisms from the kingdoms eubacteria, protista, or fungi at any level of a hierarchal order. In some embodiments, an OTU represents a prokaryotic or fungal order.

As used herein, the terms "water-limited condition", "water stress condition" and "drought condition", or "water-limited", "water stress", and "drought", may be used interchangeably. For example, a method or composition for improving a plant's ability to grow under drought conditions means the same as the ability to grow under water-limited conditions. In such cases, the plant can be further said to display improved tolerance to drought stress.

The terms "decreased", "fewer", "slower" and "increased" "faster" "enhanced" "greater" as used herein refers to a decrease or increase in a characteristic of the endophyte treated seed or resulting plant compared to an untreated seed or resulting plant. For example, a decrease in a characteristic may be at least 1%, at least 2%, at least 3%, at least 4%, at least 5%, at least 10%, at least 15%, at least 20%, at least 25%, at least 30%, at least 35%, at least 40%, at least 45%, at least 50%, at least about 60%, at least 75%, at least about 80%, at least about 90%, at least 100%, at least 200%, at least about 300%, at least about 400% or more lower than the untreated control. For example, a decrease may be between 1% and 5%, or between 5% and 10%, or between 10% and 15%, or between 15% and 20%, or between 20% and 25%, or between 25% and 30%, or between 30% and 35%, or between 35% and 40%, or between 45% and 50% lower than the untreated control or the formulation control. An increase may be at least 1%, at least 2%, at least 3%, at least 4%, at least 5%, at least 10%, at least 15%, at least 20%, at least 25%, at least 30%, at least 35%, at least 40%, at least 45%, at least 50%, at least about 60%, at least 75%, at least about 80%, at least about 90%, at least 100%, at least 200%, at least about 300%, at least about 400% or more higher than the untreated control. For example, an increase may be between 1% and 5%, or between 5% and 10%, or between 10% and 15%, or between 15% and 20%, or between 20% and 25%, or between 25% and 30%, or between 30% and 35%, or between 35% and 40%, or between 45% and 50% higher than the untreated control or the formulation control.

Endophytes

Agricultural plants appear to associate with symbiotic microorganisms termed endophytes, particularly bacteria and fungi, that may have been important during evolution and may contribute to plant survival and performance. However, modern agricultural processes may have perturbed this relationship, resulting in increased crop losses, diminished stress resilience, biodiversity losses, and increasing dependence on external chemicals, fertilizers, and other unsustainable agricultural practices. There is a need for novel methods for generating plants with novel microbiome properties that can sustainably increase yield, stress resilience, and decrease fertilizer and chemical use.

The inventors have undertaken a systematic comparison of the microbial communities that reside within a wide diversity of plants. As such, the endophytic microbes useful for the invention generally relate to endophytic microbes that are present in agricultural plants.

In part, the present invention describes preparations of novel endophytes, and the creation of synthetic combinations of agricultural seeds and/or seedlings with heterologous endophytes and formulations containing the synthetic combinations, as well as the recognition that such synthetic combinations display a diversity of beneficial properties present in the agricultural plants and the associated endophyte populations newly created by the present inventors. Such beneficial properties include metabolism, transcript expression, proteome alterations, morphology, and the resilience to a variety of environmental stresses, and the combination of a plurality of such properties.

Provided are novel compositions, methods, and products related our invention's ability to overcome the limitations of the prior art in order to provide reliable increases in crop yield, biomass, germination, vigor, stress resilience, and other properties to agricultural crops.

We find that beneficial microbes can be robustly derived from plant elements, optionally cultured, administered heterologously to agricultural plant elements such as seeds, and colonize the resulting plant tissues with high efficiency to confer multiple beneficial properties.

We find that microbes can confer beneficial properties across a range of concentrations.

We find that endophytes can be heterologously disposed onto seedlings of a distinct cultivar, species, or crop type and confer benefits to those new recipients. For example, endophytes from corn cultivars are heterologously provided to wheat cultivars to confer a benefit. This is surprising given the observations of distinct microbiome preferences in distinct plant and mammalian hosts and, in particular, the likelihood that microbes derived from seeds have been co-evolved to be specialized to a particular host.

We further find that combinations of heterologously disposed endophytes confer additive advantages to plants, including multiple functional properties and resulting in seed, seedling, and plant hosts that display single or multiple improved agronomic properties.

Endophytes are microbes that grow inside a plant. Recent appreciation that endophytes can confer remarkable traits upon the host plant is the basis for the present invention. The inventors have developed a method to introduce isolated endophytes to another plant by coating the microbes onto the surface of a seed of a plant. By combining an endophyte sourced from one plant, it is possible to transfer the beneficial agronomic trait onto an agricultural plant, and therefore holds great promise for increasing agricultural productivity.

Combining a selected plant species, OTU, strain or cultivar with one or more types of endophytes thus provides mechanisms by which, alone or in parallel with plant breeding and transgenic technologies, is provided improved yield from crops and generation of products thereof. Therefore, in a first aspect, the present invention provides a synthetic combination comprising the combination of a plant element, seedling, or whole plants and a single endophyte strain or a plurality of endophytes, in which the single endophyte strain or a plurality of endophytes are "heterologously disposed."

Synthetic Compositions of Plant Elements and Endophytes

The present invention contemplates a synthetic combination of a plant element of a plant that is coated with an endophyte on its surface. The plant element can be any agricultural plant element, for example an agricultural seed. In one embodiment, the plant element of the first plant is from a monocotyledonous plant. For example, the plant element of the first plant is from a cereal plant. The plant element of the first plant can be selected from the group consisting of a maize plant, a wheat plant, a barley plant, an onion plant, a sorghum plant, or a rice plant. In an alternative embodiment, the plant element of the first plant is from a dicotyledonous plant. The plant element of the first plant can be selected from the group consisting of a cotton plant, a *Brassica napus* plant, a tomato plant, a pepper plant, a cabbage plant, a lettuce plant, a melon plant, a strawberry plant, a turnip plant, a watermelon plant, a peanut plant, or a soybean plant. In a particular embodiment, the plant is not a cotton plant. In still another embodiment, the seed of the first plant can be from a genetically modified plant. In another embodiment, the seed of the first plant can be a hybrid seed.

The synthetic combination can comprise a plant element of the first plant that is surface-sterilized prior to combining with the endophytes. Such pre-treatment prior to coating the plant element with endophytes removes the presence of other microbes that may interfere with the optimal colonization, growth and/or function of the endophyte. Surface sterilization of plant elements can be accomplished without killing the plant elements as described herein elsewhere (see, for example, the section Isolation of endophytes).

Sources of Endophytes

As described herein, endophytes can be derived from heterologous, homologous, or engineered sources, optionally cultured, administered heterologously as a single endophyte strain or a plurality of endophytes to plant elements, and, as a result of the administration, confer multiple beneficial properties. In some embodiments, endophytes are derived from plant elements or soil. In some embodiments, the plant element from which the endophyte is derived is a monocotyledonous plant. In a particular embodiment, the plant is a cereal plant or tissue thereof. In yet another embodiment, plant is selected from the group consisting of a maize plant, a barley plant, a wheat plant, a sugarcane plant, a sorghum plant, or a rice plant. In some embodiments, the plant element is a naked grain (i.e., without hulls or fruit cases). In an alternative embodiment, the plant element from which the endophyte is derived is a W dicotyledonous plant. For example, a plant can be selected from the group consisting of a cotton plant, a *Brassica napus* plant, a tomato plant, a pepper plant, a cabbage plant, a lettuce plant, a melon plant, a strawberry plant, a turnip plant, a watermelon plant, a peanut plant, or a soybean plant.

In some embodiments, the endophytes can be obtained from a plant element of the same or different crop, and can be from the same or different cultivar or variety as the plant element to which the composition is heterologously associated. For example, endophytes from a particular corn variety can be isolated and coated onto the surface of a corn seed of the same variety. In other embodiments, the endophytes can be isolated from a related species (e.g., an endophyte isolated from *Triticum monococcum* (einkorn wheat) can be coated onto the surface of a *T. aestivum* (common wheat) plant element; or, an endophyte from *Hordeum vulgare* (barley) can be isolated and coated onto the plant element of another member of the Triticeae family, for example, plant elements of the rye plant, *Secale cereale*). In still another embodiment, the endophytes can be isolated from a plant part of a plant that is distantly related to the plant element onto which the endophyte is to be coated. For example, tomato-derived endophytes are isolated and coated onto a rice plant element. In still another embodiment, endophytes used in a composition or used to make a synthetic composition can be obtained from a plant element of a plant that is distantly related to the plant element onto which the endophyte is to be coated. For example, a tomato-derived endophyte can be isolated and coated onto a rice plant element.

In some embodiments, the present invention contemplates the use of endophytes that can confer a beneficial agronomic trait upon the seed or resulting plant onto which it is coated. In another embodiment, the seed endophytes useful for the present invention can also be isolated from seeds of plants adapted to a particular environment, including, but not limited to, an environment with water deficiency, salinity, acute and/or chronic heat stress, acute and/or chronic cold stress, nutrient deprived soils including, but not limited to, micronutrient deprived soils, macronutrient (e.g., potassium, phosphate, nitrogen) deprived soils, pathogen stress, including fungal, nematode, insect, viral, bacterial pathogen stress. In one example, the endophyte is isolated from the seed of a plant that grows in a water deficient environment.

The synthetic combination of the present invention contemplates the presence of an endophyte on the surface of the seed of the first plant. In one embodiment, the seed of the to first plant is coated with at least 10 CFU or spores of the endophyte per seed, for example, at least 20 CFU or spores, at least 50 CFU or spores, at least 100 CFU or spores, at least 200 CFU or spores, at least 300 CFU or spores, at least 500 CFU or spores, at least 1,000 CFU or spores, at least 3,000 CFU or spores, at least 10,000 CFU or spores, at least 30,000 CFU or spores or more per plant element. In another embodiment, the plant element is coated with at least 10, for example, at least 20, at least 50, at least 100, at least 200, at least 300, at least 500, at least 1,000, at least 3,000, at least 10,000, at least 30,000, at least 100,000, at least 300,000, at least 1,000,000 or more of the endophyte as detected by the number of copies of a particular endophyte gene detected, for example, by quantitative PCR.

The endophyte useful for the present invention can be a fungus. In another embodiment, the endophyte can be a bacterium. In one embodiment, the endophyte is not an *Agrobacterium*. In another embodiment, the endophyte is not capable of nitrogen fixation (for example, from the genus *Rhizobium*). In still another embodiment, the endophyte is not from the genus *Acetobacter*. In yet another embodiment, the endophyte is not from the genus *Bacillus*. In a particular embodiment, the endophyte is not *Bacillus mojavensis*. In yet another embodiment, the endophyte is not from the genus *Neotyphodium*.

Historical taxonomic classification of fungi has been according to morphological presentation. Beginning in the mid-1800's, it was recognized that some fungi have a pleomorphic life cycle, and that different nomenclature designations were being used for different forms of the same fungus. In 1981, the Sydney Congress of the International Mycological Association laid out rules for the naming of fungi according to their status as anamorph, teleomorph, or holomorph. With the development of genomic sequencing, it became evident that taxonomic classification based on molecular phylogenetics did not align with morphological-based nomenclature. As a result, in 2011 the International Botanical Congress adopted a resolution approving the International Code of Nomenclature for Algae, Fungi, and Plants (Melbourne Code) (2012), with the stated outcome of designating "One Fungus=One Name". However, systematics experts have not aligned on common nomenclature for all fungi, nor are all existing databases and information resources inclusive of updated taxonomies. As such, many fungi referenced herein may be described by their anamorph form but it is understood that based on identical genomic sequencing, any pleomorphic state of that fungus may be considered to be the same organism. For example, the genus *Alternaria* is the anamorph form of the teleomorph genus *Lewia*, ergo both would be understood to be the same organism with the same DNA sequence.

Exogenous Endophytes

In one embodiment, the endophyte is an endophytic microbe that was isolated from a different plant than the inoculated plant. For example, in one embodiment, the endophyte can be an endophyte isolated from a different plant of the same species as the inoculated plant. In some cases, the endophyte can be isolated from a species related to the inoculated plant.

The breeding of plants for agriculture, as well as cultural practices used to combat microbial pathogens, may have resulted in the loss in modern cultivars of the endophytes present in their wild ancestors or other wild plants, or such practices may have inadvertently promoted other novel or rare plant-endophyte interactions, or otherwise altered the microbial) population. The former is the case in maize and its phylogenetically confirmed, direct wild ancestor, *Parviglumis teosinte* (*Zea mays* ssp. *Parviglumis*). Although both species have seeds that appear to contain a common core of endophytic bacterial species, the relative abundance of certain groups is higher in seeds of teosinte than modern corn. It is possible that this higher diversity and titer of endophytes in the ancestor is correlated with an equally wide range of physiological responses derived from the symbiosis that allow the plant to better adapt to the environment and tolerate stress. In order to survey plant groups for potentially useful endophytes, seeds of their wild ancestors, wild relatives, primitive landraces, modern landraces, modern breeding lines, and elite modern agronomic varieties can be screened for microbial endophytes by culture and culture independent methods as described herein. In addition, microbial endophytes can be isolated from other wild plants, such as grassland plants.

In some cases, plants are inoculated with endophytes that are exogenous to the seed of the inoculated plant. In one embodiment, the endophyte is derived from a plant of another species. For example, an endophyte that is normally found in dicots is applied to a monocot plant (e.g., inoculating corn with a soy bean-derived endophyte), or vice versa. In other cases, the endophyte to be inoculated onto a plant can be derived from a related species of the plant that is being inoculated. In one embodiment, the endophyte can be derived from a related taxon, for example, from a related species. The plant of another species can be an agricultural plant. For example, an endophyte derived from *Hordeum irregulare* can be used to inoculate a *Hordeum vulgare* L., plant. Alternatively, it can be derived from a 'wild' plant (i.e., a non-agricultural plant). For example, endophytes normally associated with the wild cotton *Gossypium klotzschianum* can be used to inoculate commercial varieties of *Gossypium hirsutum* plants. Endophytes normally associated with a wild turnip plant or a wild watermelon plant can be used to inoculate commercial varieties of turnip or watermelon plants, respectively. As an alternative example of deriving an endophyte from a 'wild' plant, endophytic bacteria isolated from the South East Asian jungle orchid, *Cymbidium eburneum*, as can be isolated and testing for their capacity to benefit seedling development and survival of agricultural crops such as wheat, maize, soy and others. In another example, endophytes may be isolated from wild grassland plants. In other cases, the endophyte can be isolated from an ancestral species of the inoculated plant. For example, an endophyte derived from *Zea diploperennis* can be used to inoculate a commercial variety of modern corn, or *Zea mays*.

Selection of Plant Species from Desired Habitats for Isolation of Microbial Endophytes Different environments can contain significantly different populations of endophytes. For example, geographically isolated soils from different parts of the Americas have been shown to differ in 96% of the bacterial species they contain. Soils containing different microbial populations can strongly influence the endophytic bacterial population observed inside *Arabidopsis* illustrating that the environment can at least partially alter a plant's associated microbial population. This suggests that plants growing and especially thriving in choice environments are colonized by different and perhaps beneficial endophytes, whose isolation and inoculation onto crop plants may aid these plants to better survive in the same choice environment or to better resist certain stresses encountered in a normal agricultural environment. For instance, at least some of the bacteria isolated from plants growing in arid environments are expected to confer drought tolerance to host plants they are transplanted onto. Additionally, novel endophtytes may be found in related crop varieties grown in the choice environment. Once a choice environment is selected, seeds of choice plants to be sampled will be identified by their healthy and/or robust growth, and will then be sampled at least 5 at a time by excavating the entire plants plus small root ball including roots and associated soil and any seeds or fruit present on the plant. These will be placed in a cool (4° C. environment) for storage and prompt transport back to the lab for extraction of endophytes and DNA using methods described herein. Identification of choice environments or ecosystems for bioprospecting of plant associated endophytes from either wild plants or crop plants growing in the choice environments or ecosystems follows protocols described herein.

In one embodiment, the endophyte-associated plant is harvested from a soil type different than the normal soil type that the crop plant is grown on, for example from a gelisol (soils with permafrost within 2 m of the surface), for example from a histosol (organic soil), for example from a spodosol (acid forest soils with a subsurface accumulation of metal-humus complexes), for example from an andisol (soils formed in volcanic ash), for example from a oxisol (intensely weathered soils of tropical and subtropical environments), for example from a vertisol (clayey soils with high shrink/swell capacity), for example from an aridisol (CaCO3-containing soils of arid environments with subsurface horizon development), for example from a ultisol (strongly leached soils with a subsurface zone of clay accumulation and <35% base saturation), for example from a mollisol (grassland soils with high base status), for example from an alfisol (moderately leached soils with a so subsurface zone of clay accumulation and >35% base saturation), for example from a inceptisol (soils with weakly developed subsurface horizons), for example from a entisol (soils with little or no morphological development).

In another embodiment, the endophyte-associated plant is harvested from an ecosystem where the agricultural plant is not normally found, for example a tundra ecosystem as opposed to a temperate agricultural farm, for example from tropical and subtropical moist broadleaf forests (tropical and subtropical, humid), for example from tropical and subtropical dry broadleaf forests (tropical and subtropical, semihumid), for example from tropical and subtropical coniferous forests (tropical and subtropical, semihumid), for example from temperate broadleaf and mixed forests (temperate, humid), for example from temperate coniferous forests (temperate, humid to semihumid), from for example from boreal forests/taiga (subarctic, humid), for example from tropical and subtropical grasslands, savannas, and shrublands (tropical and subtropical, semiarid), for example from temperate grasslands, savannas, and shrublands (temperate, semiarid), for example from flooded grasslands and savannas (temperate to tropical, fresh or brackish water inundated), for example from montane grasslands and shrublands (alpine or montane climate), for example from Mediterranean forests, woodlands, and scrub or sclerophyll forests (temperate warm, semihumid to semiarid with winter rainfall), for example from mangrove forests, and for example from deserts and xeric shrublands (temperate to tropical, arid).

In another embodiment, the endophyte-associated plant is harvested from a soil with an average pH range that is different from the optimal soil pH range of the crop plant, for example the plant may be harvested from an ultra acidic soil (<3.5), from an extreme acid soil (3.5-4.4), from a very strong acid soil (4.5-5.0), from a strong acid soil (5.1-5.5), from a moderate acid soil (5.6-6.0), from an slight acid soil (6.1-6.5), from an neutral soil (6.6-7.3), from an slightly alkaline soil (7.4-7.8), from an moderately alkaline soil (7.9-8.4), from a strongly alkaline soil (8.5-9.0), or from an very strongly alkaline soil (>9.0).

In one embodiment, the endophyte-associated plant is harvested from an environment with average air temperatures lower than the normal growing temperature of the crop plant, for example 2-5° C. colder than average, for example, at least 5-10° C. colder, at least 10-15° C. colder, at least at least 15-20° C. colder, at least 20-25° C. colder, at least 25-30° C. colder, at least 30-35° C. colder, at least 35-40° C. colder, at least 40-45° C. colder, at least 45-50° C. colder, at least 50-55° C. colder or more, when compared with crop plants grown under normal conditions during an average growing season.

In one embodiment, the endophyte-associated plant is harvested from an environment with average air temperatures higher than the normal growing temperature of the crop plant, for example 2-5° C. hotter than average, for example, at least 5-10° C. hotter, at least 10-15° C. hotter, at least at least 15-20° C. hotter, at least 20-25° C. hotter, at least 25-30° C. hotter, at least 30-35° C. hotter, at least 35-40° C. hotter, at least 40-45° C. hotter, at least 45-50° C. hotter, at least 50-55° C. hotter or more, when compared with crop plants grown under normal conditions during an average growing season.

In another embodiment, the endophyte-associated plant is harvested from an environment with average rainfall lower than the optimal average rainfall received by the crop plant, for example 2-5% less rainfall than average, for example, at least 5-10% less rainfall, at least 10-15% less rainfall, at least 15-20% less rainfall, at least 20-25% less rainfall, at least 25-30% less rainfall, at least 30-35% less rainfall, at least 35-40% less rainfall, at least 40-45% less rainfall, at least 45-50% less rainfall, at least 50-55% less rainfall, at least 55-60% less rainfall, at least 60-65% less rainfall, at least 65-70% less rainfall, at least 70-75% less rainfall, at least 80-85% less rainfall, at least 85-90% less rainfall, at least 90-95% less rainfall, or less, when compared with crop plants grown under normal conditions during an average growing season.

In one embodiment, the endophyte-associated plant is harvested from an environment with average rainfall higher than the optimal average rainfall of the crop plant, for example 2-5% more rainfall than average, for example, at least 5-10% more rainfall, at least 10-15% more rainfall, at least 15-20% more rainfall, at least 20-25% more rainfall, at least 25-30% more rainfall, at least 30-35% more rainfall, at least 35-40% more rainfall, at least 40-45% more rainfall, at least 45-50% more rainfall, at least 50-55% more rainfall, at least 55-60% more rainfall, at least 60-65% more rainfall, at least 65-70% more rainfall, at least 70-75% more rainfall, at least 80-85% more rainfall, at least 85-90% more rainfall, at least 90-95% more rainfall, at least 95-100% more rainfall, or even greater than 100% more rainfall, or even greater than 200% more rainfall, or even greater than 300% more rainfall, or even greater than 400% more rainfall, or even greater than 500% more rainfall, when compared with crop plants grown under normal conditions during an average growing season.

In another embodiment, the endophyte-associated plant is harvested from a soil type with different soil moisture classification than the normal soil type that the crop plant is grown on, for example from an aquic soil (soil is saturated with water and virtually free of gaseous oxygen for sufficient periods of time, such that there is evidence of poor aeration), for example from an udic soil (soil moisture is sufficiently high year-round in most years to meet plant requirement), for example from an ustic soil (soil moisture is intermediate between udic and aridic regimes; generally, plant-available moisture during the growing season, but severe periods of drought may occur), for example from an aridic soil (soil is dry for at least half of the growing season and moist for less than 90 consecutive days), for example from a xeric soil (soil moisture regime is found in Mediterranean-type climates, with cool, moist winters and warm, dry summers).

In one embodiment, the endophyte-associated plant is harvested from an environment with average rainfall lower than the optimal average rainfall of the crop plant, for example 2-95% less rainfall than average, for example, at least 5-90% less rainfall, at least 10-85% less rainfall, at least 15-80% less rainfall, at least 20-75% less rainfall, at least 25-70% less rainfall, at least 30-65% less rainfall, at least 35-60% less rainfall, at least 40-55% less rainfall, at least 45-50% less rainfall, when compared with crop plants grown under normal conditions during an average growing season.

In one embodiment, the endophyte-associated plant is harvested from an environment with average rainfall higher than the optimal average rainfall of the crop plant, for example 2-5% more rainfall than average, for example, at least 5-10% more rainfall, at least 10-15% more rainfall, at least 15-20% more rainfall, at least 20-25% more rainfall, at least 25-30% more rainfall, at least 30-35% more rainfall, at least 35-40% more rainfall, at least 40-45% more rainfall, at least 45-50% more rainfall, at least 50-55% more rainfall, at least 55-60% more rainfall, at least 60-65% more rainfall, at least 65-70% more rainfall, at least 70-75% more rainfall, at least 80-85% more rainfall, at least 85-90% more rainfall, at least 90-95% more rainfall, at least 95-100% more rainfall, or even greater than 100% more rainfall, or even greater than 200% more rainfall, or even greater than 300% more rainfall, or even greater than 400% more rainfall, or even greater than 500% more rainfall, when compared with crop plants grown under normal conditions during an average growing season.

In another embodiment, the endophyte-associated plant is harvested from an agricultural environment with a crop yield lower than the average crop yield expected from the crop plant grown under average cultivation practices on normal agricultural land, for example 2-5% lower yield than average, for example, at least 5-10% lower yield, at least 10-15% lower yield, at least 15-20% lower yield, at least 20-25% lower yield, at least 25-30% lower yield, at least 30-35% lower yield, at least 35-40% lower yield, at least 40-45% lower yield, at least 45-50% lower yield, at least 50-55% lower yield, at least 55-60% lower yield, at least 60-65% lower yield, at least 65-70% lower yield, at least 70-75% lower yield, at least 80-85% lower yield, at least 85-90% lower yield, at least 90-95% lower yield, or less, when compared with crop plants grown under normal conditions during an average growing season.

In a related embodiment, the endophyte-associated plant is harvested from an agricultural environment with a crop yield lower than the average crop yield expected from the crop plant grown under average cultivation practices on normal agricultural land, for example 2-95% lower yield than average, for example, at least 5-90% lower yield, at least 10-85% lower yield, at least 15-80% lower yield, at least 20-75% lower yield, at least 25-70% lower yield, at least 30-65% lower yield, at least 35-60% lower yield, at least 40-55% lower yield, at least 45-50% lower yield, when compared with crop plants grown under normal conditions during an average growing season.

In one embodiment, the endophyte-associated plant is harvested from an environment with average crop yield higher than the optimal average crop yield of the crop plant, for example 2-5% more yield than average, for example, at least 5-10% more yield, at least 10-15% more yield, at least 15-20% more yield, at least 20-25% more yield, at least 25-30% more yield, at least 30-35% more yield, at least 35-40% more yield, at least 40-45% more yield, at least 45-50% more yield, at least 50-55% more yield, at least 55-60% more yield, at least 60-65% more yield, at least 65-70% more yield, at least 70-75% more yield, at least 80-85% more yield, at least 85-90% more yield, at least 90-95% more yield, at least 95-100% more yield, or even greater than 100% more yield, or even greater than 200% more yield, or even greater than 300% more yield, or even greater than 400% more yield, or even greater than 500% more yield, when compared with crop plants grown under normal conditions during an average growing season.

In a related embodiment, the endophyte-associated plant is harvested from an environment with average crop yield higher than the optimal average crop yield of the crop plant, 2-500% more yield than average, 2-400% more yield than average, 2-300% more yield than average, 2-200% more yield than average, 2-95% more yield than average, for example, at least 5-90% more yield, at least 10-85% more yield, at least 15-80% more yield, at least 20-75% more yield, at least 25-70% more yield, at least 30-65% more yield, at least 35-60% more yield, at least 40-55% more yield, at least 45-50% more yield, when compared with crop plants grown under normal conditions during an average growing season.

In another embodiment, the endophyte-associated plant is harvested from a environment where soil contains lower total nitrogen than the optimum levels recommended in order to achieve average crop yields for a plant grown under average cultivation practices on normal agricultural land, for example 2-5% less nitrogen than average, for example, at least 5-10% less nitrogen, at least 10-15% less nitrogen, at least 15-20% less nitrogen, at least 20-25% less nitrogen, at least 25-30% less nitrogen, at least 30-35% less nitrogen, at least 35-40% less nitrogen, at least 40-45% less nitrogen, at least 45-50% less nitrogen, at least 50-55% less nitrogen, at least 55-60% less nitrogen, at least 60-65% less nitrogen, at least 65-70% less nitrogen, at least 70-75% less nitrogen, at least 80-85% less nitrogen, at least 85-90% less nitrogen, at least 90-95% less nitrogen, or less, when compared with crop plants grown under normal conditions during an average growing season.

In another embodiment, the endophyte-associated plant is harvested from a environment where soil contains higher total nitrogen than the optimum levels recommended in order to achieve average crop yields for a plant grown under average cultivation practices on normal agricultural land, for example 2-5% more nitrogen than average, for example, at least 5-10% more nitrogen, at least 10-15% more nitrogen, at least 15-20% more nitrogen, at least 20-25% more nitrogen, at least 25-30% more nitrogen, at least 30-35% more nitrogen, at least 35-40% more nitrogen, at least 40-45% more nitrogen, at least 45-50% more nitrogen, at least 50-55% more nitrogen, at least 55-60% more nitrogen, at least 60-65% more nitrogen, at least 65-70% more nitrogen, at least 70-75% more nitrogen, at least 80-85% more nitrogen, at least 85-90% more nitrogen, at least 90-95% more nitrogen, at least 95-100% more nitrogen, or even greater than 100% more nitrogen, or even greater than 200% more nitrogen, or even greater than 300% more nitrogen, or even greater than 400% more nitrogen, or even greater than 500% more nitrogen, when compared with crop plants grown under normal conditions during an average growing season.

In another embodiment, the endophyte-associated plant is harvested from a environment where soil contains lower total phosphorus than the optimum levels recommended in order to achieve average crop yields for a plant grown under average cultivation practices on normal agricultural land, for example 2-5% less phosphorus than average, for example, at least 5-10% less phosphorus, at least 10-15% less phosphorus, at least 15-20% less phosphorus, at least 20-25% less phosphorus, at least 25-30% less phosphorus, at least 30-35% less phosphorus, at least 35-40% less phosphorus, at least 40-45% less phosphorus, at least 45-50% less phosphorus, at least 50-55% less phosphorus, at least 55-60% less phosphorus, at least 60-65% less phosphorus, at least 65-70% less phosphorus, at least 70-75% less phosphorus, at least 80-85% less phosphorus, at least 85-90% less phosphorus, at least 90-95% less phosphorus, or less, when compared with crop plants grown under normal conditions during an average growing season.

In another embodiment, the endophyte-associated plant is harvested from a environment where soil contains higher total phosphorus than the optimum levels recommended in order to achieve average crop yields for a plant grown under average cultivation practices on normal agricultural land, for example 2-5% more phosphorus than average, for example, at least 5-10% more phosphorus, at least 10-15% more phosphorus, at least 15-20% more phosphorus, at least 20-25% more phosphorus, at least 25-30% more phosphorus, at least 30-35% more phosphorus, at least 35-40% more phosphorus, at least 40-45% more phosphorus, at least 45-50% more phosphorus, at least 50-55% more phosphorus, at least 55-60% more phosphorus, at least 60-65% more phosphorus, at least 65-70% more phosphorus, at least 70-75% more phosphorus, at least 80-85% more phosphorus, at least 85-90% more phosphorus, at least 90-95% more phosphorus, at least 95-100% more phosphorus, or even greater than 100% more phosphorus, or even greater than 200% more phosphorus, or even greater than 300% more phosphorus, or even greater than 400% more phosphorus, or even greater than 500% more phosphorus, when compared with crop plants grown under normal conditions during an average growing season.

In another embodiment, the endophyte-associated plant is harvested from a environment where soil contains lower total potassium than the optimum levels recommended in order to achieve average crop yields for a plant grown under average cultivation practices on normal agricultural land, for example 2-5% less potassium than average, for example, at least 5-10% less potassium, at least 10-15% less potassium, at least 15-20% less potassium, at least 20-25% less potassium, at least 25-30% less potassium, at least 30-35% less potassium, at least 35-40% less potassium, at least 40-45% less potassium, at least 45-50% less potassium, at least 50-55% less potassium, at least 55-60% less potassium, at least 60-65% less potassium, at least 65-70% less potassium, at least 70-75% less potassium, at least 80-85% less potassium, at least 85-90% less potassium, at least 90-95% less potassium, or less, when compared with crop plants grown under normal conditions during an average growing season.

In another embodiment, the endophyte-associated plant is harvested from a environment where soil contains higher total potassium than the optimum levels recommended in order to achieve average crop yields for a plant grown under average cultivation practices on normal agricultural land, for example 2-5% more potassium than average, for example, at least 5-10% more potassium, at least 10-15% more potassium, at least 15-20% more potassium, at least 20-25% more potassium, at least 25-30% more potassium, at least 30-35% more potassium, at least 35-40% more potassium, at least 40-45% more potassium, at least 45-50% more potassium, at least 50-55% more potassium, at least 55-60% more potassium, at least 60-65% more potassium, at least 65-70% more potassium, at least 70-75% more potassium, at least 80-85% more potassium, at least 85-90% more potassium, at least 90-95% more potassium, at least 95-100% more potassium, or even greater than 100% more potassium, or even greater than 200% more potassium, or even greater than 300% more potassium, or even greater than 400% more potassium, or even greater than 500% more potassium, when compared with crop plants grown under normal conditions during an average growing season.

In another embodiment, the endophyte-associated plant is harvested from a environment where soil contains lower total sulfur than the optimum levels recommended in order to achieve average crop yields for a plant grown under average cultivation practices on normal agricultural land, for example 2-5% less sulfur than average, for example, at least 5-10% less sulfur, at least 10-15% less sulfur, at least 15-20% less sulfur, at least 20-25% less sulfur, at least 25-30% less sulfur, at least 30-35% less sulfur, at least 35-40% less sulfur, at least 40-45% less sulfur, at least 45-50% less sulfur, at least 50-55% less sulfur, at least 55-60% less sulfur, at least 60-65% less sulfur, at least 65-70% less sulfur, at least 70-75% less sulfur, at least 80-85% less sulfur, at least 85-90% less sulfur, at least 90-95% less sulfur, or less, when compared with crop plants grown under normal conditions during an average growing season.

In another embodiment, the endophyte-associated plant is harvested from a environment where soil contains higher total sulfur than the optimum levels recommended in order to achieve average crop yields for a plant grown under average cultivation practices on normal agricultural land, for example 2-5% more sulfur than average, for example, at least 5-10% more sulfur, at least 10-15% more sulfur, at least 15-20% more sulfur, at least 20-25% more sulfur, at least 25-30% more sulfur, at least 30-35% more sulfur, at least 35-40% more sulfur, at least 40-45% more sulfur, at least 45-50% more sulfur, at least 50-55% more sulfur, at least 55-60% more sulfur, at least 60-65% more sulfur, at least 65-70% more sulfur, at least 70-75% more sulfur, at least 80-85% more sulfur, at least 85-90% more sulfur, at least 90-95% more sulfur, at least 95-100% more sulfur, or even greater than 100% more sulfur, or even greater than 200% more sulfur, or even greater than 300% more sulfur, or even greater than 400% more sulfur, or even greater than 500% more sulfur, when compared with crop plants grown under normal conditions during an average growing season.

In another embodiment, the endophyte-associated plant is harvested from a environment where soil contains lower total calcium than the optimum levels recommended in order to achieve average crop yields for a plant grown under average cultivation practices on normal agricultural land, for example 2-5% less calcium than average, for example, at least 5-10% less calcium, at least 10-15% less calcium, at least 15-20% less calcium, at least 20-25% less calcium, at least 25-30% less calcium, at least 30-35% less calcium, at least 35-40% less calcium, at least 40-45% less calcium, at least 45-50% less calcium, at least 50-55% less calcium, at least 55-60% less calcium, at least 60-65% less calcium, at least 65-70% less calcium, at least 7.0-75% less calcium, at least 80-85% less calcium, at least 85-90% less calcium, at least 90-95% less calcium, or less, when compared with crop plants grown under normal conditions during an average growing season.

In another embodiment, the endophyte-associated plant is harvested from a environment where soil contains lower total magnesium than the optimum levels recommended in order to achieve average crop yields for a plant grown under average cultivation practices on normal agricultural land, for example 2-5% less magnesium than average, for example, at least 5-10% less magnesium, at least 10-15% less magnesium, at least 15-20% less magnesium, at least 20-25% less magnesium, at least 25-30% less magnesium, at least 30-35% less magnesium, at least 35-40% less magnesium, at least 40-45% less magnesium, at least 45-50% less magnesium, at least 50-55% less magnesium, at least 55-60% less magnesium, at least 60-65% less magnesium, at least 65-70% less magnesium, at least 70-75% less magnesium, at least 80-85% less magnesium, at least 85-90% less magnesium, at least 90-95% less magnesium, or less, when compared with crop plants grown under normal conditions during an average growing season.

In another embodiment, the endophyte-associated plant is harvested from a environment where soil contains higher total sodium chloride (salt) than the optimum levels recommended in order to achieve average crop yields for a plant grown under average cultivation practices on normal agricultural land, for example 2-5% more salt than average, for example, at least 5-10% more salt, at least 10-15% more salt, at least 15-20% more salt, at least 20-25% more salt, at least 25-30% more salt, at least 30-35% more salt, at least 35-40% more salt, at least 40-45% more salt, at least 45-50% more salt, at least 50-55% more salt, at least 55-60% more salt, at least 60-65% more salt, at least 65-70% more salt, at least 70-75% more salt, at least 80-85% more salt, at least 85-90% more salt, at least 90-95% more salt, at least 95-100% more salt, or even greater than 100% more salt, or even greater than 200% more salt, or even greater than 300% more salt, or even greater than 400% more salt, or even greater than 500% more salt, when compared with crop plants grown under normal conditions during an average growing season.

Relocalization of Endophytes

In some embodiments, a single endophyte strain or a plurality of endophytes that are used to treat a plant element are capable of localizing to a different tissue of the plant, regardless of the original source of the endophyte. For example, the endophyte can be capable of localizing to any one of the tissues in the plant, including: the root, adventitious root, seminal root, root hair, shoot, leaf, flower, bud, tassel, meristem, pollen, pistil, ovaries, stamen, fruit, stolon, rhizome, nodule, tuber, trichome, guard cells, hydathode, petal, sepal, glume, rachis, vascular cambium, phloem, and xylem. In one embodiment, the endophyte is capable of localizing to the root and/or the root hair of the plant. In another embodiment, the endophyte is capable of localizing to the photosynthetic tissues, for example, leaves and shoots of the plant. In other cases, the endophyte is localized to the vascular tissues of the plant, for example, in the xylem and phloem. In still another embodiment, the endophyte is capable of localizing to the reproductive tissues (flower, pollen, pistil, ovaries, stamen, fruit) of the plant. In another embodiment, the endophyte is capable of localizing to the root, shoots, leaves and reproductive tissues of the plant. In still another embodiment, the endophyte colonizes a fruit or seed tissue of the plant. In still another embodiment, the endophyte is able to colonize the plant such that it is present in the surface of the plant (i.e., its presence is detectably present on the plant exterior, or the episphere of the plant). In still other embodiments, the endophyte is capable of localizing to substantially all, or all, tissues of the plant. In certain embodiments, the endophyte is not localized to the root of a plant. In other cases, the endophyte is not localized to the photosynthetic tissues of the plant.

Endophytes Capable of Altering the Metabolome, Epigenome, or Transcriptome of Plants The endophytes useful for the invention can also be classified according to the changes conferred upon the plant. For example, the endophyte can alter the hormone status or levels of hormone production in the plant, which in turn can affect many physiological parameters, including flowering time, water efficiency, apical dominance and/or lateral shoot branching, increase in root hair, and alteration in fruit ripening. The endophyte may also introduce other changes to the plant, including biochemical, metabolomic, proteomic, genomic, epigenomic and/or transcriptomic profiles of endophyte-associated plants can be compared with reference agricultural plants under the same conditions.

Metabolomic differences between the plants can be detected using methods known in the art. For example, a biological sample (whole tissue, exudate, phloem sap, xylem sap, root exudate, etc.) from the endophyte-associated and reference agricultural plants can be analyzed essentially as described in Fiehn et al., (2000) Nature Biotechnol., 18, 1157-1161, or Roessner et al., (2001) Plant Cell, 13, 11-29. Such metabolomic methods can be used to detect differences in levels in hormone, nutrients, secondary metabolites, root exudates, phloem sap content, xylem sap content, heavy metal content, and the like. Such methods are also useful for detecting alterations in microbial content and status; for example, the presence and levels of bacterial/fungal signaling molecules (e.g., autoinducers and pheromones), which can indicate the status of group-based behavior of endophytes based on, for example, population of endophyte-associated and reference agricultural plants can also be performed to detect changes in expression of at least one transcript, or a set or network of genes upon endophyte association. Similarly, epigenetic changes can be detected using methylated DNA immunoprecipitation followed by high-throughput sequencing.

Combinations of Endophytes

Combinations of endophytes can be selected by any one or more of several criteria. In one embodiment, compatible endophytes are selected. As used herein, "compatibility" refers to endophyte populations that do not significantly interfere with the growth, propagation, and/or production of beneficial substances of the other. Incompatible endophyte populations can arise, for example, where one of the populations produces or secrets a compound that is toxic or deleterious to the growth of the other population(s). Incompatibility arising from production of deleterious compounds/agents can be detected using methods known in the art, and as described herein elsewhere. Similarly, the distinct populations can compete for limited resources in a way that makes co-existence difficult.

In another embodiment, combinations are selected on the basis of compounds produced by each population of endophytes. For example, the first population is capable of producing siderophores, and another population is capable of producing anti-fungal compounds. In an embodiment, the first population of endophytes or endophytic components is capable of a function selected from the group consisting of auxin production, nitrogen fixation, and production of an antimicrobial compound, siderophore production, mineral phosphate solubilization, cellulase production, chitinase production, xylanase production, and acetoin production, carbon source utilization, and combinations thereof. In another embodiment, the second population of endophytes or endophytic component is capable of a function selected from the group consisting of auxin production, nitrogen fixation, production of an antimicrobial compound, siderophore production, mineral phosphate solubilization, cellulase production, chitinase production, xylanase production, and acetoin production, and combinations thereof. In still another embodiment, the first and second populations are capable of at least one different function.

In still another embodiment, the combinations of endophytes are selected for their distinct localization in the plant after colonization. For example, the first population of endophytes or endophytic components can colonize, and in some cases preferentially colonize, the root tissue, while a second population can be selected on the basis of its preferential colonization of the aerial parts of the agricultural plant. Therefore, in an embodiment, the first population is capable of colonizing one or more of the tissues selected from the group consisting of a root, shoot, leaf, flower, and seed. In another embodiment, the second population is capable of colonizing one or more tissues selected from the group consisting of root, shoot, leaf, flower, and seed. In still another embodiment, the first and second populations are capable of colonizing a different tissue within the agricultural plant.

In some embodiments, combinations of endophytes are selected for their ability to confer a benefit to the host plant at different points in the life cycle of said host plant. In one example, one endophyte can be selected to impart improved seedling vigor, and a second endophyte can be selected to improve soil nutrient acquisition by roots of the mature plant.

In still another embodiment, combinations of endophytes are selected for their ability to confer one or more distinct fitness traits on the inoculated agricultural plant, either individually or in synergistic association with other endophytes. In another embodiment, one endophyte may induce the colonization of a second endophyte. Alternatively, two or more endophytes may induce the colonization of a third endophyte. For example, the first population of endophytes or endophytic components is selected on the basis that it confers significant increase in biomass, while the second population promotes increased drought tolerance on the inoculated agricultural plant. Therefore, in one embodiment, the first population is capable of conferring at least one trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, enhanced soil water retention, or a combination thereof. In another embodiment, the second population is capable of conferring a trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, and enhanced soil water retention. In still another embodiment, each of the first and second population is capable of conferring a different trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, and enhanced soil water retention.

The combinations of endophytes can also be selected based on combinations of the above criteria. For example, the first population of endophytes can be selected on the basis of the compound it produces (e.g., its ability to fix nitrogen, thus providing a potential nitrogen source to the plant), while the second population can be selected on the basis of its ability to confer increased resistance of the plant to a pathogen (e.g., a fungal pathogen).

In some embodiments of the present invention, it is contemplated that combinations of endophytes can provide an increased benefit to the host plant, as compared to that conferred by a single endophyte, by virtue of additive effects. For example, one endophyte strain that induces a benefit in the host plant may induce such benefit equally well in a plant that is also colonized with a different endophyte strain that also induces the same benefit in the host plant. The host plant thus exhibits the same total benefit from the combination of different endophyte strains as the additive benefit to individual plants colonized with each individual endophyte of the combination. In one example, a plant is colonized with two different endophyte strains: one provides a 1× increase in biomass when associated with the plant, and the other provides a 2× increase in biomass when associated with a different plant. When both endophyte strains are associated with the same plant, that plant would experience a 3× (additive of 1×+2× single effects) increase in auxin biomass. Additive effects are a surprising embodiment of the present invention, as non-compatibility of endophytes may result in a cancellation of the beneficial effects of both endophytes.

In some embodiments of the present invention, it is contemplated that a combination of endophytes can provide an increased benefit to the host plant, as compared to that conferred by a single endophyte, by virtue of synergistic effects. For example, one endophyte strain that induces a benefit in the host plant may induce such benefit beyond additive effects in a plant that is also colonized with a different endophyte strain that also induces that benefit in the host plant. The host plant thus exhibits the greater total benefit from the combination of different endophyte strains than could be seen from the additive benefit of individual plants colonized with each individual endophyte of the combination. In one example, a plant is colonized with two different endophyte strains: one provides a 1× increase in biomass when associated with a plant, and the other provides a 2× increase in biomass when associated with a different plant. When both endophyte strains are associated with the same plant, that plant would experience a 5× (greater than an additive of 1×+2× single effects) increase in biomass. Synergistic effects are a surprising embodiment of the present invention.

Inoculation with Multiple Endophytes

In another embodiment, the present invention contemplates methods of coating a plant element, e.g., a seed of a plant, with a plurality of endophytes, as well as synthetic compositions comprising a plurality of endophytes on and/or in the plant element. The methods according to this embodiment can be performed in a manner similar to those described herein for single endophyte coating. In one example, multiple endophytes can be prepared in a single preparation that is coated onto the plant element, e.g., a seed. The endophytes can be from a common origin (i.e., a same plant). Alternatively, the endophytes can be from different plants.

Where multiple endophytes are coated onto a plant element, each endophyte can be a bacterium. In the alternative, each endophyte can be a fungus. In still another embodiment, a plurality of bacterial and fungal endophytes can be coated onto the surface of a plant element.

Where a plurality of endophytes are coated onto the plant element, any or all of the endophytes may be capable of conferring a beneficial trait onto the host plant. In some cases, all of the endophytes are capable of conferring a beneficial trait onto the host plant. The trait conferred by each of the endophytes may be the same (e.g., both improve the host plant's tolerance to a particular biotic stress), or may be distinct (e.g., one improves the host plant's tolerance to drought, while another improves phosphate utilization). In other cases the conferred trait may be the result of interactions between the endophytes.

In one embodiment, an agricultural plant is contacted with a formulation comprising at least two endophytic microbial entities. Specific examples of pairs of endophytic microbial entities that can be applied to an agricultural plant include, for example, a pair of endophytic microbes containing nucleic acid sequences that are each at least 97% identical to the nucleic acid sequence selected from the groups provided in Table 1, Table 2, Table 7 and Table 8.

Isolation of Endophytes

According to the present invention, endophytes are isolated from a plant element, e.g., a seed of a plant. Because endophytes are capable of living and/or residing within the plant, or portion of the plant (including the seed), the endophytic nature of a microbe can distinguished from surface associated microbes by its resistance to surface sterilization techniques. Therefore, in one embodiment, endophytes are isolated from plant elements after the surface of the plant element is sterilized by contacting with non-specific antimicrobial agents such as sodium hypochlorite, hydrogen peroxide, copper oxychloride, copper hydroxide, copper sulfate, chlorothalonil, cuprous oxide, streptomycin, copper ammonium carbonate, copper diammonia diacetate complex, copper octanoate, oxytetracycline, fosetyl-AL or chloropicrin, in an aqueous solution and also optionally including detergents such as SDS, triton X-100, tween 20, can be used. In addition, dried seeds can be soaked in organic solvents such as ethanol, for example 50%-90% ethanol. Antibacterial or antifungal agents (e.g., captan, maneb, thiram, fludioxonil, etc.), particularly those that do not penetrate into the plant element, can also be used. In general, plant elements are soaked in an aqueous solution or commercial formulation containing one or more of these compounds for 30 seconds to 12 hours in a plastic container. After surface sterilization, the plant element is removed from the antibacterial formulation and washed 3-5 times with sterile distilled water. In an alternative embodiment where the plant element is a seed, the seed coat can be removed under sterile conditions, and the microbes inside the seed isolated and characterized.

Once surface-residing microbes are removed, the surviving microbes present in the plant element are generally considered endophytes. Such endophytes can be a bacterium or fungus, and can be isolated by homogenizing the surface sterilized seeds, and placing the homogenate under conditions allowing growth of the microbe. Therefore, the loss of microbe viability upon surface sterilization indicates that the microbes are almost exclusively located on the seed surface. In contrast, resistance of the microbe population to such plant element sterilization methods indicates an internal localization of the microbes. Alternatively, the presence of microbial DNA after surface sterilization with agents that cross-link or otherwise destroy DNA can be detected using sensitive detection methods such as PCR to establish the presence of the microbe within the plant element.

Growth of Endophytes

Viability of the microbe can be tested after plant element surface sterilization, or after removal of the seed coat, by homogenizing the plant element and placing the homogenate under conditions that promote growth of the microbe. In the alternative, the presence of microbes can be detected visually or microscopically if the microbes can form a colony that is visible by such inspection. Reagents are also available for the detection of microbes: the stain aniline blue can be used for detecting hyphae, other assays are known in the art.

Endophytes may require special conditions to allow for growth in isolation. A number of different growth media can be used to grow the endophytes. Additional details of endophyte growth are described within the examples sections.

Functional Attributes of Endophytes

In some cases, a single endophyte strain, a plurality of endophytes, or each individual type of endophytes of that plurality, may produce one or more compounds and/or have one or more activities, e.g., one or more of the following: production of a metabolite, production of a phytohormone such as auxin, production of acetoin, production of an antimicrobial compound, production of a siderophore, production of a cellulase, production of a pectinase, production of a chitinase, production of a xylanase, nitrogen fixation, or mineral phosphate solubilization. For example, an endophyte can produce a phytohormone selected from the group consisting of an auxin, a cytokinin, a gibberellin, ethylene, a brassinosteroid, and abscisic acid. In some embodiments, the endophyte produces auxin (e.g., indole-3-acetic acid (IAA)). Production of auxin can be assayed as described herein. Many of the microbes described herein are capable of producing the plant hormone auxin indole-3-acetic acid (IAA) when grown in culture. Auxin plays a key role in altering the physiology of the plant, including the extent of root growth. Therefore, in other embodiments, endophytes are disposed on the surface or within a tissue of the plant element in an amount effective to detectably increase production of auxin in the agricultural plant when compared with a reference agricultural plant. In some embodiments, the increased auxin production can be detected in a tissue type selected from the group consisting of the root, shoot, leaves, and flowers.

In some embodiments, a single endophyte strain, a plurality of endophytes, or each individual type of endophytes of that plurality, can produce a compound with antimicrobial properties. For example, the compound can have antibacterial properties, as determined by the growth assays provided herein. In some embodiments, the compound with antibacterial properties shows bacteriostatic or bactericidal activity against *E. coli* and/or *Bacillus* sp. In other embodiments, the endophyte produces a compound with antifungal properties, for example, fungicidal or fungistatic activity against *S. cerevisiae* and/or *Rhizoctonia*.

In some embodiments, a single endophyte strain, a plurality of endophytes, or each individual type of endophytes of that plurality, is capable of nitrogen fixation, and is thus capable of producing ammonium from atmospheric nitrogen. The ability of endophytes to fix nitrogen can be confirmed by testing for growth of the fungus in nitrogen-free growth media, for example, LGI media, as described herein.

In some embodiments, a single endophyte strain, a plurality of endophytes, or each individual type of endophytes of that plurality, can produce a compound that increases the solubility of mineral phosphate in the medium, i.e., mineral phosphate solubilization, for example, using growth assays known in the art. In some embodiments, the endophytes produce a compound that allows the bacterium to grow in growth media comprising $Ca_3HPO_4$ as the sole phosphate source.

In some embodiments, a single endophyte strain, a plurality of endophytes, or each individual type of endophytes of that plurality, can produce a siderophore. Siderophores are small high-affinity iron chelating agents secreted by microorganisms that increase the bioavailability of iron. Siderophore production by the endophytes can be detected, for example, using methods known in the art.

In some embodiments, a single endophyte strain, a plurality of endophytes, or each individual type of endophytes of that plurality, can produce a hydrolytic enzyme. For example, in some embodiments, an endophytes can produce a hydrolytic enzyme selected from the group consisting of a cellulase, a pectinase, a chitinase and a xylanase. Hydrolytic enzymes can be detected using the methods known in the art.

Selection of Endophytes Conferring Beneficial Traits

The present invention contemplates inoculation of plants with microbes. As described earlier, the microbes can be derived from many different plants species, from different parts of the plants, and from plants isolated across different environments. Once a microbe is isolated, it can be tested for its ability to confer a beneficial trait. Numerous tests can be performed both in vitro and in vivo to assess what benefits, if any, are conferred upon the plant. In one embodiment, a microbe is tested in vitro for an activity selected from the group consisting of: liberation of complexed phosphates, liberation of complexed iron (e.g., through secretion of siderophores), production of phytohormones, production of antibacterial compounds, production of antifungal compounds, production of insecticidal compounds, production of nematicidal compounds, production and/or secretion of ACC deaminase, production and/or secretion of acetoin, production and/or secretion of pectinase, production and/or secretion of cellulase, and production and/or secretion of RNAse. Exemplary in vitro methods for the above can be found in the Examples sections below.

It is noted that the initial test for the activities listed above can also be performed using a mixture of microbes, for example, a community of microbes isolated from a single plant. A positive activity readout using such mixture can be followed with the isolation of individual microbes within that population and repeating the in vitro tests for the activities to isolate the microbe responsible for the particular activity. Once validated using a single microbe isolate, then the plant can be inoculated with a microbe, and the test performed in vivo, either in growth chamber or greenhouse conditions, and comparing with a control plant that was not inoculated with the microbe.

Endophyte Preparations

Also described herein is a preparation comprising one or more isolated modified endophytes described above. The preparation further comprises an agriculturally acceptable carrier, and the preparation comprises an amount of endophytes sufficient to improve an agronomic trait of the population of seeds. In one embodiment, the isolated endophyte is cultured, for example, on semi-synthetic or synthetic growth medium. In one embodiment, the endophyte is provided as a powder, for example, a lyophilized powder. In another embodiment, the endophyte is applied in suspension at a suitable concentration. The preparation of microbes can be an aqueous solution, an oil-in-water emulsion or water-in-oil emulsion containing a minimum concentration of a microbe. Microbes are present as live cells, viable cells, spores, or mycelia. Typically, the concentration is at least $10^4$ CFU/ml or spores/ml, for example at least $3\times10^4$ CFU/mL or spores/ml, at least $10^5$ CFU/mL or spores/ml, at least $3\times10^5$ CFU/mL or spores/ml, at least $10^6$ CFU/mL or spores/ml, at least $3\times10^6$ CFU/mL or spores/ml, at least $10^7$ CFU/ml or spores/ml, at least $3\times10^7$ CFU/mL or spores/ml, at least $10^8$ CFU/mL or spores/ml, $10^9$ CFU/mL or spores/ml, or more. In one embodiment, the preparation is a solution containing a microbe at a concentration between about $10^5$ CFU/mL or spores/ml and about $10^9$ CFU/mL or spores/ml. In another embodiment, the preparation contains a microbe at a concentration between about $10^6$ CFU/mL or spores/ml and about $10^8$ CFU/mL or spores/ml.

The synthetic preparation can also contain any number of other components. In one embodiment, the synthetic preparation may contain growth media or constituents required for the growth and propagation of the microbe. In one embodiment, the growth medium is selected from the group provided in the table below.

TABLE 100

Exemplary growth medium

| Microbe Type | Media | Organisms |
|---|---|---|
| Bacteria | Nutrient Peptone Agar | Heterotrophic bacteria |
| | MacConkey Agar + myo-inositol + Carbenicillin | *Klebsiella* Sp. |
| | J agar | *Bacillus* sp. and other firmicutes |
| | N-poor Medium (LGT) | Aerobic heterotrophic N2-fixing bacteria |
| | Yeast Mannitol Agar | *Rhizobium* sp. |
| | King's B medium | *Pseudomonas* sp. |
| | SC medium | Fastidious bacteria |
| | R2A agar | Oligotrophic bacteria |
| | Tryptic Soy Agar | Heterotrophic bacteria |
| Fungi | Cornmeal agar | Fungi |
| | Glucose-Yeast extract agar + tetracycline | Selective enumeration of yeasts and molds. |
| | Potato-Dextrose agar (PDA) | Yeasts and molds |
| | Potato-Dextrose broth (PDB) | Yeast and molds |
| | Sabouraud Agar | Yeasts, molds and aciduric microorganisms |
| | V8 Agar | Fungi |
| | Malt Dextrose Agar | Identification of yeasts and moulds |
| | Czapek's medium | Fungi and Mold |
| | SPT agar | *Verticillium* sp. |

The synthetic preparation can be of a defined pH range. In one embodiment, the pH of the preparation can be between pH 5.5-6.0, pH 5.75-6.25, pH 6.0-6.5, pH 6.25-6.75, pH 6.5-7.0, pH 6.75-7.25, and pH 7.0-7.5. The pH of the medium can be adjusted using any biologically compatible buffering agent.

The synthetic preparation can also comprise a carrier, such as diatomaceous earth, clay, or chitin, which act to complex with chemical agents, such as control agents.

The synthetic preparation can also comprise an adherent. Such agents are useful for combining the microbes of the invention with carriers that can contain other compounds (e.g., control agents that are not biologic), to yield a coating composition. Such compositions help create coatings around the plant or seed to maintain contact between the microbe and other agents with the plant or plant part. In one embodiment, adherents are selected from the group consisting of: alginate, gums, starches, lecithins, formononetin, polyvinyl alcohol, alkali formononetinate, hesperetin, polyvinyl acetate, cephalins, Gum Arabic, Xanthan Gum, Mineral Oil, Polyethylene Glycol (PEG), Polyvinyl pyrrolidone (PVP), Arabino-galactan, Methyl Cellulose, PEG 400, Chitosan, Polyacrylamide, Polyacrylate, Polyacrylonitrile, Glycerol, Triethylene glycol, Vinyl Acetate, Gellan Gum, Polystyrene, Polyvinyl, Carboxymethyl cellulose, Gum Ghatti, and polyoxyethylene-polyoxybutylene block copolymers. Other examples of adherent compositions that can be used in the synthetic preparation include those described in EP 0818135, CA 1229497, WO 2013090628, EP 0192342, WO 2008103422 and CA 1041788, each of which is incorporated by reference in its entirety.

The synthetic preparation can also contain one or more reagents that promote internalization of the microbe into the plant, and can include any one of the following classes of compounds: a surfactant, an abrasive, an osmoticum, and a plant signaling molecule.

The preparation can also contain a surfactant. Non-limiting examples of surfactants include nitrogen-surfactant blends such as Prefer 28 (Cenex), Surf-N (US), Inhance (Brandt), P-28 (Wilfarm) and Patrol (Helena); esterified seed oils include Sun-It II (AmCy), MSO (UAP), Scoil (Agsco), Hasten (Wilfarm) and Mes-100 (Drexel); and organo-silicone surfactants include Silwet L77 (UAP), Silikin (Terra), Dyne-Amic (Helena), Kinetic (Helena), Sylgard 309 (Wilbur-Ellis) and Century (Precision). In one embodiment, the surfactant is present at a concentration of between 0.01% v/v to 10% v/v. In another embodiment, the surfactant is present at a concentration of between 0.1% v/v to 1% v/v.

The synthetic preparation of a defined osmolality can also be used. In one embodiment, the synthetic preparation has an osmolality of less than about 100 mOsm, for example less than about 75 mOsm, less than about 50 mOsm, or less than about 25 mOsm. In another embodiment, the synthetic preparation has an osmolality of at least 250 mOsm, for example at least 300 mOsm, at least 400 mOsm, at least 500 mOsm, at least 600 mOsm, at least 700 mOsm, at least 800 mOsm, 900 mOsm or greater. The osmolality of the preparation can be adjusted by addition of an osmoticum: the osmoticum can be any commonly used osmoticum, and can selected from the group consisting of: mannitol, sorbitol, NaCl, KCl, $CaCl_2$, $MgSO_4$, sucrose, or any combination thereof.

The endophyte can be obtained from growth in culture, for example, using semi-synthetic or synthetic growth medium. In addition, the microbe can be cultured on solid media, for example on petri dishes, scraped off and suspended into the preparation. Microbes at different growth phases can be used. For example, microbes at lag phase, early-log phase, mid-log phase, late-log phase, stationary phase, early death phase, or death phase can be used.

For certain microbes that exist as mycelia or mycelia-like structures, pre-treatment of the microbes with enzymes (including, but not limited to, driselase, gluculase, cellulase, beta-glucanase, lysozyme, zymolyase) can be used to generate protoplasts in order to provide a suspension of microbes. After generation of protoplasts, the microbes can be allowed to partially regenerate the cell walls by leaving the protoplasts in a growth medium or solution with relatively high osmolarity for a short time (typically less than about 12 hours at room temperature) to prevent bursting of protoplasts.

Detection and Quantitation of Endophytes and Other Microbes

The presence of the endophyte or other microbes can be detected and its localization in or on the host plant (including the seed) can be determined using a number of different methodologies. The presence of the microbe in the embryo or endosperm, as well as its localization with respect to the plant cells, can be determined using methods known in the art, including immunofluorescence microscopy using microbe specific antibodies, or fluorescence in situ hybridization. The presence and quantity of other microbes can be established by the FISH, immunofluorescence and PCR methods using probes that are specific for the microbe. Alternatively, degenerate probes recognizing conserved sequences from many bacteria and/or fungi can be employed to amplify a region, after which the identity of the microbes present in the tested tissue/cell can be determined by sequencing.

Therefore, in one embodiment, where the endophyte is coated onto the surface of a plant element of a first plant such that the endophyte is present at a higher level on the surface of the plant element than is present on the surface of an uncoated reference plant element, the level of the endophyte present on the surface of the uncoated reference plant element is determined by culturing microbes that are present on the surface of the plant element. In another embodiment, the level of the endophyte present on the surface of the uncoated reference plant element is determined by PCR.

Uniformity of Seeds and Plants

In another aspect, the seeds according to the present invention provide a substantially uniform population of seeds with a uniform endophyte composition. The uniform population of seeds can be of a predefined weight. For example, a substantially uniform population of seeds containing at least 100 g seeds, for example at least 1 kg seeds, at least 5 kg seeds, at least 10 kg seeds, can be provided by the method according to the present invention that contains—as a whole product—more than 1%, for example more than 5%, more than 10%, more than 20%, more than 30%, more than 40%, especially more than 50%, of the endophytic microorganism, i.e., the strain that is coated onto the surface of the seeds. According to a preferred embodiment, the present invention provides a marketable seed product containing at least 100 g seeds, for example, at least 1 kg seeds, for example at least 5 kg seeds, at least 10 kg seeds, wherein—as a whole product—more than 50%, for example, more than 60%, more than 70%, more than 80%, more than 90%, more than 95%, more than 99%, or 100% of the seeds contain the microbe, i.e., the inoculant strain. Each of the seeds can also contain a uniform number of microbes (for example, viable endophytes): for example, at least 50% of the seeds, for example at least 60%, at least 70%, at least 80%, at least 90%, at least 95%, at least 99%, or more of the seeds in the population can contain at least 100 CFU or spores, at least 300 CFU or spores, at least 1,000 CFU or spores, at least 3,000 CFU or spores, at least 10,000 CFU or spores, at least 30,000 CFU or spores or more, of the endophytic microorganism. In some embodiments, at least 50% of the seeds, for example at least 60%, at least 70%, at least 80%, at least 90%, at least 95%, at least 99%, or more of the seeds in the population contains a single endophyte or a plurality of endophytes at a concentration between about 100 CFU or spores and about 30,000 CFU or spores, between about 100 CFU or spores and about 300 CFU or spores, between about 100 CFU or spores and about 1,000 CFU or spores, between about 100 CFU or spores and about 3,000 CFU or spores, between about 100 CFU or spores and about 10,00 CFU or spores, between about 100 CFU or spores and about 30,000 CFU or spores, between about 300 CFU or spores and about 1,000 CFU or spores, between about 300 CFU or spores and about 3,000 CFU or spores, between about 300 CFU or spores and about 10,00 CFU or spores, between about 300 CFU or spores and about 30,000 CFU or spores, between about 1,000 CFU or spores and about 3,000 CFU or spores, between about 1,000 CFU or spores and about 10,00 CFU or spores, between about 1,000 CFU or spores and about 30,00 CFU or spores, between about 3,000 CFU or spores and about 10,000 CFU or spores, between about 3,000 CFU or spores and about 30,00 CFU or spores, or between about 10,000 CFU or spores and about 30,000 CFU or spores. The endophyte can also be quantitated using other means, for example, using quantitative PCR, to detect the total number of endophyte present on each seed.

The uniformity of the microbes within the seed population can be measured in several different ways. In one embodiment, a substantial portion of the population of seeds, for example at least 10%, at least 20%, at least 30%, at least 40%, at least 50%, at least 60%, at least 70%, at least 75%, at least 80%, at least 90%, at least 95% or more of the seeds in a population, contains a viable endophyte on its surface. In another embodiment, a substantial portion of the population of seeds, for example at least 10%, at least 20%, at least 30%, at least 40%, at least 50%, at least 60%, at least 70%, at least 75%, at least 80%, at least 90%, at least 95% or more of the seeds in a population contain on its surface a threshold number of viable microbe that is at least 1 CFU or spore per seed, at least 10 CFU or spores per seed, for example, at least 100 CFU or spores, at least 300 CFU or spores, at least 1,000 CFU or spores, at least 3,000 CFU or spores, or more, of the microbe per seed. In some embodiments, a substantial portion of the population of seeds, for example at least 10%, at least 20%, at least 30%, at least 40%, at least 50%, at least 60%, at least 70%, at least 75%, at least 80%, at least 90%, at least 95% or more of the seeds in a population contain on its surface a threshold number of viable microbe that is between 1 CFU or spore per seed and about 3,000 CFU or spores per seed, between 1 CFU or spore per seed and about 10 CFU or spores per seed, between 1 CFU or spore per seed and about 100 CFU or spores per seed, between 1 CFU or spore per seed and about 300 CFU or spores per seed, between 1 CFU or spore per seed and about 1,000 CFU or spores per seed, between 1 CFU or spore per seed and about 3,000 CFU or spores per seed, between about 10 CFU or spore per seed and about 100 CFU or spores per seed, between about 10 CFU or spore per seed and about 300 CFU or spores per seed, between about 10 CFU or spore per seed and about 1,000 CFU or spores per seed, between about 10 CFU or spore per seed and about 3,000 CFU or spores per seed, between about 100 CFU or spore per seed and about 300 CFU or spores per seed, between about 100 CFU or spore per seed and about 1,000 CFU or spores per seed, between about 100 CFU or spore per seed and about 3,000 CFU or spores per seed, between about 300 CFU or spore per seed and about 1,000 CFU or spores per seed, between about 300 CFU or spore per seed and about 3,000 CFU or spores per seed, or between about 1,000 CFU or spore per seed and about 3,000 CFU or spores per seed.

In still another aspect, the present invention discloses a substantially uniform population of plants produced by growing the population of seeds described above. In one embodiment, at least 75%, at least 80%, at least 90%, at least 95% or more of the plants comprise in one or more tissues an effective amount of the endophyte or endophytes. In another embodiment, at least 1%, between 1% and 10%, for example, at least 10%, between 10% and 20%, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the plants comprise a microbe population that is substantially similar.

In some cases, a substantial portion of the population of plants or seeds, for example, at least 1%, between 1% and 10%, for example, at least 10%, between 10% and 20%, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the seeds in a population, is coated with an endophyte that is able to perform one of the following functions, including: to stimulate plant growth, grow on nitrogen-free media, solubilize phosphate, sequester iron, secrete RNAse, antagonize pathogens, catabolize the precursor of ethylene, produce auxin and acetoin/butanediol. In some cases, a substantial portion of the population of seeds, for example, at least 1%, between 1% and 10%, for example, at least 10%, between 10% and 20%, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the seeds in a population, exhibits at least one of the endophyte community attributes listed in herein (e.g., total CFUs, presence of a taxa, absence of a taxa, spatial distribution, intercellular colonization, functional properties of endophytes; presence of monoclonal strain, presence of conserved subset of microbial plasmid repertoire, microbe isolated from habitat that is distinct from the location of seed production, etc.).

Increased uniformity of microbes in plants or seeds can also be detected by measuring the presence of non-genomic nucleic acids present in the microbes. For examples, where the microbe that is inoculated into the plant is known to harbor a plasmid or episome, the presence of the plasmid or episome can be detected in individual plants or seeds by using conventional methods of nucleic acid detection. Therefore, in one embodiment, a substantial portion of the population of seeds, for example at least example at least 1%, between 1% and 10%, for example, at least 10%, between 10% and 20%, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the seeds in a population, has a detectable presence of the microbial plasmid or episome.

Increased uniformity of the microbes' epigenetic status can also be used to detect increased uniformity of a population of seeds or plants derived from such seeds. For example, where a microbe that has been inoculated by a plant is also present in the plant (for example, in a different tissue or portion of the plant), or where the introduced microbe is sufficiently similar to a microbe that is present in some of the plants (or portion of the plant, including seeds), it is still possible to distinguish between the inoculated microbe and the native microbe, for example, by distinguishing between the two microbe types on the basis of their epigenetic status. Therefore, in one embodiment, the epigenetic status is detected in microbes across individual seeds or the plants that grow from such seeds.

It is also known that certain viruses are associated with endophytic fungi (such as the Curvularia thermal tolerance virus (CThTV) described in Márquez, L. M., et al., (2007). Science 315: 513-515). Therefore, the presence and quantity of a virus can be used to measure uniformity of seeds or plants containing the endophyte. For example, where the inoculated microbe is known to be associated with a virus, the presence of that virus can be used as a surrogate indicator of uniformity. Therefore, in one embodiment, a substantial portion of the seeds, for example at least 1%, between 1% and 10%, for example, at least 10%, between 10% and 20%, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the seeds, contain the virus. In other embodiments, where one or more of the endogenous microbes contain associated viruses which are not found in, and not compatible with the inoculated microbe, the loss (i.e., absence) of the virus can be used to measure uniformity of the seed population. As such, in another embodiment, a substantial portion of the seeds, for example at least 1%, between 1% and 10%, for example, at least 10%, between 10% and 20%, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the seeds, do not contain the virus. In other cases, the genetic sequence of the virus can be used to measure the genetic similarity of the virus within a population. In one embodiment, a substantial proportion of the seeds, for example, at least 10%, for example at least 20%, at least 30%, at least 40%, at least 50%, at least 60%, at least 70%, at least 80%, at least 90%, at least 95% or more of the seeds contain the same virus, for example, as determined by sequence analysis.

Such uniformity in microbial composition is unique and is extremely advantageous for high-tech and/or industrial agriculture. It allows significant standardization with respect to qualitative endophyte load of seed products. Suitable volumes or weights are those that are currently used for plant seeds (e.g., the at least 100 g, at least 1, 5 or 10 kg; but also 25 or more, 40 or more, 50 kg or more, even 100 kg or more, 500 kg or more, 1 ton or more, etc.). Suitable containers or packages are those traditionally used in plant seed commercialization: however, also other containers with more sophisticated storage capabilities (e.g., with microbiologically tight wrappings or with gas- or water-proof containments) can be used. The amount of endophytes (qualitatively and quantitatively) contained in the seeds or in the marketable seed product as a whole can be determined by standard techniques in microbiology readily available to any person skilled in the art of plant endophyte analysis.

In some cases, a sub-population of agricultural seeds can be further selected on the basis of increased uniformity, for example, on the basis of uniformity of microbial population. For example, individual seeds of pools collected from individual cobs, individual plants, individual plots (representing plants inoculated on the same day) or individual fields can be tested for uniformity of microbial density, and only those pools meeting specifications (e.g., at least 80% of tested seeds have minimum density, as determined by quantitative methods described elsewhere) are combined to provide the agricultural seed sub-population.

The methods described herein can also comprise a validating step. The validating step can entail, for example, growing some seeds collected from the inoculated plants into mature agricultural plants, and testing those individual plants for uniformity. Such validating step can be performed on individual seeds collected from cobs, individual plants, individual plots (representing plants inoculated on the same day) or individual fields, and tested as described above to identify pools meeting the required specifications.

Agricultural Field

In another aspect, described herein is an agricultural field, including a greenhouse, comprising the population of plants described above. In one embodiment, the agricultural field comprises at least 100 plants. In another embodiment, the population occupies at least about 100 square feet of space, wherein at least about 10%, 20%, 30%, 40%, 50%, 60%, 70%, 80%, 90% or more than 90% of the population comprises an effective amount of the microbe. In another embodiment, the population occupies at least about 100 square feet of space, wherein at least 1%, between 1% and 10%, for example, at least 10%, between 10% and 20%, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the population comprises the microbe in reproductive tissue. In still another embodiment, the population occupies at least about 100 square feet of space, wherein at least about 10%, 20%, 30%, 40%, 50%, 60%, 70%, 80%, 90% or more than 90% of the population comprises at least 10 CFUs or spores, 100 CFUs or spores, 1,000 CFUs or spores, 10,000 CFUs or spores or more of the microbe. In still another embodiment, the population occupies at least about 100 square feet of space, wherein at least 1%, between 1% and 10%, for example, at least 10%, between 10% and 20%, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the population comprises between about 10 CFU or spores and about 10,000 CFU or spores, between about 10 CFU or spores and about 100 CFU or spores, between about 10 CFU or spores and about 1,000 CFU or spores, between about 100 CFU or spores and about 1,000 CFU or spores, between about 100 CFU or spores and about 10,00 CFU or spores, or between about 1,000 CFU or spores and about 10,000 CFU or spores. In yet another embodiment, the population occupies at least about 100 square feet of space, wherein at least 1%, between 1% and 10%, for example, at least 10%, between 10% and 20%, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the population comprises a exogenous microbe (i.e., the endophyte) of monoclonal origin.

Plants can be grown individually from the seeds coated with the endophytes to propagate the desired microbes in indoor or outdoor settings. An advantage of the present invention is that it allows multiple plants harboring endophytes to be grown under agricultural methods as a means of providing improved uniformity of microbe-derived benefits to farmers.

Therefore, in another aspect, provided herein are indoor arrangements of populations (e.g., greenhouse) of plants generated from the methods of the present invention. Such arrangements can include at least a defined number of plants of the present invention, such as at least 1, at least 2, at least 3, between 3 and 5, at least 5, between 5 and 10, at least 10, between 10 and 15, at least 15, between 15 and 20, at least 20, between 20 and 30, at least 30, between 30 and 50, at least 50, between 50 and 100, at least 100, between 100 and 200, at least 200, between 200 and 500, at least 500, between 500 and 1000, at least 1000, between 1000 and 5000, at least 5000, between 5000 and 10000, at least 10000 or more plants.

Also provided herein are agricultural fields that contain population of plants generated from the seeds of the present invention. Agricultural fields can occupy as little as 100 square feet or less, or can occupy hundreds or thousands of acres. Area of field containing a population of microbe-associated plants can be measured in square feet, such as at least 100, 500, 1000, 5000, 10,000, 50,000 or greater than 50,000 square feet, or can be measured in acres, such as least 1, at least 2, at least 3, between 3 and 5, at least 5, between 5 and 10, at least 10, between 10 and 15, at least 15, between 15 and 20, at least 20, between 20 and 30, at least 30, between 30 and 50, at least 50, between 50 and 100, at least 100, between 100 and 200, at least 200, between 200 and 500, at least 500, between 500 and 1000, at least 1000, between 1000 and 5000, at least 5000, between 5000 and 10000, at least 10000, between 10000 and 50000, at least 50000 or greater acres. The field can also be measured in hectares, for example at least 1, at least 2, at least 3, between 3 and 5, at least 5, between 5 and 10, at least 10, between 10 and 15, at least 15, between 15 and 20, at least 20, between 20 and 30, at least 30, between 30 and 50, at least 50, between 50 and 100, at least 100, between 100 and 200, at least 200, between 200 and 500, at least 500, between 500 and 1000, at least 1000, between 1000 and 5000, at least 5000, between 5000 and 10000, at least 10000 or more hectares. Additionally, a field containing a population of microbe-associated plants can be characterized by the number of plants in the population, generally a field is at least two, such as at least 3, between 3 and 5, at least 5, between 5 and 10, at least 10, between 10 and 15, at least 15, between 15 and 20, at least 20, between 20 and 30, at least 30, between 30 and 50, at least 50, between 50 and 100, at least 100, between 100 and 200, at least 200, between 200 and 500, at least 500, between 500 and 1000, at least 1000, between 1000 and 5000, at least 5000, between 5000 and 10000, at least 10000, between 10000 and 25000, at least 250000, between 25000 and 50000, at least 500000, between 50000 and 75000, at least 750000, between 75000 and 100000, at least 1000000 or more plants. A field is generally a contiguous area but may be separated by geographical features such as roads, waterways, buildings, fences, and the like known to those skilled in the art. Because the microbe-associated plants described herein benefit from an increased level of uniformity of germination and other characteristics, it is desirable to maximize the percentage of plants containing microbes. For example, at least 10% (e.g., between 10% and 20%, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, between 95% and 99%, at least 99% or more) of the plants contain the microbes.

Endophytes Compatible with Agrichemicals

In certain embodiments, the endophyte is selected on the basis of its compatibility with commonly used agrichemicals. As mentioned earlier, plants, particularly agricultural plants, can be treated with a vast array of agrichemicals, including fungicides, biocides (anti-bacterial agents), herbicides, insecticides, nematicides, rodenticides, fertilizers, and other agents.

In some cases, it can be important for the endophyte to be compatible with agrichemicals, particularly those with fungicidal or antibacterial properties, in order to persist in the plant although, as mentioned earlier, there are many such fungicidal or antibacterial agents that do not penetrate the plant, at least at a concentration sufficient to interfere with the endophyte. Therefore, where a systemic fungicide or antibacterial agent is used in the plant, compatibility of the endophyte to be inoculated with such agents will be an important criterion.

In one embodiment, natural isolates of endophytes that are compatible with agrichemicals can be used to inoculate the plants according to the methods described herein. For example, fungal endophytes which are compatible with agriculturally employed fungicides can be isolated by plating a culture of the endophytes, on a petri dish containing an effective concentration of the fungicide, and isolating colonies of the endophyte that are compatible with the fungicide. In another embodiment, an endophyte that is compatible with a fungicide is used for the methods described herein. Fungicide compatible endophytes can also be isolated by selection on liquid medium. The culture of endophytes can be plated on petri dishes without any forms of mutagenesis; alternatively, the endophytes can be mutagenized using any means known in the art. For example, microbial cultures can be exposed to UV light, gamma-irradiation, or chemical mutagens such as ethylmethanesulfonate (EMS) prior to selection on fungicide containing media. Finally, where the mechanism of action of a particular fungicide is known, the target gene can be specifically mutated (either by gene deletion, gene replacement, site-directed mutagenesis, etc.) to generate an endophyte that is resilient against that particular fungicide. It is noted that the above-described methods can be used to isolate fungi that are compatible with both fungistatic and fungicidal compounds.

It will also be appreciated by one skilled in the art that a plant may be exposed to multiple types of fungicides or antibacterial compounds, either simultaneously or in succession, for example at different stages of plant growth. Where the target plant is likely to be exposed to multiple fungicidal and/or antibacterial agents, an endophyte that is compatible with many or all of these agrichemicals can be used to inoculate the plant. An endophyte that is compatible with several fungicidal agents can be isolated, for example, by serial selection. An endophyte that is compatible with the first fungicidal agent is isolated as described above (with or without prior mutagenesis). A culture of the resulting endophyte can then be selected for the ability to grow on liquid or solid media containing the second antifungal compound (again, with or without prior mutagenesis). Colonies isolated from the second selection are then tested to confirm its compatibility to both antifungal compounds.

Likewise, bacterial endophytes that are compatible to biocides (including herbicides such as glyphosate or antibacterial compounds, whether bacteriostatic or bactericidal) that are agriculturally employed can be isolated using methods similar to those described for isolating fungicide compatible endophytes. In one embodiment, mutagenesis of the microbial population can be performed prior to selection with an antibacterial agent. In another embodiment, selection is performed on the microbial population without prior mutagenesis. In still another embodiment, serial selection is performed on an endophyte: the endophyte is first selected for compatibility to a first antibacterial agent. The isolated compatible endophyte is then cultured and selected for compatibility to the second antibacterial agent. Any colony thus isolated is tested for compatibility to each, or both antibacterial agents to confirm compatibility with these two agents.

Resistance, or compatibility with an antimicrobial agent can be determined by a number of means known in the art, including the comparison of the minimal inhibitory concentration (MIC) of the unmodified and modified endophyte. Therefore, in one embodiment, the present invention discloses an isolated modified endophyte derived from an endophyte isolated from within a plant or tissue thereof, wherein the endophyte is modified such that it exhibits at least 3 fold greater, for example, at least 5 fold greater, at least 10 fold greater, at least 20 fold greater, at least 30 fold greater or more MIC to an antimicrobial agent when compared with the unmodified endophyte.

In one particular aspect, disclosed herein are bacterial endophytes with enhanced resistance to the herbicide glyphosate. In one embodiment, the bacterial endophyte has a doubling time in growth medium containing at least 1 mM glyphosate, for example, at least 2 mM glyphosate, at least 5 mM glyphosate, at least 10 mM glyphosate, at least 15 mM glyphosate or more, that is no more than 250%, for example, no more than 200%, no more than 175%, no more than 150%, or no more than 125%, of the doubling time of the endophyte in the same growth medium containing no glyphosate. In one particular embodiment, the bacterial endophyte has a doubling time in growth medium containing 5 mM glyphosate that is no more than 150% the doubling time of the endophyte in the same growth medium containing no glyphosate.

In another embodiment, the bacterial endophyte has a doubling time in a plant tissue containing at least 10 ppm glyphosate, for example, at least 15 ppm glyphosate, at least 20 ppm glyphosate, at least 30 ppm glyphosate, at least 40 ppm glyphosate or more, that is no more than 250%, for example, no more than 200%, no more than 175%, no more than 150%, or no more than 125%, of the doubling time of the endophyte in a reference plant tissue containing no glyphosate. In one particular embodiment, the bacterial endophyte has a doubling time in a plant tissue containing 40 ppm glyphosate that is no more than 150% the doubling time of the endophyte in a reference plant tissue containing no glyphosate.

The selection process described above can be repeated to identify isolates of the endophyte that are compatible with a multitude of antifungal or antibacterial agents.

Candidate isolates can be tested to ensure that the selection for agrichemical compatibility did not result in loss of a desired microbial bioactivity. Isolates of the endophyte that are compatible with commonly employed fungicides can be selected as described above. The resulting compatible endophyte can be compared with the parental endophyte on plants in its ability to promote germination.

The agrichemical compatible endophytes generated as described above can be detected in samples. For example, where a transgene was introduced to render the endophyte resistant to the agrichemical(s), the transgene can be used as a target gene for amplification and detection by PCR. In addition, where point mutations or deletions to a portion of a specific gene or a number of genes results in compatibility with the agrichemical(s), the unique point mutations can likewise be detected by PCR or other means known in the art. Such methods allow the detection of the microbe even if it is no longer viable. Thus, commodity plant products produced using the agrichemical compatible microbes described herein can readily be identified by employing these and related methods of nucleic acid detection.

Improved Traits Conferred by the Endophyte

The present invention contemplates the establishment of a microbial symbiont in a plant. In one embodiment, the microbial association results in a detectable change to the seed or plant. The detectable change can be an improvement in a number of agronomic traits (e.g., improved general health, increased response to biotic or abiotic stresses, or enhanced properties of the plant or a plant part, including fruits and grains). Alternatively, the detectable change can be a physiological or biological change that can be measured by methods known in the art. The detectable changes are described in more detail in the sections below. As used herein, an endophyte is considered to have conferred an improved agricultural trait whether or not the improved trait arose from the plant, the endophyte, or the concerted action between the plant and endophyte. Therefore, for example, whether a beneficial hormone or chemical is produced by the plant or endophyte, for purposes of the present invention, the endophyte will be considered to have conferred an improved agronomic trait upon the host plant.

In some embodiments, plant-endophyte combinations confer an agronomic benefit in agricultural plants. In some embodiments, the agronomic trait is selected from the group consisting of altered oil content, altered protein content, altered seed carbohydrate composition, altered seed oil composition, and altered seed protein composition, chemical tolerance, cold tolerance, delayed senescence, disease resistance, drought tolerance, ear weight, growth improvement, health enhancement, heat tolerance, herbicide tolerance, herbivore resistance, improved nitrogen fixation, improved nitrogen utilization, improved root architecture, improved water use efficiency, increased biomass, increased root length, increased seed weight, increased shoot length, increased yield, increased yield under water-limited conditions, kernel mass, kernel moisture content, metal tolerance, number of ears, number of kernels per ear, number of pods, nutrition enhancement, pathogen resistance, pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased number of pods per plant, increased length of pods per plant, reduced number of wilted leaves per plant, reduced number of severely wilted leaves per plant, and increased number of non-wilted leaves per plant, a detectable modulation in the level of a metabolite, a detectable modulation in the level of a transcript, and a detectable modulation in the proteome relative to a reference plant. In other embodiments, at least two agronomic traits are improved in the agricultural plant.

For example, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, or at least 300% or more, when compared with uninoculated plants grown under the same conditions.

In some aspects, provided herein, are methods for producing a seed of a plant with a heritably altered trait. The trait of the plant can be altered without known genetic modification of the plant genome, and comprises the following steps. First, a preparation of an isolated endophyte that is exogenous to the seed of the plant is provided, and optionally processed to produce a microbial preparation. The microbial preparation is then contacted with the plant. The plants are then allowed to go to seed, and the seeds, which contain the endophytes on and/or in the seed are collected. The endophytes contained within the seed are viably incorporated into the seed.

The method of the present invention can facilitate crop productivity by enhancing germination, seedling vigor and biomass in comparison with a non-treated control. Moreover, the introduction of the beneficial microorganisms to within the seed instead of by, e.g., seed coating, makes the endophytes less susceptible to environmental perturbation and more compatible with chemical seed coatings (e.g., pesticides and herbicides). Using endophyte colonized seeds, the plant growth and biomass increases are statistically similar to those obtained using conventional inoculation methods e.g., exogenous seed soaking and soil inoculation (that are more laborious and less practicable in certain circumstances).

Improved General Health

Also described herein are plants, and fields of plants, that are associated with beneficial endophytes, such that the overall fitness, productivity or health of the plant or a portion thereof, is maintained, increased and/or improved over a period of time. Improvement in overall plant health can be assessed using numerous physiological parameters including, but not limited to, height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof. Improved plant health, or improved field health, can also be demonstrated through improved resistance or response to a given stress, either biotic or abiotic stress, or a combination of one or more abiotic stresses, as provided herein.

Other Abiotic Stresses

Disclosed herein are endophyte-associated plants with increased resistance to an abiotic stress. Exemplary abiotic stresses include, but are not limited to: drought, salt, high metal content, low nutrients, cold stress, and heat stress.

Drought and Heat Tolerance

When soil water is depleted or if water is not available during periods of drought, crop yields are restricted. Plant water deficit develops if transpiration from leaves exceeds the supply of water from the roots. The available water supply is related to the amount of water held in the soil and the ability of the plant to reach that water with its root system. Transpiration of water from leaves is linked to the fixation of carbon dioxide by photosynthesis through the stomata. The two processes are positively correlated so that high carbon dioxide influx through photosynthesis is closely linked to water loss by transpiration. As water transpires from the leaf, leaf water potential is reduced and the stomata tend to close in a hydraulic process limiting the amount of photosynthesis. Since crop yield is dependent on the fixation of carbon dioxide in photosynthesis, water uptake and transpiration are contributing factors to crop yield: Plants which are able to use less water to fix the same amount of carbon dioxide or which are able to function normally at a lower water potential have the potential to conduct more photosynthesis and thereby to produce more biomass and economic yield in many agricultural systems.

In some cases, a plant resulting from seeds or other plant elements treated with a single endophyte strain or a plurality of endophytes can exhibit a physiological change, such as a compensation of the stress-induced reduction in photosynthetic activity (expressed, for example, as ΔFv/Fm) after exposure to heat shock or drought conditions as compared to a corresponding control, genetically identical plant that does not contain the endophytes grown in the same conditions. In some cases, the endophyte-associated plant as disclosed herein can exhibit an increased change in photosynthetic activity ΔFv(ΔFv/Fm) after heat-shock or drought stress treatment, for example 1, 2, 3, 4, 5, 6, 7 days or more after the heat-shock or drought stress treatment, or until photosynthesis ceases, as compared with corresponding control plant of similar developmental stage but not comprising the endophytes. For example, a plant having a plurality of the endophytes able to confer heat and/or drought-tolerance can exhibit a ΔFv/Fm of from about 0.1 to about 0.8 after exposure to heat-shock or drought stress or a ΔFv/Fm range of from about 0.03 to about 0.8 under one day, or 1, 2, 3, 4, 5, 6, 7, or over 7 days post heat-shock or drought stress treatment, or until photosynthesis ceases. In some embodiments, stress-induced reductions in photosynthetic activity can be compensated by at least about 0.25% (for example, at least about 0.5%, between 0.5% and 1%, at least about 1%, between 1% and 2%, at least about 2%, between 2% and 3%, at least about 3%, between 3% and 5%, at least about 5%, between 5% and 10%, at least about 8%, at least about 10%, between 10% and 15%, at least about 15%, between 15% and 20%, at least about 20%, between 20$ and 25%, at least about 25%, between 25% and 30%, at least about 30%, between 30% and 40%, at least about 40%, between 40% and 50%, at least about 50%, between 50% and 60%, at least about 60%, between 60% and 75%, at least about 75%; between 75% and 80%, at least about 80%, between 80% and 85%, at least about 85%, between 85% and 90%, at least about 90%, between 90% and 95%, at least about 95%, between 95% and 99%, at least about 99%, between 99% and 100%, or at least 100%) as compared to the photosynthetic activity decrease in a corresponding reference agricultural plant following heat shock conditions. Significance of the difference between endophyte-associated and reference agricultural plants can be established upon demonstrating statistical significance, for example at $p<0.05$ with an appropriate parametric or non-parametric statistic, e.g., Chi-square test, Student's t-test, Mann-Whitney test, or F-test based on the assumption or known facts that the endophyte-associated plant and reference agricultural plant have identical or near identical genomes (isoline comparison).

In selecting traits for improving crops, a decrease in water use, without a change in growth would have particular merit in an irrigated agricultural system where the water input costs were high. An increase in growth without a corresponding jump in water use would have applicability to all agricultural systems. In many agricultural systems where water supply is not limiting, an increase in growth, even if it came at the expense of an increase in water use also increases yield. Water use efficiency (WUE) is a parameter often correlated with drought tolerance, and is the CO2 assimilation rate per water transpired by the plant. An increased water use efficiency of the plant relates in some cases to an increased fruit/kernel size or number. Therefore, in some embodiments, the plants described herein exhibit an increased water use efficiency when compared with a reference agricultural plant grown under the same conditions. For example, the plants grown from the plant elements comprising the plurality of endophytes can have at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100% higher WUE than a reference agricultural plant grown under the same conditions. Such an increase in WUE can occur under conditions without water deficit, or under conditions of water to deficit, for example, when the soil water content is less than or equal to 60% of water saturated soil, for example, less than or equal to 50%, less than or equal to 40%, less than or equal to 30%, less than or equal to 20%, less than or equal to 10% of water saturated soil on a weight basis. In a related embodiment, the plant comprising the plurality of endophytes can have at least. 10% higher relative water content (RWC), for example, at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100% higher RWC than a reference agricultural plant grown under the same conditions.

In some embodiments, the plants comprise a single endophyte strain or a plurality of endophytes able to increase heat and/or drought-tolerance in sufficient quantity, such that increased growth or improved recovery from wilting under conditions of heat or drought stress is observed. For example, a plurality of endophyte populations described herein can be present in sufficient quantity in a plant, resulting in increased growth as compared to a plant that does not contain endophytes, when grown under drought conditions or heat shock conditions, or following such conditions. Increased heat and/or drought tolerance can be assessed with physiological parameters including, but not limited to, increased height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, wilt recovery, turgor pressure, or any combination thereof, as compared to a reference agricultural plant grown under similar conditions. For example, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

In various embodiments, a a single endophyte strain or plurality of endophytes introduced into altered seed microbiota can confer in the resulting plant thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased protein content, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, enhanced soil water retention, or a combination thereof. A difference between the endophyte-associated plant and a reference agricultural plant can also be measured using other methods known in the art.

Salt Stress

In other embodiments, a a single endophyte strain or plurality of endophytes able to confer increased tolerance to salinity stress can be introduced into plants. The resulting plants comprising endophytes can exhibit increased resistance to salt stress, whether measured in terms of survival under saline conditions, or overall growth during, or following salt stress. The physiological parameters of plant health recited above, including height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof, can be used to measure growth, and compared with the growth rate of reference agricultural plants (e.g., isogenic plants without the endophytes) grown under identical conditions. For example, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

In other instances, endophyte-associated plants and reference agricultural plants can be grown in soil or growth media containing different concentration of sodium to establish the inhibitory concentration of sodium (expressed, for example, as the concentration in which growth of the plant is inhibited by 50% when compared with plants grown under no sodium stress). Therefore, in another embodiment, a plant resulting from seeds containing an endophyte able to confer salt tolerance described herein exhibits an increase in the inhibitory sodium concentration by at least 10 mM, for example at least 15 mM, at least 20 mM, at least 30 mM, at least 40 mM, at least 50 mM, at least 60 mM, at least 70 mM, at least 80 mM, at least 90 mM, at least 100 mM or more, when compared with the reference agricultural plants.

High Metal Content

Plants are sessile organisms and therefore must contend with the environment in which they are placed. While plants have adapted many mechanisms to deal with chemicals and substances that may be deleterious to their health, heavy metals represent a class of toxins which are highly relevant for plant growth and agriculture. Plants use a number of mechanisms to cope with toxic levels of heavy metals (for example, nickel, cadmium, lead, mercury, arsenic, or aluminum) in the soil, including excretion and internal sequestration. For agricultural purposes, it is important to have plants that are able to tolerate otherwise hostile conditions, for example soils containing elevated levels of toxic heavy metals. Endophytes that are able to confer increased heavy metal tolerance may do so by enhancing sequestration of the metal in certain compartments. Use of such endophytes in a plant would allow the development of novel plant-endophyte combinations for purposes of environmental remediation (also known as phytoremediation). Therefore, in one embodiment, the plant containing the endophyte able to confer increased metal tolerance exhibits a difference in a physiological parameter that is at least about 5% greater, for example at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, or at least 100%, at least about 200%, at least about 300%, at least about 400% or greater than a reference agricultural plant grown under the same heavy metal concentration in the soil.

Alternatively, the inhibitory concentration of the heavy metal can be determined for the endophyte-associated plant and compared with a reference agricultural plant under the same conditions. Therefore, in one embodiment, the plants resulting from seeds containing an endophyte able to confer heavy metal tolerance described herein exhibit an increase in the inhibitory sodium concentration by at least 0.1 mM, for example at least 0.3 mM, at least 0.5 mM, at least 1 mM, at least 2 mM, at least 5 mM, at least 10 mM, at least 15 mM, at least 20 mM, at least 30 mM, at least 50 mM or more, when compared with the reference agricultural plants.

Finally, plants inoculated with endophytes that are able to confer increased metal tolerance exhibits an increase in overall metal accumulation by at least 10%, for example at least 15%, at least 20%, at least 30%, at least 40%, at least 50%, at least 60%, at least 75%, at least 100%, at least 150%, at least 200%, at least 300% or more, when compared with uninoculated plants grown under the same conditions.

Low Nutrient Stress

A single endophyte strain or a plurality of endophytes described herein may also confer to the plant an increased ability to grow in nutrient limiting conditions, for example by solubilizing or otherwise making available to the plants macronutrients or micronutrients that are complexed, insoluble, or otherwise in an unavailable form. In some embodiments, a plant is inoculated with a plurality of endophytes that confer increased ability to liberate and/or otherwise provide to the plant with nutrients selected from the group consisting of phosphate, nitrogen, potassium, iron, manganese, calcium, molybdenum, vitamins, or other micronutrients. Such a plant can exhibit increased growth in soil comprising limiting amounts of such nutrients when compared with reference agricultural plant. Differences between the endophyte-associated plant and reference agricultural plant can be measured by comparing the biomass of the two plant types grown under limiting conditions, or by measuring the physical parameters described above. Therefore, in some embodiments, the plant comprising endophytes shows increased tolerance to nutrient limiting conditions as compared to a reference agricultural plant grown under the same nutrient limited concentration in the soil, as measured for example by increased biomass or seed yield of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions. In other embodiments, the plant containing the plurality of endophytes is able to grown under nutrient stress conditions while exhibiting no difference in the physiological parameter compared to a plant that is grown without nutrient stress. In some embodiments, such a plant will exhibit no difference in the physiological parameter when grown with 2-5% less nitrogen than average cultivation practices on normal agricultural land, for example, at least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, or between 75% and 100%, less nitrogen, when compared with crop plants grown under normal conditions during an average growing season. In some embodiments, the microbe capable of providing nitrogen-stress tolerance to a plant is diazotrophic. In other embodiments, the microbe capable of providing nitrogen-stress tolerance to a plant is non-diazotrophic.

Cold Stress

In some cases, endophytes can confer to the plant the ability to tolerate cold stress. Many known methods exist for the measurement of a plant's tolerance to cold stress (as reviewed, for example, in Thomashow (2001) Plant Physiol. 125: 89-93, and Gilmour et al. (2000) Plant Physiol. 124: 1854-1865, both of which are incorporated herein by reference in their entirety). As used herein, cold stress refers to both the stress induced by chilling (0° C.-15° C.) and freezing (<0° C.). Some cultivars of agricultural plants can be particularly sensitive to cold stress, but cold tolerance traits may be multigenic, making the breeding process difficult. Endophytes able to confer cold tolerance would potentially reduce the damage suffered by farmers on an annual basis. Improved response to cold stress can be measured by survival of plants, the amount of necrosis of parts of the plant, or a change in crop yield loss, as well as the physiological parameters used in other examples. Therefore, in one embodiment, the plant containing the endophyte able to confer increased cold tolerance exhibits a difference in a physiological parameter that is at least about 5% greater, for example at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, or at least 100%, at least about 200%, at least about 300%, at least about 400% or greater than a reference agricultural plant grown under the same conditions of cold stress.

Biotic Stress

In other embodiments, a single endophyte strain or plurality of endophytes protects the plant from a biotic stress, for example, insect infestation, nematode infestation, complex infection, fungal infection, oomycete infection, protozoal infection, viral infection, and herbivore grazing, or a combination thereof. For example, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

Insect Herbivory

There are an abundance of insect pest species that can infect or infest a wide variety of plants. Pest infestation can lead to significant damage. Insect pests that infest plant species are particularly problematic in agriculture as they can cause serious damage to crops and significantly reduce plant yields. A wide variety of different types of plant are susceptible to pest infestation including commercial crops such as cotton, soybean, wheat, barley, and corn.

In some embodiments, endophytes described herein confer upon the host plant the ability to repel insect herbivores. In other cases, the endophytes may produce, or induce the production in the plant of, compounds which are insecticidal or insect repellant. The insect may be any one of the common pathogenic insects affecting plants, particularly agricultural plants. Examples include, but are not limited to: *Leptinotarsa* spp. (e.g., *L. decemlineata* (Colorado potato beetle), *L. juncta* (false potato beetle), or *L. texana* (Texan false potato beetle)); *Nilaparvata* spp. (e.g., *N. lugens* (brown planthopper)); *Laode/phax* spp. (e.g., *L. striatellus* (small brown planthopper)); *Nephotettix* spp. (e.g., *N. virescens* or *N. cincticeps* (green leafhopper), or *N. nigropictus* (rice leafhopper)); *Sogatella* spp. (e.g., *S. furcifera* (white-backed planthopper)); *Chilo* spp. (e.g., *C. suppressalis* (rice striped stem borer), *C. auricilius* (gold-fringed stem borer), or *C. polychrysus* (dark-headed stem borer)); *Sesamia* spp. (e.g., *S. inferens* (pink rice borer)); *Tryporyza* spp. (e.g., *T. innotata* (white rice borer), or *T. incertulas* (yellow rice borer)); *Anthonomus* spp. (e.g., *A. grandis* (boll weevil)); *Phaedon* spp. (e.g., *P. cochleariae* (mustard leaf beetle)); *Epilachna* spp. (e.g., *E. varivetis* (Mexican bean beetle)); *Tribolium* spp. (e.g., *T. castaneum* (red floor beetle)); *Diabrotica* spp. (e.g., *D. virgifera*. (western corn rootworm), *D. barberi* (northern corn rootworm), *D. undecimpunctata* howardi (southern corn rootworm), *D. virgifera zeae* (Mexican corn rootworm); *Ostrinia* spp. (e.g., *O. nubilalis* (European corn borer)); *Anaphothrips* spp. (e.g., *A. obscrurus* (grass *thrips*)); *Pectinophora* spp. (e.g., *P. gossypiella* (pink bollworm)); *Heliothis* spp. (e.g., *H. virescens* (tobacco budworm)); *Trialeurodes* spp. (e.g., *T. abutiloneus* (banded-winged whitefly) *T. vaporariorum* (greenhouse whitefly)); *Bemisia* spp. (e.g., *B. argentifolii* (silverleaf whitefly)); *Aphis* spp. (e.g., *A. gossypii* (cotton aphid)); *Lygus* spp. (e.g., *L. lineolaris* (tarnished plant bug) or *L. hesperus* (western tarnished plant bug)); *Euschistus* spp. (e.g., *E. conspersus* (consperse stink bug)); *Chlorochroa* spp. (e.g., *C. sayi* (Say stinkbug)); *Nezara* spp. (e.g., *N. viridula* (southern green stinkbug)); *Thrips* spp. (e.g., *T. tabaci* (onion *thrips*)); *Frankliniella* spp. (e.g., *F. fusca* (tobacco *thrips*), or *F. occidentalis* (western flower *thrips*)); *Acheta* spp. (e.g., *A. domesticus* (house cricket)); *Myzus* spp. (e.g., *M. persicae* (green peach aphid)); *Macrosiphum* spp. (e.g., *M. euphorbiae* (potato aphid)); *Blissus* spp. (e.g., *B. leucopterus* (chinch bug)); *Acrostemum* spp. (e.g., *A. hilare* (green stink bug)); *Chilotraea* spp. (e.g., *C. polychrysa* (rice stalk borer)); *Lissorhoptrus* spp. (e.g., *L. oryzophilus* (rice water weevil)); *Rhopalosiphum* spp. (e.g., *R. maidis* (corn leaf aphid)); *Anuraphis* spp. (e.g., *A. maidiradicis* (corn root aphid)), and combinations thereof.

The endophyte-associated plant can be tested for its ability to resist, or otherwise repel, pathogenic insects by measuring, for example, insect load, overall plant biomass, biomass of the fruit or grain, percentage of intact leaves, or other physiological parameters described herein, and comparing with a reference agricultural plant. In some embodiments, the endophyte-associated plant exhibits increased biomass as compared to a reference agricultural plant grown under the same conditions (e.g., grown side-by-side, or adjacent to, endophyte-associated plants). In other embodiments, the endophyte-associated plant exhibits increased fruit or grain yield as compared to a reference agricultural plant grown under the same conditions (e.g., grown side-by-side, or adjacent to, endophyte-associated plants). In any of the above, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

Nematodes

Nematodes are microscopic roundworms that feed on the roots, fluids, leaves and stems of more than 2,000 row crops, vegetables, fruits, and ornamental plants, causing an estimated $100 billion crop loss worldwide and accounting for 13% of global crop losses due to disease. A variety of parasitic nematode species infect crop plants, including root-knot nematodes (RKN), cyst- and lesion-forming nematodes. Root-knot nematodes, which are characterized by causing root gall formation at feeding sites, have a relatively broad host range and are therefore parasitic on a large number of crop species. The cyst- and lesion-forming nematode species have a more limited host range, but still cause considerable losses in susceptible crops.

Signs of nematode damage include stunting and yellowing of leaves, and wilting of the plants during hot periods. Nematode infestation, however, can cause significant yield losses without any obvious above-ground disease symptoms. The primary causes of yield reduction are due to underground root damage. Roots infected by SCN are dwarfed or stunted. Nematode infestation also can decrease the number of nitrogen-fixing nodules on the roots, and may make the roots more susceptible to attacks by other soil-borne plant nematodes.

In some embodiments, the endophyte-associated plant has an increased resistance to a nematode when compared with a reference agricultural plant. As before with insect herbivores, biomass of the plant or a portion of the plant, or any of the other physiological parameters mentioned elsewhere, can be compared with the reference agricultural plant grown under the same conditions. Particularly useful measurements include overall plant biomass, biomass and/or size of the fruit or grain, and root biomass. In some embodiments, the endophyte-associated plant exhibits increased biomass as compared to a reference agricultural plant grown under the same conditions (e.g., grown side-by-side, or adjacent to, the endophyte-associated plants, under conditions of nematode challenge). In other embodiments, the endophyte-associated plant exhibits increased root biomass as compared to a reference agricultural plant grown under the same conditions (e.g., grown side-by-side, or adjacent to, the endophyte-associated plants, under conditions of nematode challenge). In still another embodiment, the endophyte-associated plant exhibits increased fruit or grain yield as compared to a reference agricultural plant grown under the same conditions (e.g., grown side-by-side, or adjacent to, the endophyte-associated plants, under conditions of nematode challenge). In any of the above, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

Fungal Pathogens

Fungal diseases are responsible for yearly losses of over $10 Billion on agricultural crops in the US, represent 42% of global crop losses due to disease, and are caused by a large variety of biologically diverse pathogens. Different strategies have traditionally been used to control them. Resistance traits have been bred into agriculturally important varieties, thus providing various levels of resistance against either a narrow range of pathogen isolates or races, or against a broader range. However, this involves the long and labor intensive process of introducing desirable traits into commercial lines by genetic crosses and, due to the risk of pests evolving to overcome natural plant resistance, a constant effort to breed new resistance traits into commercial lines is required. Alternatively, fungal diseases have been controlled by the application of chemical fungicides. This strategy usually results in efficient control, but is also associated with the possible development of resistant pathogens and can be associated with a negative impact on the environment. Moreover, in certain crops, such as barley and wheat, the control of fungal pathogens by chemical fungicides is difficult or impractical.

The present invention contemplates the use a single endophyte strain or of a plurality of endophytes that is able to confer resistance to fungal pathogens to the host plant. Increased resistance to fungal inoculation can be measured, for example, using any of the physiological parameters presented above, by comparing with reference agricultural plants. In some embodiments, the endophyte-associated plant exhibits increased biomass and/or less pronounced disease symptoms as compared to a reference agricultural plant grown under the same conditions (e.g., grown side-by-side, or adjacent to, the endophyte-associated plants, infected with the fungal pathogen). In still another embodiment, the endophyte-associated plant exhibits increased fruit or grain yield as compared to a reference agricultural plant grown under the same conditions (e.g., grown side-by-side, or adjacent to, the endophyte-associated plants, infected with the fungal pathogen). In other embodiments, the endophyte-associated plant exhibits decreased hyphal growth as compared to a reference agricultural plant grown under the same conditions (e.g., grown side-by-side, or adjacent to, the endophyte-associated plants, infected with the fungal pathogen). In any of the above, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

Viral Pathogens

Plant viruses are estimated to account for 18% of global crop losses due to disease. There are numerous examples of viral pathogens affecting agricultural productivity. Examples include the American wheat striate mosaic virus (AWSMV) (wheat striate mosaic), Barley stripe mosaic virus (BSMV), Barley yellow dwarf virus (BYDV), Brome mosaic virus (BMV), Cereal chlorotic mottle virus (CCMV), Corn chlorotic vein banding virus (CCVBV), Brazilian maize mosaic virus, Corn lethal necrosis Virus complex from Maize chlorotic mottle virus, (MCMV), Maize dwarf mosaic virus (MDMV), A or B Wheat streak mosaic virus (WSMV), Cucumber mosaic virus (CMV), *Cynodon* chlorotic streak virus (CCSV), Johnsongrass mosaic virus (JGMV), Maize bushy stunt *Mycoplasma*-like organism (MLO) associated virus, Maize chlorotic dwarf Maize chlorotic dwarf virus (MCDV), Maize chlorotic mottle virus (MCMV), Maize dwarf mosaic virus (MDMV), strains A, D, E and F, Maize leaf fleck virus (MLFV), Maize line virus (MLV), Maize mosaic (corn leaf stripe, Maize mosaic virus (MMV), enanismo rayado), Maize mottle and chlorotic stunt virus, Maize pellucid ringspot virus (MPRV), Maize raya gruesa virus (MRGV), Maize rayado fino (fine striping) virus (MRFV), Maize red stripe virus (MRSV), Maize ring mottle virus (MRMV), Maize rio cuarto virus (MRCV), Maize rough dwarf virus (MRDV), Cereal tillering disease virus, Maize sterile stunt virus, barley yellow striate virus, Maize streak virus (MSV), Maize stripe virus, Maize chloroticstripe virus, maize hoja blanca virus, Maize stunting virus; Maize tassel abortion virus (MTAV), Maize vein enation virus (MVEV), Maize wallaby ear virus (MWEV), Maize white leaf virus, Maize white line mosaic virus (MWLMV), Millet red leaf virus (MRLV), Northern cereal mosaic virus (NCMV), Oat pseudorosette virus, (zakuklivanie), Oat sterile dwarf virus (OSDV), Rice black-streaked dwarf virus (RBSDV), Rice stripe virus (RSV), Sorghum mosaic virus (SrMV), Sugarcane mosaic virus (SCMV) strains H, I and M, Sugarcane Fiji disease virus (FDV), Sugarcane mosaic virus (SCMV) strains A, B, D, E, SC, BC, Sabi and MB (formerly MDMV-B), and Wheat spot mosaic virus (WSMV). In one embodiment, the endophyte-associated plant provides protection against viral pathogens such that there is at least 5% greater biomass, for example, at least 10%, at least 15%, at least 20%, at least 30%, at least 40%, at least 50%, at least 75%, at least 100% or more biomass, than the reference agricultural plant grown under the same conditions. In still another embodiment, the endophyte-associated plant exhibits at least 5% greater fruit or grain yield, for example, at least 10%, at least 15%, at least 20%, at least 30%, at least 40%, at least 50%, at least 75%, at least 100% or more fruit or grain yield when challenged with a virus, as compared to a reference agricultural plant grown under the same conditions. In yet another embodiment, the endophyte-associated plant exhibits at least 5% lower viral titer, for example, at least 10%, at least 15%; at least 20%, at least 30%, at least 40%, at least 50%, at least 75%, at least 100% lower viral titer when challenged with a virus, as compared to a reference agricultural plant grown under the same conditions.

Bacterial Pathogens

Likewise, bacterial pathogens are a significant problem negatively affecting agricultural productivity and accounting for 27% of global crop losses due to plant disease. In one embodiment, the endophyte-associated plant described herein provides protection against bacterial pathogens such that there is at least 5% greater biomass, for example, at least 10%, at least 15%, at least 20%, at least 30%, at least 40%, at least 50%, at least 75%, at least 100% or more biomass, than the reference agricultural plant grown under the same conditions. In still another embodiment, the endophyte-associated plant exhibits at least 5% greater fruit or grain yield, for example, at least 10%, at least 15%, at least 20%, at least 30%, at least 40%, at least 50%, at least 75%, at least 100% or more fruit or grain yield when challenged with a bacterial pathogen, than the reference agricultural plant grown under the same conditions. In yet another embodiment, the endophyte-associated plant exhibits at least 5% lower bacterial count, for example, at least 10%, at least 15%, at least 20%, at least 30%, at least 40%, at least 50%, at least 75%, at least 100% lower bacterial count when challenged with a bacteria, as compared to a reference agricultural plant grown under the same conditions.

Yield and Biomass Improvement

In other embodiments, the improved trait can be an increase in overall biomass of the plant or a part of the plant, including its fruit or seed. In some embodiments, a single endophyte strain or a plurality of endophytes is disposed on the surface or within a tissue of the plant element in an amount effective to increase the biomass of the plant, or a part or tissue of the plant grown from the plant element. The increased biomass is useful in the production of commodity products derived from the plant. Such commodity products include an animal feed, a fish fodder, a cereal product, a processed human-food product, a sugar or an alcohol. Such products may be a fermentation product or a fermentable product, one such exemplary product is a biofuel. The increase in biomass can occur in a part of the plant (e.g., the root tissue, shoots, leaves, etc.), or can be an increase in overall biomass. Increased biomass production, such an increase meaning at at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions. Such increase in overall biomass can be under relatively stress-free conditions. In other cases, the increase in biomass can be in plants grown under any number of abiotic or biotic stresses, including drought stress, salt stress, heat stress, cold stress, low nutrient stress, nematode stress, insect herbivory stress, fungal pathogen stress, bacterial pathogen stress, and viral pathogen stress. In some embodiments, a plurality of endophytes is disposed in an amount effective to increase root biomass by at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions, when compared with a reference agricultural plant. In other cases, a plurality of endophytes is disposed on the plant element in an amount effective to increase the average biomass of the fruit or cob from the resulting plant at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

Increase in Plant Growth Hormones

Many of the microbes described herein are capable of producing the plant hormone auxin indole-3-acetic acid (IAA) when grown in culture. Auxin may play a key role in altering the physiology of the plant, including the extent of root growth. Therefore, in other embodiments, a single endophyte strain or a plurality of endophytes is disposed on the surface or within a tissue of the plant element in an amount effective to detectably induce production of auxin in the agricultural plant. For example, the increase in auxin production can be at least 2%, at least 3%, at least 4%, at least 5%, at least 6%, at least 7%, at least 8%, at least 9%, at least 10%, at least 15%, for example, at least 20%, at least 30%, at least 40%, at least 50%, at least 60%, at least 75%, at least 100%, or more, when compared with a reference agricultural plant. In some embodiments, the increased auxin production can be detected in a tissue type selected from the group consisting of the root, shoot, leaves, and flowers.

Improvement of Other Traits.

In other embodiments, a single endophyte strain or a plurality of endophytes can confer other beneficial traits to the plant. Improved traits can include an improved nutritional content of the plant or plant element used for human consumption. In some embodiments, the endophyte-associated plant is able to produce a detectable change in the content of at least one nutrient. Examples of such nutrients include amino acid, protein, oil (including any one of Oleic acid, Linoleic acid, Alpha-linoleic acid, Saturated fatty acids, Palmitic acid, Stearic acid and Trans fats), carbohydrate (including sugars such as sucrose, glucose and fructose, starch, or dietary fiber), Vitamin A, Thiamine (vit. B1), Riboflavin (vit. B2), Niacin (vit. B3), Pantothenic acid (B5), Vitamin B6, Folate (vit. B9), Choline, Vitamin C, Vitamin E, Vitamin K, Calcium, Iron, Magnesium, Manganese, Phosphorus, Potassium, Sodium, Zinc. In some embodiments, the endophyte-associated plant or part thereof contains at least one increased nutrient when compared with reference agricultural plants.

In other cases, the improved trait can include reduced content of a harmful or undesirable substance when compared with reference agricultural plants. Such compounds include those which are harmful when ingested in large quantities or are bitter tasting (for example, oxalic acid, amygdalin, certain alkaloids such as solanine, caffeine, nicotine, quinine and morphine, tannins, cyanide). As such, in some embodiments, the endophyte-associated plant or part thereof contains less of the undesirable substance when compared with reference agricultural plant. In a related embodiment, the improved trait can include improved taste of the plant or a part of the plant, including the fruit or seed. In a related embodiment, the improved trait can include reduction of undesirable compounds produced by other endophytes in plants, such as degradation of *Fusarium*-produced deoxynivalenol (also known as vomitoxin and a virulence factor involved in *Fusarium* head blight of maize and wheat) in a part of the plant, including the fruit or seed.

The endophyte-associated plant can also have an altered hormone status or altered levels of hormone production when compared with a reference agricultural plant. An alteration in hormonal status may affect many physiological parameters, including flowering time, water efficiency, apical dominance and/or lateral shoot branching, increase in root hair, and alteration in fruit ripening.

The association between the endophytes and the plant can also be detected using other methods known in the art. For example, the biochemical, genomic, epigenomic, transcriptomic, metabolomics, and/or proteomic profiles of endophyte-associated plants can be compared with reference agricultural plants under the same conditions.

Transcriptome analysis of endophyte-associated and reference agricultural plants can also be performed to detect changes in expression of at least one transcript, or a set or network of genes upon endophyte association. Similarly, epigenetic changes can be detected using methylated DNA immunoprecipitation followed by high-throughput sequencing.

Metabolomic or proteomic differences between the plants can be detected using methods known in the art. The metabolites, proteins, or other compounds described herein can be detected using any suitable method including, but not limited to gel electrophoresis, liquid and gas phase chromatography, either alone or coupled to mass spectrometry, NMR, immunoassays (enzyme-linked immunosorbent assays (ELISA)), chemical assays, spectroscopy and the like. In some embodiments, commercial systems for chromatography and NMR analysis are utilized. Such metabolomic methods can be used to detect differences in levels in hormone, nutrients, secondary metabolites, root exudates, phloem sap content, xylem sap content, heavy metal content, and the like. Such methods are also useful for detecting alterations in endophyte content and status; for example, the presence and levels of signaling molecules (e.g., autoinducers and pheromones), which can indicate the status of group-based behavior of endophytes based on, for example, population density. In some embodiments, a biological sample (whole tissue, exudate, phloem sap, xylem sap, root exudate, etc.) from endophyte-associated and reference agricultural plants can be analyzed essentially as known in the art.

In some embodiments, metabolites in plants can be modulated by making synthetic combinations of plants with pluralities of endophytes. For example, a plurality of endophytes can cause a detectable modulation (e.g., an increase or decrease) in the level of various metabolites, e.g., indole-3-carboxylic acid, trans-zeatin, abscisic acid, phaseic acid, indole-3-acetic acid, indole-3-butyric acid, indole-3-acrylic acid, jasmonic acid, jasmonic acid methyl ester, dihydrophaseic acid, gibberellin A3, salicylic acid, upon colonization of a plant.

In some embodiments, a single endophyte strain or a plurality of endophytes modulates the level of the metabolite directly (e.g., the microbes produces the metabolite, resulting in an overall increase in the level of the metabolite found in the plant). In other cases, the agricultural plant, as a result of the association with the plurality of endophytes, exhibits a modulated level of the metabolite (e.g., the plant reduces the expression of a biosynthetic enzyme responsible for production of the metabolite as a result of the microbe inoculation). In still other cases, the modulation in the level of the metabolite is a consequence of the activity of both the microbe and the plant (e.g., the plant produces increased amounts of the metabolite when compared with a reference agricultural plant, and the endophyte also produces the metabolite). Therefore, as used herein, a modulation in the level of a metabolite can be an alteration in the metabolite level through the actions of the microbe and/or the inoculated plant.

The levels of a metabolite can be measured in an agricultural plant, and compared with the levels of the metabolite in a reference agricultural plant, and grown under the same conditions as the inoculated plant. The uninoculated plant that is used as a reference agricultural plant is a plant that has not been applied with a formulation with the plurality of endophytes (e.g., a formulation comprising a plurality of populations of purified endophytes). The uninoculated plant used as the reference agricultural plant is generally the same species and cultivar as, and is isogenic to, the inoculated plant.

The metabolite whose levels are modulated (e.g., increased or decreased) in the endophyte-associated plant may serve as a primary nutrient (i.e., it provides nutrition for the humans and/or animals who consume the plant, plant tissue, or the commodity plant product derived therefrom, including, but not limited to, a sugar, a starch, a carbohydrate, a protein, an oil, a fatty acid, or a vitamin). The metabolite can be a compound that is important for plant growth, development or homeostasis (for example, a phytohormone such as an auxin, cytokinin, gibberellin, a brassinosteroid, ethylene, or abscisic acid, a signaling molecule, or an antioxidant). In other embodiments, the metabolite can have other functions. For example, in some embodiments, a metabolite can have bacteriostatic, bactericidal, fungistatic, fungicidal or antiviral properties. In other embodiments, the metabolite can have insect-repelling, insecticidal, nematode-repelling, or nematicidal properties. In still other embodiments, the metabolite can serve a role in protecting the plant from stresses, may help improve plant vigor or the general health of the plant. In yet another embodiment, the metabolite can be a useful compound for industrial production. For example, the metabolite may itself be a useful compound that is extracted for industrial use, or serve as an intermediate for the synthesis of other compounds used in industry. In a particular embodiment, the level of the metabolite is increased within the agricultural plant or a portion thereof such that it is present at a concentration of at least 0.1 ug/g dry weight, for example, at least 0.3 ug/g dry weight, between 0.3 ug/g and 1.0 ug/g dry weight, at least 1.0 ug/g dry weight, between 1.0 ug/g and 3.0 ug/g dry weight, at least 3.0 ug/g dry weight, between 3.0 ug/g and 10 ug/g dry weight, at least 10 ug/g dry weight, between 10 ug/g and 30 ug/g dry to weight, at least 30 ug/g dry weight, between 30 ug/g and 100 ug/g dry weight, at least 100 ug/g dry weight, between 100 ug/g and 300 ug/g dry weight, at least 300 ug/g dry weight, between 300 ug/g and 1 mg/g dry weight, or more than 1 mg/g dry weight, of the plant or portion thereof.

Likewise, the modulation can be a decrease in the level of a metabolite. The reduction can be in a metabolite affecting the taste of a plant or a commodity plant product derived from a plant (for example, a bitter tasting compound), or in a metabolite which makes a plant or the resulting commodity plant product otherwise less valuable (for example, reduction of oxalate content in certain plants, or compounds which are deleterious to human and/or animal health). The metabolite whose level is to be reduced can be a compound that affects quality of a commodity plant product (e.g., reduction of lignin levels).

Commodity Plant Product

The present invention provides a commodity plant product, as well as methods for producing a commodity plant product, that is derived from a plant of the present invention. As used herein, a "commodity plant product" refers to any composition or product that is comprised of material derived from a plant, seed, plant cell, or plant part of the present invention. Commodity plant products may be sold to consumers and can be viable or nonviable. Nonviable commodity products include but are not limited to nonviable seeds and grains; processed seeds, seed parts, and plant parts; dehydrated plant tissue, frozen plant tissue, and processed plant tissue; seeds and plant parts processed for animal feed for terrestrial and/or aquatic animal consumption, oil, meal, flour, flakes, bran, fiber, paper, tea, coffee, silage, crushed of whole grain, and any other food for human or animal consumption; and biomasses and fuel products; and raw material in industry. Industrial uses of oils derived from the agricultural plants described herein include ingredients for paints, plastics, fibers, detergents, cosmetics, lubricants, and biodiesel fuel. Soybean oil may be split, inter-esterified, sulfurized, epoxidized, polymerized, ethoxylated, or cleaved. Designing and producing soybean oil derivatives with improved functionality and improved oliochemistry is a rapidly growing field. The typical mixture of triglycerides is usually split and separated into pure fatty acids, which are then combined with petroleum-derived alcohols or acids, nitrogen, sulfonates, chlorine, or with fatty alcohols derived from fats and oils to produce the desired type of oil or fat. Commodity plant products also include industrial compounds, such as a wide variety of resins used in the formulation of adhesives, films, plastics, paints, coatings and foams.

In some cases, commodity plant products derived from the plants, or using the methods of the present invention can be identified readily. In some cases, for example, the presence of viable endophytes can be detected using the methods described herein elsewhere. In other cases, particularly where there are no viable endophytes, the commodity plant product may still contain at least a detectable amount of the specific and unique DNA corresponding to the microbes described herein. Any standard method of detection for polynucleotide molecules may be used, including methods of detection disclosed herein.

Formulations for Agricultural Use

The present invention contemplates a synthetic combination of a plant element that is associated with a single endophyte strain or a plurality of endophytes to confer an improved trait of agronomic importance to the host plant, or an improved agronomic trait potential to a plant element associated with the endophytes, that upon and after germination will confer said benefit to the resultant host plant.

In some embodiments, the plant element is associated with a single endophyte strain or a plurality of endophytes on its surface. Such association is contemplated to be via a mechanism selected from the group consisting of: spraying, immersion, coating, encapsulating, dusting, dripping, aerosolizing, seed treatment, root wash, seedling soak, foliar application, soil inocula, in-furrow application, sidedress application, soil pre-treatement, wound inoculation, drip tape irrigation, vector-mediation via a pollinator, injection, osmopriming, hydroponics, aquaponics, and aeroponics.

In some embodiments, the plant element is a leaf, and the synthetic combination is formulated for application as a foliar treatment.

In some embodiments, the plant element is a seed, and the synthetic combination is formulated for application as a seed coating.

In some embodiments, the plant element is a root, and the synthetic combination is formulated for application as a root treatment.

In certain embodiments, the plant element becomes associated with a plurality of endophytes through delayed exposure. For example, the soil in which a plant element is to be introduced is first treated with a composition comprising a plurality of endophytes. In another example, the area around the plant or plant element is exposed to a formulation comprising a plurality of endophytes, and the plant element becomes subsequently associated with the endophytes due to movement of soil, air, water, insects, mammals, human intervention, or other methods.

The plant element can be obtained from any agricultural plant. In some embodiments, the plant element of the first plant is from a monocotyledonous plant. For example, the plant element of the first plant is from a cereal plant. The plant element of the first plant can be selected from the group consisting of a maize seed, a wheat seed, a barley seed, a rice seed, a sugarcane seed, a maize root, a wheat root, a barley root, a sugarcane root, a rice root, a maize leaf, a wheat leaf, a barley leaf, a sugarcane leaf, or a rice leaf. In an alternative embodiment, the plant element of the first plant is from a dicotyledonous plant. The plant element of the first plant can be selected from the group consisting of a cotton seed, a tomato seed, a canola seed, a pepper seed, a soybean seed, a cotton root, a tomato root, a canola root, a pepper root, a soybean root, a cotton leaf, a tomato leaf, a canola leaf, a pepper leaf, or a soybean leaf. In still another embodiment, the plant element of the first plant can be from a genetically modified plant. In other embodiments, the plant element of the first plant can be a hybrid plant element.

The synthetic combination can comprise a plant element of the first plant which is surface-sterilized prior to combining with a plurality of endophytes. Such pre-treatment prior to coating the seed with endophytes removes the presence of other microbes which may interfere with the optimal colonization, growth and/or function of the endophytes. Surface sterilization of seeds can be accomplished without killing the seeds as described herein.

A single endophyte strain or a plurality of endophytes is intended to be useful in the improvement of agricultural plants, and as such, may be formulated with other compositions as part of an agriculturally compatible carrier. It is contemplated that such carriers can include, but not be limited to: seed treatment, root treatment, foliar treatment, soil treatment. The carrier composition with a plurality of endophytes, may be prepared for agricultural application as a liquid, a solid, or a gas formulation. Application to the plant may be achieved, for example, as a powder for surface deposition onto plant leaves, as a spray to the whole plant or selected plant element, as part of a drip to the soil or the roots, or as a coating onto the seed prior to planting. Such examples are meant to be illustrative and not limiting to the scope of the invention.

In some embodiments, the present invention contemplates plant elements comprising a single endophyte strain or a plurality of endophytes, and further comprising a formulation. The formulation useful for these embodiments generally comprises at least one member selected from the group consisting of an agriculturally compatible carrier, a tackifier, a microbial stabilizer, a fungicide, an antibacterial agent, an herbicide, a nematicide, an insecticide, a plant growth regulator, a rodenticide, and a nutrient.

In some cases, a single endophyte strain or a plurality of endophytes is mixed with an agriculturally compatible carrier. The carrier can be a solid carrier or liquid carrier. The carrier may be any one or more of a number of carriers that confer a variety of properties, such as increased stability, wettability, or dispersability. Wetting agents such as natural or synthetic surfactants, which can be nonionic or ionic surfactants, or a combination thereof can be included in a composition of the invention. Water-in-oil emulsions can also be used to formulate a composition that includes a plurality of endophytes. Suitable formulations that may be prepared include wettable powders, granules, gels, agar strips or pellets, thickeners, and the like, microencapsulated particles, and the like, liquids such as aqueous flowables, aqueous suspensions, water-in-oil emulsions, etc. The formulation may include grain or legume products, for example, ground grain or beans, broth or flour derived from grain or beans, starch, sugar, or oil.

In some embodiments, the agricultural carrier may be soil or plant growth medium. Other agricultural carriers that may be used include fertilizers, plant-based oils, humectants, or combinations thereof. Alternatively, the agricultural carrier may be a solid, such as diatomaceous earth, loam, silica, alginate, clay, bentonite, vermiculite, seed cases, other plant and animal products, or combinations, including granules, pellets, or suspensions. Mixtures of any of the aforementioned ingredients are also contemplated as carriers, such as but not limited to, pesta (flour and kaolin clay), agar or flour-based pellets in loam, sand, or clay, etc. Formulations may include food sources for the cultured organisms, such as barley, rice, or other biological materials such as seed, leaf, root, plant elements, sugar cane bagasse, hulls or stalks from grain processing, ground plant material or wood from building site refuse, sawdust or small fibers from recycling of paper, fabric, or wood. Other suitable formulations will be known to those skilled in the art.

In some embodiments, the formulation can comprise a tackifier or adherent. Such agents are useful for combining the microbial population of the invention with carriers that can contain other compounds (e.g., control agents that are not biologic), to yield a coating composition. Such compositions help create coatings around the plant or plant element to maintain contact between the microbe and other agents with the plant or plant part. In some embodiments, adherents are selected from the group consisting of: alginate, gums, starches, lecithins, formononetin, polyvinyl alcohol, alkali formononetinate, hesperetin, polyvinyl acetate, cephalins, Gum Arabic, Xanthan Gum, carragennan, PGA, other biopolymers, Mineral Oil, Polyethylene Glycol (PEG), Polyvinyl pyrrolidone (PVP), Arabino-galactan, Methyl Cellulose, PEG 400, Chitosan, Polyacrylamide, Polyacrylate, Polyacrylonitrile, Glycerol, Triethylene glycol, Vinyl Acetate, Gellan Gum, Polystyrene, Polyvinyl, Carboxymethyl cellulose, Gum Ghatti, and polyoxyethylene-polyoxybutylene block copolymers. Other examples of adherent compositions that can be used in the synthetic preparation include those described in EP 0818135, CA 1229497, WO 2013090628, EP 0192342, WO 2008103422 and CA 1041788, each of which is incorporated herein by reference in its entirety.

It is also contemplated that the formulation may further comprise an anti-caking agent.

The formulation can also contain a surfactant, wetting agent, emulsifier, stabilizer, or anti-foaming agent. Non-limiting examples of surfactants include nitrogen-surfactant blends such as Prefer 28 (Cenex), Surf-N (US), Inhance (Brandt), P-28 (Wilfarm) and Patrol (Helena); esterified seed oils include Sun-It II (AmCy), MSO (UAP), Scoil (Agsco), Hasten (Wilfarm) and Mes-100 (Drexel); and organo-silicone surfactants include Silwet L77 (UAP), Silikin (Terra), Dyne-Auric (Helena), Kinetic (Helena), Sylgard 309 (Wilbur-Ellis) and Century (Precision), polysorbate 20, polysorbate 80, Tween 20, Tween 80, Scattics, Alktest TW20, Canarcel, Peogabsorb 80, Triton X-100, Conco NI, Dowfax 9N, Igebapl CO, Makon, Neutronyx 600, Nonipol NO, Plytergent B, Renex 600, Solar NO, Sterox, Serfonic N, T-DET-N, Tergitol NP, Triton N, IGEPAL CA-630, Nonident P-40, and Pluronic. In some embodiments, the surfactant is present at a concentration of between 0.01% v/v to 10% v/v. In other embodiments, the surfactant is present at a concentration of between 0.1% v/v to 1% v/v. An example of an anti-foaming agent is Antifoam-C.

In certain cases, the formulation includes a microbial stabilizer. Such an agent can include a desiccant. As used herein, a "desiccant" can include any compound or mixture of compounds that can be classified as a desiccant regardless of whether the compound or compounds are used in such concentrations that they in fact have a desiccating effect on the liquid inoculant. Such desiccants are ideally compatible with the endophytes used, and should promote the ability of the microbial population to survive application on the plant elements and to survive desiccation. Examples of suitable desiccants include one or more of trehalose, sucrose, glycerol, and Methylene glycol. Other suitable desiccants include, but are not limited to, non-reducing sugars and sugar alcohols (e.g., mannitol or sorbitol). The amount of desiccant introduced into the formulation can range from about 5% to about 50% by weight/volume, for example, between about 10% to about 40%, between about 15% and about 35%, or between about 20% and about 30%.

In some cases, it is advantageous for the formulation to contain agents such as a fungicide, an antibacterial agent, an herbicide, a nematicide, an insecticide, a plant growth regulator, a rodenticide, a bactericide, a virucide, and a nutrient. Such agents are ideally compatible with the agricultural plant element or seedling onto which the formulation is applied (e.g., it should not be deleterious to the growth or health of the plant). Furthermore, the agent is ideally one which does not cause safety concerns for human, animal or industrial use (e.g., no safety issues, or the compound is sufficiently labile that the commodity plant product derived from the plant contains negligible amounts of the compound).

In the liquid form, for example, solutions or suspensions, a plurality of endophytes can be mixed or suspended in aqueous solutions. Suitable liquid diluents or carriers include aqueous solutions, petroleum distillates, or other liquid carriers.

Solid compositions can be prepared by dispersing a plurality of endophytes of the invention in and on an appropriately divided solid carrier, such as peat, wheat, bran, vermiculite, clay, talc, bentonite, diatomaceous earth, fuller's earth, pasteurized soil, and the like. When such formulations are used as wettable powders, biologically compatible dispersing agents such as non-ionic, anionic, amphoteric, or cationic dispersing and emulsifying agents can be used.

The solid carriers used upon formulation include, for example, mineral carriers such as kaolin clay, pyrophyllite, bentonite, montmorillonite, diatomaceous earth, acid white soil, vermiculite, and pearlite, and inorganic salts such as ammonium sulfate, ammonium phosphate, ammonium nitrate, urea, ammonium chloride, and calcium carbonate. Also, organic fine powders such as wheat flour, wheat bran, and rice bran may be used. The liquid carriers include vegetable oils such as soybean oil and cottonseed oil, glycerol, ethylene glycol, polyethylene glycol, propylene glycol, polypropylene glycol, etc.

In some embodiments, the formulation is ideally suited for coating of a plurality of endophytes onto plant elements. The plurality of endophytes is capable of conferring many agronomic benefits to the host plants. The ability to confer such benefits by coating the plurality of endophytes on the surface of plant elements has many potential advantages, particularly when used in a commercial (agricultural) scale.

A single endophyte strain or a plurality of endophytes can be combined with one or more of the agents described above to yield a formulation suitable for combining with an agricultural plant element or seedling. The plurality of endophytes can be obtained from growth in culture, for example, using a synthetic growth medium. In addition, the microbe can be cultured on solid media, for example on petri dishes, scraped off and suspended into the preparation. Microbes at different growth phases can be used. For example, microbes at lag phase, early-log phase, mid-log phase, late-log phase, stationary phase, early death phase, or death phase can be used. Endophytic spores may be used for the present invention, for example but not limited to: arthospores, sporangispores, conidia, chlamadospores, pycnidiospores, endospores, zoospores.

The formulations comprising a plurality of endophytes of the present invention typically contains between about 0.1 to 95% by weight, for example, between about 1% and 90%, between about 3% and 75%, between about 5% and 60%, between about 10% and 50% in wet weight of a plurality of endophytes. In some embodiments, the formulation contains at least about 10^2 per ml of formulation, at least about 10^3 per ml of formulation, for example, at least about 10^4, at least about 10^5, at least about 10^6, at least about 10^7 CFU or spores, at least about 10^3 CFU or spores per ml of formulation. In some embodiments, the formulation be applied to the plant element at about 10^2 CFU/seed, between 10^2 and 10^3 CFU, at least about 10^3 CFU, between 10^3 and 10^4 CFU, at least about 10^4 CFU, between 10^4 and 10^5 CFU, at least about 10^5 CFU, between 10^5 and 10^6 CFU, at least about 10^6 CFU, between 10^6 and 10^7 CFU, at least about 10^7 CFU, between 10^7 and 10^8 CFU, or even greater than 10^8 CFU per seed.

The compositions provided herein are preferably stable. The endophyte may be shelf-stable, where at least 0.01%, of the CFU or spores are viable after storage in desiccated form (i.e., moisture content of 30% or less) for 1, 2, 3, 4, 5, 6, 7, 8, 9, 10 or greater than 10 weeks at 4° C. or at room temperature. Optionally, a shelf-stable formulation is in a dry formulation, a powder formulation, or a lyophilized formulation. In some embodiments, the formulation is formulated to provide stability for the population of endophytes. In one embodiment, the formulation is substantially stable at temperatures between about −20° C. and about 50° C. for at least about 1, 2, 3, 4, 5, or 6 days, or 1, 2, 3 or 4 weeks, or 1, 2, 3, 4, 5, 6, 7, 8, 9, 10, 11 or 12 months, or one or more years. In another embodiment, the formulation is substantially stable at temperatures between about 4° C. and about 37° C. for at least about 5, 10, 15, 20, 25, 30 or greater than 30 days.

As described above, in certain embodiments, the present invention contemplates the use of a single endophyte strain or a plurality of endophytes heterologously disposed on the plant, for example, the plant element. In certain cases, the agricultural plant may contain bacteria that are substantially similar to, or even genetically indistinguishable from, the bacteria that are being applied to the plant. It is noted that, in many cases, the bacteria that are being applied is substantially different from the bacteria already present in several significant ways. First, the bacteria that are being applied to the agricultural plant have been adapted to culture, or adapted to be able to grow on growth media in isolation from the plant. Second, in many cases, the bacteria that are being applied are derived from a clonal origin, rather than from a heterologous origin and, as such, can be distinguished from the bacteria that are already present in the agricultural plant by the clonal similarity. For example, where a microbe that has been inoculated by a plant is also present in the plant (for example, in a different tissue or portion of the plant), or where the introduced microbe is sufficiently similar to a microbe that is present in some of the plants (or portion of the plant, including plant elements), it is still possible to distinguish between the inoculated microbe and the native microbe by distinguishing between the two microbe types on the basis of their epigenetic status (e.g., the bacteria that are applied, as well as their progeny, would be expected to have a much more uniform and similar pattern of cytosine methylation of its genome, with respect to the extent and/or location of methylation).

It is, of course, also possible to provide a coating with additional microorganisms (either the same or different as the endophyte that was inoculated). Therefore, according to another embodiment of the present invention, the obtained plant seed containing microorganisms is therefore subjected to a further seed impregnation step.

Once coated with the endophyte formulation, the seeds can be mixed and allowed to dry before germination occurs.

Endophytes Compatible with Agrichemicals

In certain embodiments, the single endophyte strain or the plurality of endophytes is selected on the basis of its compatibility with commonly used agrichemicals. As mentioned earlier, plants, particularly agricultural plants, can be treated with a vast array of agrichemicals, including fungicides, biocides (anti-complex agents), herbicides, insecticides, nematicides, rodenticides, fertilizers, and other agents.

In some cases, it can be important for the single endophyte strain or the plurality of endophytes to be compatible with agrichemicals, particularly those with anticomplex properties, in order to persist in the plant although, as mentioned earlier, there are many such anticomplex agents that do not penetrate the plant, at least at a concentration sufficient to interfere with the endophytes. Therefore, where a systemic anticomplex agent is used in the plant, compatibility of the endophytes to be inoculated with such agents will be an important criterion.

Fungicides

In some embodiments, the control agent is a fungicide. As used herein, a fungicide is any compound or agent (whether chemical or biological) that can either inhibit the growth of a fungus or kill a fungus. In that sense, a "fungicide", as used herein, encompasses compounds that may be fungistatic or fungicidal. As used herein, the fungicide can be a protectant, or agents that are effective predominantly on the seed surface, providing protection against seed surface-borne pathogens and providing some level of control of soil-borne pathogens. Non-limiting examples of protectant fungicides include captan, maneb, thiram, or fludioxonil.

The fungicide can be a systemic fungicide, which can be absorbed into the emerging seedling and inhibit or kill the fungus inside host plant tissues. Systemic fungicides used for seed treatment include, but are not limited to the following: azoxystrobin, carboxin, mefenoxam, metalaxyl, thiabendazole, trifloxystrobin, and various triazole fungicides, including difenoconazole, ipconazole, tebuconazole, and triticonazole. Mefenoxam and metalaxyl are primarily used to target the water mold fungi *Pythium* and *Phytophthora*. Some fungicides are preferred over others, depending on the plant species, either because of subtle differences in sensitivity of the pathogenic fungal species, or because of the differences in the fungicide distribution or sensitivity of the plants. In some embodiments, the endophyte is compatible with at least one of the fungicides selected from the group consisting of: 2-(thiocyanatomethylthio)-benzothiazole, 2-phenylphenol, 8-hydroxyquinoline sulfate, ametoctradin, amisulbrom, antimycin, *Ampelomyces quisqualis*, azaconazole, azoxystrobin, *Bacillus subtilis*, benalaxyl, benomyl, benthiavalicarb-isopropyl, benzylaminobenzene-sulfonate (BABS) salt, bicarbonates, biphenyl, bismerthiazol, bitertanol, bixafen, blasticidin-S, borax, Bordeaux mixture, boscalid, bromuconazole, bupirimate, calcium polysulfide, captafol, captan, carbendazim, carboxin, carpropamid, carvone, chloroneb, chlorothalonil, chlozolinate, *Coniothyrium minitans*, copper hydroxide, copper octanoate, copper oxychloride, copper sulfate, copper sulfate (tribasic), cuprous oxide, cyazofamid, cyflufenamid, cymoxanil, cyproconazole, cyprodinil, dazomet, debacarb, diammonium ethylenebis-(dithiocarbamate), dichlofluanid, dichlorophen, diclocymet, diclomezine, dichloran, diethofencarb, difenoconazole, difenzoquat ion, diflumetorim, dimethomorph, dimoxystrobin, diniconazole, diniconazole-M, dinobuton, dinocap, diphenylamine, dithianon, dodemorph, dodemorph acetate, dodine, dodine free base, edifenphos, enestrobin, epoxiconazole, ethaboxam, ethoxyquin, etridiazole, famoxadone, fenamidone, fenarimol, fenbuconazole, fenfuram, fenhexamid, fenoxanil, fenpiclonil, fenpropidin, fenpropimorph, fentin, fentin acetate, fentin hydroxide, ferbam, ferimzone, fluazinam, fludioxonil, flumorph, fluopicolide, fluopyram, fluoroimide, fluoxastrobin, fluquinconazole, flusilazole, flusulfamide, flutianil, flutolanil, flutriafol, fluxapyroxad, folpet, formaldehyde, fosetyl, fosetyl-aluminium, fuberidazole, furalaxyl, furametpyr, guazatine, guazatine acetates, GY-81, hexachlorobenzene, hexaconazole, hymexazol, imazalil, imazalil sulfate, imibenconazole, iminoctadine, iminoctadine triacetate, iminoctadine tris(albesilate), ipconazole, iprobenfos, iprodione, iprovalicarb, isoprothiolane, isopyrazam, isotianil, kasugamycin, kasugamycin hydrochloride hydrate, kresoxim-methyl, mancopper, mancozeb, mandipropamid, maneb, mepanipyrim, mepronil, mercuric chloride, mercuric oxide, mercurous chloride, metalaxyl, mefenoxam, metalaxyl-M, metam, metam-ammonium, metam-potassium, metam-sodium, metconazole, methasulfocarb, methyl iodide, methyl isothiocyanate, metiram, metominostrobin, metrafenone, mildiomycin, myclobutanil, nabam, nitrothal-isopropyl, nuarimol, octhilinone, ofurace, oleic acid (fatty acids), orysastrobin, oxadixyl, oxine-copper, oxpoconazole fumarate, oxycarboxin, pefurazoate, penconazole, pencycuron, penflufen, pentachlorophenol, pentachlorophenyl laurate, penthiopyrad, phenylmercury acetate, phosphonic acid, phthalide, picoxystrobin, polyoxin B, polyoxins, polyoxorim, potassium bicarbonate, potassium hydroxyquinoline sulfate, probenazole, prochloraz, procymidone, propamocarb, propamocarb hydrochloride, propiconazole, propineb, proquinazid, prothioconazole, pyraclostrobin, pyrametostrobin, pyraoxystrobin, pyrazophos, pyribencarb, pyributicarb, pyrifenox, pyrimethanil, pyroquilon, quinoclamine, quinoxyfen, quintozene, *Reynoutria sachalinensis* extract, sedaxane, silthiofam, simeconazole, sodium 2-phenylphenoxide, sodium bicarbonate, sodium pentachlorophenoxide, spiroxamine, sulfur, SYP-Z071, SYP-Z048, tar oils, tebuconazole, tebufloquin, tecnazene, tetraconazole, thiabendazole, thifluzamide, thiophanate-methyl, thiram, tiadinil, tolclofos-methyl, tolylfluanid, triadimefon, triadimenol, triazoxide, tricyclazole, tridemorph, trifloxystrobin, triflumizole, triforine, triticonazole, validamycin, valifenalate, valiphenal, vinclozolin, zineb, ziram, zoxamide, *Candida oleophila, Fusarium oxysporum, Gliocladium* spp., *Phlebiopsis gigantea, Streptomyces griseoviridis, Trichoderma* spp., (RS)—N-(3,5-dichlorophenyl)-2-(methoxymethyl)-succinimide, 1,2-dichloropropane, 1,3-dichloro-1,1,3,3-tetrafluoroacetone hydrate, 1-chloro-2,4-dinitronaphthalene, 1-chloro-2-nitropropane, 2-(2-heptadecyl-2-imidazolin-1-yl)ethanol, 2,3-dihydro-5-phenyl-1,4-dithi-ine 1,1,4,4-tetraoxide, 2-methoxyethylmercury acetate, 2-methoxyethylmercury chloride, 2-methoxyethylmercury silicate, 3-(4-chlorophenyl)-5-methylrhodanine, 4-(2-nitroprop-1-enyl) phenyl thiocyanateme, ampropylfos, anilazine, azithiram, barium polysulfide, Bayer 32394, benodanil, benquinox, bentaluron, benzamacril; benzamacril-isobutyl, benzamorf, binapacryl, bis(methylmercury) sulfate, bis(tributyltin) oxide, buthiobate, cadmium calcium copper zinc chromate sulfate, carbamorph, CECA, chlobenthiazone, chloraniformethan, chlorfenazole, chlorquinox, climbazole, cyclafuramid, cypendazole, cyprofuram, decafentin, dichlone, dichlozoline, diclobutrazol, dimethirimol, dinocton, dinosulfon, dinoterbon, dipyrithione, ditalimfos, dodicin, drazoxolon, EBP, ESBP, etaconazole, etem, ethirim, fenaminosulf, fenapanil, fenitropan, 5-fluorocytosine and profungicides thereof, fluotrimazole, furcarbanil, furconazole, furconazole-cis, furmecyclox, furophanate, glyodine, griseofulvin, halacrinate, Hercules 3944, hexylthiofos, ICIA0858, isopamphos, isovaledione, mebenil, mecarbinzid, metazoxolon, methfuroxam, methylmercury dicyandiamide, metsulfovax, milneb, mucochloric anhydride, myclozolin, N-3,5-dichlorophenyl-succinimide, N-3-nitrophenylitaconimide, natamycin, N-ethylmercurio-4-toluenesulfonanilide, nickel bis(dimethyldithiocarbamate), OCH, phenylmercury dimethyldithiocarbamate, phenylmercury nitrate, phosdiphen, picolinamide UK-2A and derivatives thereof, prothiocarb; prothiocarb hydrochloride, pyracarbolid, pyridinitril, pyroxychlor, pyroxyfur, quinacetol; quinacetol sulfate, quinazamid, quinconazole, rabenzazole, salicylanilide, SSF-109, sultropen, tecoram, thiadifluor, thicyofen, thiochlorfenphim, thiophanate, thioquinox, tioxymid, triamiphos, triarimol, triazbutil, trichlamide, urbacid, XRD-563, and zarilamide, IK-1140. In still another embodiment, an endophyte that is compatible with an antibacterial compound is used for the methods described herein. For example, the endophyte is compatible with at least one of the antibiotics selected from the group consisting of: Amikacin, Gentamicin, Kanamycin, Neomycin, Netilmicin, Tobramycin, Paromomycin, Spectinomycin, Geldanamycin, Herbimycin, Rifaximin, streptomycin, Loracarbef, Ertapenem, Doripenem, Imipenem/Cilastatin, Meropenem, Cefadroxil, Cefazolin, Cefalotin or Cefalothin, Cefalexin, Cefaclor, Cefamandole, Cefoxitin, Cefprozil, Cefuroxime, Cefixime, Cefdinir, Cefditoren, Cefoperazone, Cefotaxime, Cefpodoxime, Ceftazidime, Ceftibuten, Ceftizoxime, Ceftriaxone, Cefepime, Ceftaroline fosamil, Ceftobiprole, Teicoplanin, Vancomycin, Telavancin, Clindamycin, Lincomycin, Daptomycin, Azithromycin, Clarithromycin, Dirithromycin, Erythromycin, Roxithromycin, Troleandomycin, Telithromycin, Spiramycin, Aztreonam, Furazolidone, Nitrofurantoin, Linezolid, Posizolid, Radezolid, Torezolid, Amoxicillin, Ampicillin, Azlocillin, Carbenicillin, Cloxacillin, Dicloxacillin, Flucloxacillin, Mezlocillin, Methicillin, Nafcillin, Oxacillin, Penicillin G, Penicillin V, Piperacillin, Penicillin G, Temocillin, Ticarcillin, Amoxicillin/clavulanate, Ampicillin/sulbactam, Piperacillin/tazobactam, Ticarcillin/clavulanate, Bacitracin, Colistin, Polymyxin B, Ciprofloxacin, Enoxacin, Gatifloxacin, Levofloxacin, Lomefloxacin, Moxifloxacin, Nalidixic acid, Norfloxacin, Ofloxacin, Trovafloxacin, Grepafloxacin, Sparfloxacin, Temafloxacin, Mafenide, Sulfacetamide, Sulfadiazine, Silver sulfadiazine, Sulfadimethoxine, Sulfamethizole, Sulfamethoxazole, Sulfanilimide (archaic), Sulfasalazine, Sulfisoxazole, Trimethoprim-Sulfamethoxazole (Co-trimoxazole) (TMP-SMX), Sulfonamidochrysoidine (archaic), Demeclocycline, Doxycycline, Minocycline, Oxytetracycline, Tetracycline, Clofazimine, Dapsone, Capreomycin, Cycloserine, Ethambutol, Ethionamide, Isoniazid, Pyrazinamide, Rifampicin (Rifampin in US), Rifabutin, Rifapentine, Streptomycin, Arsphenamine, Chloramphenicol, Fosfomycin, Fusidic acid, Metronidazole, Mupirocin, Platensimycin, Quinupristin/Dalfopristin, Thiamphenicol, Tigecycline, Tinidazole, and Trimethoprim.

A fungicide can be a biological control agent, such as a bacterium or fungus. Such organisms may be parasitic to the pathogenic fungi, or secrete toxins or other substances which can kill or otherwise prevent the growth of fungi. Any type of fungicide, particularly ones that are commonly used on plants, can be used as a control agent in a seed composition.

Antibacterial Agents

In some cases, the seed coating composition comprises a control agent which has antibacterial properties. In some embodiments, the control agent with antibacterial properties is selected from the compounds described herein elsewhere. In other embodiments, the compound is Streptomycin, oxytetracycline, oxolinic acid, or gentamicin.

Plant Growth Regulators

The seed coat composition can further comprise a plant growth regulator. In some embodiments, the plant growth regulator is selected from the group consisting of: Abscisic acid, amidochlor, ancymidol, 6-benzylaminopurine, brassinolide, butralin, chlormequat (chlormequat chloride), choline chloride, cyclanilide, daminozide, dikegulac, dimethipin, 2,6-dimethylpuridine, ethephon, flumetralin, flurprimidol, fluthiacet, forchlorfenuron, gibberellic acid, inabenfide, indole-3-acetic acid, maleic hydrazide, mefluidide, mepiquat (mepiquat chloride), naphthaleneacetic acid, N-6-benzyladenine, paclobutrazol, prohexadione (prohexadione—calcium), prohydrojasmon, thidiazuron, triapenthenol, tributyl phosphorotrithioate, 2,3,5-tri-iodobenzoic acid, trinexapac-ethyl and uniconazole. Other examples of antibacterial compounds which can be used as part of a seed coating composition include those based on dichlorophene and benzylalcohol hemi formal (Proxel® from ICI or Acticide® RS from Thor Chemie and Kathon® MK from Rohm & Haas) and isothiazolinone derivatives such as alkylisothiazolinones and benzisothiazolinones (Acticide® MBS from Thor Chemie). Other plant growth regulators that can be incorporated seed coating compositions are described in US 2012/0108431, which is incorporated by reference in its entirety.

Nematicides

Preferred nematode-antagonistic biocontrol agents include ARF18; *Arthrobotrys* spp.; *Chaetomium* spp.; *Cylindrocarpon* spp.; *Exophilia* spp.; *Fusarium* spp.; *Gliocladium* spp.; *Hirsutella* spp.; *Lecanicillium* spp.; *Monacrosporium* spp.; *Myrothecium* spp.; *Neocosmospora* spp.; *Paecilomyces* spp.; *Pochonia* spp.; *Stagonospora* spp.; vesicular-arbuscular mycorrhizal fungi, *Burkholderia* spp.; *Pasteuria* spp., *Brevibacillus* spp.; *Pseudomonas* spp.; and *Rhizobacteria*. Particularly preferred nematode-antagonistic biocontrol agents include ARF18, *Arthrobotrys oligospora, Arthrobotrys dactyloides, Chaetomium globosum, Cylindrocarpon heteronema, Exophilia jeanselmei, Exophilia pisciphila, Fusarium aspergilus, Fusarium solani, Gliocladium catenulatum, Gliocladium roseum, Gliocladium virens, Hirsutella rhossiliensis, Hirsutella minnesotensis, Lecanicillium lecanii, Monacrosporium drechsleri, Monacrosporium gephyropagum, Myrotehcium verrucaria, Neocosmospora vasinfecta, Paecilomyces lilacinus, Pochonia chlamydosporia, Stagonospora heteroderae, Stagonospora phaseoli*, vesicular-arbuscular mycorrhizal fungi, *Burkholderia cepacia, Pasteuria penetrans, Pasteuria thornei, Pasteuria nishizawae, Pasteuria ramosa, Pastrueia usage, Brevibacillus laterosporus* strain G4, *Pseudomonas fluorescens* and *Rhizobacteria.*

Nutrients

In other embodiments, the seed coating composition can comprise a nutrient. The nutrient can be selected from the group consisting of a nitrogen fertilizer including, but not limited to Urea, Ammonium nitrate, Ammonium sulfate, Non-pressure nitrogen solutions, Aqua ammonia, Anhydrous ammonia, Ammonium thiosulfate, Sulfur-coated urea, Urea-formaldehydes, IBDU, Polymer-coated urea, Calcium nitrate, Ureaform, and Methylene urea, phosphorous fertilizers such as Diammonium phosphate, Monoammonium phosphate, Ammonium polyphosphate, Concentrated superphosphate and Triple superphosphate, and potassium fertilizers such as Potassium chloride, Potassium sulfate, Potassium-magnesium sulfate, Potassium nitrate. Such compositions can exist as free salts or ions within the seed coat composition. Alternatively, nutrients/fertilizers can be complexed or chelated to provide sustained release over time.

Rodenticides

Rodents such as mice and rats cause considerable economical damage by eating and soiling planted or stored seeds. Moreover, mice and rats transmit a large number of infectious diseases such as plague, typhoid, leptospirosis, trichinosis and salmonellosis. Anticoagulants such as coumarin and indandione derivatives play an important role in the control of rodents. These active ingredients are simple to handle, relatively harmless to humans and have the advantage that, as the result of the delayed onset of the activity, the animals being controlled identify no connection with the bait that they have ingested, therefore do not avoid it. This is an important aspect in particular in social animals such as rats, where individuals act as tasters. In some embodiments, the seed coating composition comprises a rodenticide selected from the group of substances consisting of 2-isovalerylindan-1,3-dione, 4-(quinoxalin-2-ylamino)benzenesulfonamide, alpha-chlorohydrin, aluminum phosphide, antu, arsenous oxide, barium carbonate, bisthiosemi, brodifacoum, bromadiolone, bromethalin, calcium cyanide, chloralose, chlorophacinone, cholecalciferol, coumachlor, coumafuryl, coumatetralyl, crimidine, difenacoum, difethialone, diphacinone, ergocalciferol, flocoumafen, fluoroacetamide, flupropadine, flupropadine hydrochloride, hydrogen cyanide, iodomethane, lindane, magnesium phosphide, methyl bromide, norbormide, phosacetim, phosphine, phosphorus, pindone, potassium arsenite, pyrinuron, scilliroside, sodium arsenite, sodium cyanide, sodium fluoroacetate, strychnine, thallium sulfate, warfarin and zinc phosphide.

Compatibility

In some embodiments, a single endophyte strain or a plurality of endophytes that are compatible with agrichemicals can be used to inoculate the plants according to the methods described herein. In each case below, each single endophyte strain or each type of endophyte used in a plurality of endophytes can be tested for compatibility on their own or as the plurality. Endophytes that are compatible with agriculturally employed anticomplex agents can be isolated by plating a culture of endophytes on a petri dish comprising an effective concentration of the anticomplex agent, and isolating colonies of endophytes that are compatible with the anticomplex agent. In other embodiments, a plurality of endophytes that are compatible with an anticomplex agent are used for the methods described herein.

In some embodiments, the endophytes of the present invention display tolerance to an agrichemical selected from the group consisting of: Aeris®, Avicta® DuoCot 202, Cruiser®, Syntenta CCB® (A), Clariva®, Albaugh, Dynasty®, Apron®, Maxim®, Gaucho®, Provoke® ST, Syngenta CCB®, Trilex®, WG Purple, WG Silver, Azoxystrobin, Carboxin, Difenoconazole, Fludioxonil, fluxapyroxad, Ipconazole, Mefenoxam, Metalaxyl, Myclobutanil, Penflufen, pyraclostrobin, Sedaxane, TCMTB, Tebuconazole, Thiram, Triadimenol (Baytan®), Trifloxystrobin, Triticonazole, Tolclofos-methyl, PCNB, Abamectin, Chlorpyrifos, Clothianidin, Imidacloprid, Thiamethoxam, and Thiodicarb.

Bactericide-compatible endophytes can also be isolated by selection on liquid medium. The culture of endophytes can be plated on petri dishes without any forms of mutagenesis; alternatively, endophytes can be mutagenized using any means known in the art. For example, endophyte cultures can be exposed to UV light, gamma-irradiation, or chemical mutagens such as ethylmethanesulfonate (EMS), ethidium bromide (EtBr) dichlovos (DDVP, methyl methane sulphonale (MMS), triethylphosphate (TEP), trimethylphosphate (TMP), nitrous acid, or DNA base analogs, prior to selection on fungicide comprising media. Finally, where the mechanism of action of a particular bactericide is known, the target gene can be specifically mutated (either by gene deletion, gene replacement, site-directed mutagenesis, etc.) to generate a plurality of endophytes that are resilient against that particular chemical. It is noted that the above-described methods can be used to isolate endophytes that are compatible with both bacteriostatic and bactericidal compounds.

It will also be appreciated by one skilled in the art that a plant may be exposed to multiple types of anticomplex compounds, either simultaneously or in succession, for example at different stages of plant growth. Where the target plant is likely to be exposed to multiple anticomplex agents, a plurality of endophytes that are compatible with many or all of these agrichemicals can be used to inoculate the plant. Endophytes that are compatible with several agents can be isolated, for example, by serial selection. Endophytes that are compatible with the first agent can be isolated as described above (with or without prior mutagenesis). A culture of the resulting endophytes can then be selected for the ability to grow on liquid or solid media comprising the second agent (again, with or without prior mutagenesis). Colonies isolated from the second selection are then tested to confirm its compatibility to both agents.

Likewise, endophytes that are compatible to biocides (including herbicides such as glyphosate or anticomplex compounds, whether bacteriostatic or bactericidal) that are agriculturally employed can be isolated using methods similar to those described for isolating compatible endophytes. In some embodiments, mutagenesis of the endophytes can be performed prior to selection with an anticomplex agent. In other embodiments, selection is performed on the endophytes without prior mutagenesis. In still another embodiment, serial selection is performed on endophytes: the endophytes are first selected for compatibility to a first anticomplex agent. The isolated compatible endophytes are then cultured and selected for compatibility to the second anticomplex agent. Any colony thus isolated is tested for compatibility to each, or both anticomplex agents to confirm compatibility with these two agents.

Compatibility with an antimicrobial agent can be determined by a number of means known in the art, including the comparison of the minimal inhibitory concentration (MIC) of the unmodified and modified endophytes. Therefore, in some embodiments, the present invention discloses modified endophytes, wherein the endophytes are modified such that they exhibits at least 3 fold greater, for example, at least 5 fold greater, between 5 and 10 fold greater, at least 10 fold greater, between 10 and 20 fold greater, at least 20 fold greater, between 20 and 30 fold greater, at least 30 fold greater or more MIC to an antimicrobial agent when compared with the unmodified endophytes.

In some embodiments, disclosed herein are endophytes with enhanced compatibility to the herbicide glyphosate. In some embodiments, the endophytes have a doubling time in growth medium comprising least 1 mM glyphosate, for example, between 1 mM and 2 mM glyphosate, at least 2 mM glyphosate, between 2 mM and 5 mM glyphosate, at least 5 mM glyphosate, between 5 mM and 10 mM glyphosate, at least 10 mM glyphosate, between 10 mM and 15 mM glyphosate, at least 15 mM glyphosate or more, that is no more than 250%, between 250% and 100%, for example, no more than 200%, between 200% and 175%, no more than 175%, between 175% and 150%, no more than 150%, between 150% and 125%, or no more than 125%, of the doubling time of the endophytes in the same growth medium comprising no glyphosate. In some embodiments, the endophytes have a doubling time in growth medium comprising 5 mM glyphosate that is no more than 150% the doubling time of the endophytes in the same growth medium comprising no glyphosate.

In other embodiments, the endophytes have a doubling time in a plant tissue comprising at least 10 ppm glyphosate, for example, between 10 and 15 ppm, at least 15 ppm glyphosate, between 15 and 10 ppm, at least 20 ppm glyphosate, between 20 and 30 ppm, at least 30 ppm glyphosate, between 30 and 40 ppm, at least 40 ppm glyphosate or more, that is no more than 250%, between 250% and 200%, for example, no more than 200%, between 200% and 175%, no more than 175%, between 175% and 150%, no more than 150%, between 150% and 125%, of the doubling time of the endophytes in a reference plant tissue comprising no glyphosate. In some embodiments, the endophytes have a doubling time in a plant tissue comprising 40 ppm glyphosate that is no more than 150% the doubling time of the endophytes in a reference plant tissue comprising no glyphosate.

The selection process described above can be repeated to identify isolates of endophytes that are compatible with a multitude of agents.

Candidate isolates can be tested to ensure that the selection for agrichemical compatibility did not result in loss of a desired bioactivity. Isolates of endophytes that are compatible with commonly employed agents can be selected as described above. The resulting compatible endophytes can be compared with the parental endophytes on plants in its ability to promote germination.

The agrichemical compatible endophytes generated as described above can be detected in samples. For example, where a transgene was introduced to render the endophytes compatible with the agrichemical(s), the transgene can be used as a target gene for amplification and detection by PCR. In addition, where point mutations or deletions to a portion of a specific gene or a number of genes results in compatibility with the agrichemical(s), the unique point mutations can likewise be detected by PCR or other means known in the art. Such methods allow the detection of the endophytes even if they is no longer viable. Thus, commodity plant products produced using the agrichemical compatible endophytes described herein can readily be identified by employing these and related methods of nucleic acid detection.

Populations of Plant Elements

The synthetic combinations of the present invention may be confined within an object selected from the group consisting of: bottle, jar, ampule, package, vessel, bag, box, bin, envelope, carton, container, silo, shipping container, truck bed, and case. In a particular embodiment, the population of plant elements is packaged in a bag or container suitable for commercial sale. For example, a bag contains a unit weight or count of the plant elements comprising a plurality of endophytes as described herein, and further comprises a label. In one embodiment, the bag or container contains at least 100 plant elements, between 100 and 1,000 plant elements, 1,000 plant elements, between 1,000 and 5,000 plant elements, for example, at least 5,000 plant elements, between 5,000 and 10,000 plant elements, at least 10,000 plant elements, between 10,000 and 20,000 plant elements, at least 20,000 plant elements, between 20,000 and 30,000 plant elements, at least 30,000 plant elements, between 30,000 and 50,000 plant elements, at least 50,000 plant elements, between 50,000 and 70,000 plant elements, at least 70,000 plant elements, between 70,000 and 80,000 plant elements, at least 80,000 plant elements, between 80,000 and 90,000, at least 90,000 plant elements or more. In another embodiment, the bag or container can comprise a discrete weight of plant elements, for example, at least 1 lb, between 1 and 2 lbs, at least 2 lbs, between 2 and 5 lbs, at least 5 lbs, between 5 and 10 lbs, at least 10 lbs, between 10 and 30 lbs, at least 30 lbs, between 30 and 50 lbs, at least 50 lbs, between 50 and 70 lmbs, at least 70 lbs or more. The label can contain additional information, for example, the information selected from the group consisting of: net weight, lot number, geographic origin of the plant elements, test date, germination rate, inert matter content, and the amount of noxious weeds, if any. Suitable containers or packages include those traditionally used in plant plant element commercialization. The invention also contemplates other containers with more sophisticated storage capabilities (e.g., with microbiologically tight wrappings or with gas- or water-proof containments).

In some cases, a sub-population of plant elements comprising a plurality of endophytes is further selected on the basis of increased uniformity, for example, on the basis of uniformity of microbial population. For example, individual plant elements of pools collected from individual cobs, individual plants, individual plots (representing plants inoculated on the same day) or individual fields can be tested for uniformity of microbial density, and only those pools meeting specifications (e.g., at least 80% of tested plant elements have minimum density, as determined by quantitative methods described elsewhere) are combined to provide the agricultural plant element sub-population.

The methods described herein can also comprise a validating step. The validating step can entail, for example, growing some plant elements collected from the inoculated plants into mature agricultural plants, and testing those individual plants for uniformity. Such validating step can be performed on individual plant elements collected from cobs, individual plants, individual plots (representing plants inoculated on the same day) or individual fields, and tested as described above to identify pools meeting the required specifications.

In some embodiments, methods described herein include planting a synthetic composition described herein. Suitable planters include an air seeder and/or fertilizer apparatus used in agricultural operations to apply particulate materials including one or more of the following, seed, fertilizer and/or inoculants, into soil during the planting operation.

Seeder/fertilizer devices can include a tool bar having ground-engaging openers thereon, behind which is towed a wheeled cart that includes one or more containment tanks or bins and associated metering means to respectively contain and meter therefrom particulate materials.

In certain embodiments, a composition described herein may be in the form of a liquid, a slurry, a solid, or a powder (wettable powder or dry powder). In another embodiment, a composition may be in the form of a seed coating. Compositions in liquid, slurry, or powder (e.g., wettable powder) form may be suitable for coating plant elements. When used to coat plant elements, the composition may be applied to the plant elements and allowed to dry. In embodiments wherein the composition is a powder (e.g., a wettable powder), a liquid, such as water, may need to be added to the powder before application to a seed.

In still another embodiment, the methods can include introducing into the soil an inoculum of one or more of the endophyte populations described herein. Such methods can include introducing into the soil one or more of the compositions described herein. The inoculum(s) or compositions may be introduced into the soil according to methods known to those skilled in the art. Non-limiting examples include in-furrow introduction, spraying, coating seeds, foliar introduction, etc. In a particular embodiment, the introducing step comprises in-furrow introduction of the inoculum or compositions described herein.

In one embodiment, plant elements may be treated with composition(s) described herein in several ways but preferably via spraying or dripping. Spray and drip treatment may be conducted by formulating compositions described herein and spraying or dripping the composition(s) onto a seed(s) via a continuous treating system (which is calibrated to apply treatment at a predefined rate in proportion to the continuous flow of seed), such as a drum-type of treater. Batch systems, in which a predetermined batch size of seed and composition(s) as described herein are delivered into a mixer, may also be employed.

In another embodiment, the treatment entails coating plant elements. One such process involves coating the inside wall of a round container with the composition(s) described herein, adding plant elements, then rotating the container to cause the plant elements to contact the wall and the composition(s), a process known in the art as "container coating". Plant elements can be coated by combinations of coating methods. Soaking typically entails using liquid forms of the compositions described. For example, plant elements can be soaked for about 1 minute to about 24 hours (e.g., for at least 1 min, between 1 and 5 min, 5 min, between 5 and 10 min, 10 min, between 10 and 20 min, 20 min, between 20 and 40 min, 40 min, between 40 and 80 min, 80 min, between 80 min and 3 hrs, 3 hrs, between 3 hrs and 6 hrs, 6 hr, between 6 hrs and 12 hrs, 12 hr, between 12 hrs and 24 hrs, or at least 24 hrs).

Throughout the specification, the word "comprise," or variations such as "comprises" or "comprising," will be understood to imply the inclusion of a stated integer or group of integers but not the exclusion of any other integer or group of integers.

Although the present invention has been described in detail with reference to examples below, it is understood that various modifications can be made without departing from the spirit of the invention. For instance, while the particular examples below may illustrate the methods and embodiments described herein using a specific plant, the principles in these examples may be applied to any agricultural crop. Therefore, it will be appreciated that the scope of this invention is encompassed by the embodiments of the inventions recited herein and the specification rather than the specific examples that are exemplified below.

EXAMPLES

Example 1: Cultivation-Independent Analysis of Microbial Taxa in Agriculturally Relevant Seed Communities Based on Marker Gene High-Throughput Sequencing Example Description Microbial taxa found in agriculturally relevant communities were identified using high-throughput marker gene sequencing across several crops and numerous varieties of seeds.

Experimental Description

To identify core (i.e. ubiquitous) microbial taxa across seeds, we used high-throughput sequencing of marker genes for bacteria, archaea, and fungi.

Cereals 2 inbred, 10 landrace, 4 teosinte corn seeds, and 4 modern and 4 wild wheat seeds were obtained. Accessions were categorized into landrace, wild, and inbred varieties based on their assessment of improvement status. In order to extract microbial DNA, the seeds were first sterilized in one of four different manners. Some of the seeds were surface sterilized using 95% ethanol to reduce superficial contaminant microbes, then rinsed in water. Others were first soaked in sterile, DNA-free water for 48 hours to soften them, and they were surface sterilized using 95% ethanol to reduce superficial contaminant microbes, then rinsed in water. Others were rinsed in deionized water, immersed in 95% ethanol for 5 seconds, 0.5% NaOCl for 2 minutes, 70% ethanol for 2 minutes, and then washed three times in deionized water for 1 minute each.

Grasslands

To identify microbial taxa from seeds of wild grassland plants, we used high-throughput sequencing of marker genes for bacteria, archaea, and fungi. Seeds from the following wild grassland species were obtained: Big bluestem, Side oats grama, Bicknell's sedge, Short beak sedge, Canada wild rye, Virginia wild rye, June grass, Leafy satin grass, Switch grass, Little bluestem, Prairie cord grass, Prairie dropseed, Nodding wild onion, Meadow/Canada anemone, Common milkweed, Butterfly weed, Whorled milkweed, New England aster, False boneset, Tall coreopsis, Shooting star, Pale purple coneflower, Rattlesnake master, Tall boneset, Purple joe pye weed, Biennial gaure, Prairie smoke, False sunflower, Rough blazing star, Wild bergamot, Horse mint, Common evening primrose, Wild quinine, Beardtongue, Yellow coneflower, Black-eyed Susan, Sweet black-eyed susan, Compass plant, Prairie dock, Stiff goldenrod, Showy goldenrod, Hairy aster, Hoary vervain, Culver's root, Golden alexanders, Dogtooth daisy, Wild blue iris, Pointed broom sedge, Dark green bulrush, and Blue vervain. In order to extract microbial DNA, the seeds were first soaked in sterile, DNA-free water for 48 h to soften them, and they were surface sterilized using 95% ethanol to reduce superficial contaminant microbes, then rinsed in water.

Fruits and Vegetables

Seeds from 22 different varieties of cabbage were obtained, including broccoli, cauliflower, and collards. In addition, seeds from 8 different varieties of lettuce, 9 varieties of melon (including cantaloupe and honeydew), 7 varieties of onions (including cippolini, shallots, and vidalia), 4 varieties of tomatoes, one variety of toria, 4 varieties of turnip, 7 varieties of watermelon, and one variety of yellow sarcon were obtained. For strawberries, the seeds or runner plant tissue of 9 varieties were obtained. For sterilization, the seeds were first soaked in sterile, DNA-free water for 48 h to soften them, and they were surface sterilized using 95% ethanol to reduce superficial contaminant microbes, then rinsed in water. Strawberry tissue was surface sterilized using 95% ethanol, then rinsed in water.

Oilseed

Seeds from 1 wild and 3 modern cultivars of *Brassica Napus* were also obtained. In order to extract microbial DNA, the seeds were first soaked in sterile, DNA-free water for 48 h to soften them, and they were surface sterilized using 95% ethanol to reduce superficial contaminant microbes, then rinsed in water.

The seeds or tissues from all of the plants described above were then ground using a mortar and pestle treated with 95% ethanol and RNAse Away (Life Technologies, Inc., Grand Island, N.Y.) to remove contaminant DNA. DNA was extracted from the ground seeds using the PowerPlant Pro DNA extraction kit (Mo Bio Laboratories, Inc., Carlsbad, Calif.) according to the manufacturer's instructions. The surface wash off from certain sterilization treatments of cereal seeds was also collected and DNA was extracted as above.

Marker genes were amplified and sequenced from the extracted DNA. For the bacterial and archaeal analyses, the V4 hypervariable region of the 16S rRNA gene was targeted (primers 515f/806r), and for fungi, the first internal transcribed spacer (ITS1) region of the rRNA operon (primers ITS1f/ITS2r) was targeted. The two marker genes were PCR amplified separately using 35 cycles, and error-correcting 12-bp barcoded primers specific to each sample were used to facilitate combining of samples. To reduce the amplification of chloroplast and mitochondrial DNA, PNA clamps specific to the rRNA genes in these organelles were used. PCR reactions to amplify 16S rRNA genes followed the protocol of (Lundberg et al. 2013), and those to amplify ITS regions followed the protocol of (Fierer et al. 2012). PCR products were quantified using the PicoGreen assay (Life Technologies, Inc., Grand Island, N.Y.), pooled in equimolar concentrations, and cleaned using the UltraClean kit (Mo Bio Laboratories, Inc., Carlsbad, Calif.). Cleaned DNA pools were sequenced on an Illumina MiSeq instrument at the University of Colorado Next Generation Sequencing Facility.

OTU Assignment

For both 16S rRNA and ITS1 sequences, the raw sequence data were reassigned to distinct samples using a custom Python script, and quality filtering and OTU (i.e. operational taxonomic unit) clustering was conducted using the UPARSE pipeline (Edgar 2013). Briefly, a de novo sequence database with representative sequences for each OTU was created using a 97% similarity threshold, and raw reads were mapped to this database to calculate sequence counts per OTU per sample. Prior to creating the database, sequences were quality filtered using an expected error frequency threshold of 0.5 errors per sequence. In addition, sequences were dereplicated and singletons were removed prior to creating the database. OTUs were provided taxonomic classifications using the RDP classifier (Wang et al. 2007) trained with the Greengenes (McDonald et al. 2012) and UNITE (Abarenkov et al. 2010) databases for 16S rRNA and ITS sequences, respectively. To account for differences in the variable number of sequences per sample, each sample was rarefied to 1000 16S rRNA and 1000 ITS sequences per sample. OTUs classified as chloroplasts or mitochondria were discarded prior to rarefaction.

Overall differences in bacterial community composition between the control and inoculated plants were evaluated using non-metric multidimensional scaling based on Bray-Curtis dissimilarities in order to visualize pairwise differences between sample communities. Permutational analysis of variance (PERMANOVA) was used to statistically test the significance of these differences. Analyses were conducted using the vegan package in R (R Core Team 2013). To determine the OTUs contributing to overall differences among crop types, mean relative abundances were calculated for each OTU within each crop type. Only OTUs with a mean relative abundance of 0.1% in either group were included in this analysis.

Results

Across seeds from all plants analyzed herein, a total of 144 bacterial and 145 fungal OTUs were detected and evaluated (Table 3 and Table 4) following stringent sequence quality filtering approach. Among all OTUs, 28 bacterial OTUs and 20 fungal OTUs were found to be core taxa within seeds across plants (Table 1 and Table 2).

TABLE 3

Exemplary bacterial endophytes present in all plants.

| OTU_ID | SEQ ID NO | Phylum | Class | Order | Family | Genus | Species |
|---|---|---|---|---|---|---|---|
| OTU_558 | 1 | OD1 | ABY1 | | | | |
| OTU_762 | 2 | Actinobacteria | Actinobacteria | Actinomycetales | Microbacteriaceae | | |
| OTU_136 | 3 | Actinobacteria | Actinobacteria | Actinomycetales | Streptomycetaceae | | *Streptomyces* |
| OTU_161 | 4 | Actinobacteria | Actinobacteria | Actinomycetales | Corynebacteriaceae | | *Corynebacterium* |
| OTU_309 | 5 | Actinobacteria | Actinobacteria | Actinomycetales | Corynebacteriaceae | | *Corynebacterium* |
| OTU_63 | 6 | Actinobacteria | Actinobacteria | Actinomycetales | Geodermatophilaceae | | |
| OTU_67 | 7 | Actinobacteria | Actinobacteria | Actinomycetales | Sanguibacteraceae | | *Sanguibacter* |
| OTU_1203 | 8 | Actinobacteria | Actinobacteria | Actinomycetales | Microbacteriaceae | *Rathayibacter* | *caricis* |
| OTU_364 | 9 | Actinobacteria | Actinobacteria | Actinomycetales | Micrococcaceae | *Microbispora* | *rosea* |
| OTU_130 | 10 | Actinobacteria | Actinobacteria | Actinomycetales | Nocardiaceae | *Rhodococcus* | *fascians* |
| OTU_74 | 11 | Actinobacteria | Actinobacteria | Actinomycetales | Kineosporiaceae | *Kineococcus* | |
| OTU_41 | 12 | Actinobacteria | Actinobacteria | Actinomycetales | Microbacteriaceae | | |
| OTU_24 | 13 | Actinobacteria | Actinobacteria | Actinomycetales | Microbacteriaceae | | |
| OTU_1230 | 14 | Proteobacteria | Alphaproteobacteria | Sphingomonadales | Sphingomonadaceae | | |
| OTU_30 | 15 | Proteobacteria | Alphaproteobacteria | Caulobacterales | Caulobacteraceae | *Mycoplana* | |
| OTU_799 | 16 | Proteobacteria | Alphaproteobacteria | Rhizobiales | Rhizobiaceae | | *Agrobacterium* |
| OTU_101 | 17 | Proteobacteria | Alphaproteobacteria | Rhizobiales | Aurantimonadaceae | | |
| OTU_572 | 18 | Proteobacteria | Alphaproteobacteria | Rhizobiales | Phyllobacteriaceae | | *Mesorhizobium* |

TABLE 3-continued

Exemplary bacterial endophytes present in all plants.

| OTU_ID | SEQ ID NO | Phylum | Class | Order | Family | Genus | Species |
|---|---|---|---|---|---|---|---|
| OTU_153 | 19 | Proteobacteria | Alphaproteobacteria | Rhizobiales | Hyphomicrobiaceae | *Devosia* | |
| OTU_140 | 20 | Proteobacteria | Alphaproteobacteria | Sphingomonadales | Sphingomonadaceae | *Sphingomonas* | |
| OTU_194 | 21 | Proteobacteria | Alphaproteobacteria | Rhizobiales | Methylocystaceae | | |
| OTU_158 | 22 | Proteobacteria | Alphaproteobacteria | Caulobacterales | Caulobacteraceae | | |
| OTU_124 | 23 | Proteobacteria | Alphaproteobacteria | Sphingomonadales | Sphingomonadaceae | *Sphingomonas* | *wittichii* |
| OTU_188 | 24 | Proteobacteria | Alphaproteobacteria | Rhodospirillales | Acetobacteraceae | | |
| OTU_1287 | 25 | Proteobacteria | Alphaproteobacteria | Sphingomonadales | Sphingomonadaceae | *Novosphingobium* | |
| OTU_971 | 26 | Proteobacteria | Alphaproteobacteria | Rhodobacterales | Rhodobacteraceae | *Rhodobacter* | |
| OTU_20 | 27 | Proteobacteria | Alphaproteobacteria | Rhizobiales | Aurantimonadaceae | | |
| OTU_57 | 28 | Proteobacteria | Alphaproteobacteria | Sphingomonadales | Sphingomonadaceae | *Novosphingobium* | |
| OTU_49 | 29 | Proteobacteria | Alphaproteobacteria | Rhizobiales | Methylobacteriaceae | | |
| OTU_1222 | 30 | Proteobacteria | Alphaproteobacteria | Sphingomonadales | Sphingomonadaceae | *Sphingomonas* | |
| OTU_80 | 31 | Proteobacteria | Alphaproteobacteria | Sphingomonadales | Sphingomonadaceae | *Sphingomonas* | |
| OTU_436 | 32 | Proteobacteria | Alphaproteobacteria | Sphingomonadales | Sphingomonadaceae | *Sphingomonas* | |
| OTU_1077 | 33 | Proteobacteria | Alphaproteobacteria | Rhizobiales | Methylobacteriaceae | *Methylobacterium* | *adhaesivum* |
| OTU_510 | 34 | Proteobacteria | Alphaproteobacteria | Rhodospirillales | Rhodospirillaceae | *Azospirillum* | |
| OTU_43 | 35 | Proteobacteria | Alphaproteobacteria | Rhizobiales | Methylobacteriaceae | *Methylobacterium* | *adhaesivum* |
| OTU_65 | 36 | Proteobacteria | Alphaproteobacteria | Rhodospirillales | Acetobacteraceae | | |
| OTU_64 | 37 | Proteobacteria | Alphaproteobacteria | Sphingomonadales | Sphingomonadaceae | *Sphingomonas* | *wittichii* |
| OTU_27 | 38 | Proteobacteria | Alphaproteobacteria | Sphingomonadales | Sphingomonadaceae | *Sphingomonas* | |
| OTU_47 | 39 | Proteobacteria | Alphaproteobacteria | Rhizobiales | Methylobacteriaceae | *Methylobacterium* | |
| OTU_15 | 40 | Proteobacteria | Alphaproteobacteria | Rhizobiales | Rhizobiaceae | *Agrobacterium* | |
| OTU_956 | 41 | Proteobacteria | Alphaproteobacteria | Rhizobiales | Methylobacteriaceae | *Methylobacterium* | *adhaesivum* |
| OTU_21 | 42 | Proteobacteria | Alphaproteobacteria | Rhizobiales | Methylobacteriaceae | *Methylobacterium* | |
| OTU_14 | 43 | Proteobacteria | Alphaproteobacteria | Sphingomonadales | Sphingomonadaceae | *Sphingomonas* | |
| OTU_6 | 44 | Proteobacteria | Alphaproteobacteria | Sphingomonadales | Sphingomonadaceae | *Sphingomonas* | |
| OTU_1436 | 45 | Proteobacteria | Alphaproteobacteria | Sphingomonadales | Sphingomonadaceae | *Sphingomonas* | |
| OTU_61 | 46 | Firmicutes | Bacilli | Bacillales | Paenibacillaceae | *Paenibacillus* | |
| OTU_77 | 47 | Firmicutes | Bacilli | Lactobacillales | Leuconostocaceae | *Leuconostoc* | |
| OTU_358 | 48 | Firmicutes | Bacilli | Bacillales | Bacillaceae | *Bacillus* | *badius* |
| OTU_353 | 49 | Firmicutes | Bacilli | Bacillales | Paenibacillaceae | *Paenibacillus* | |
| OTU_1250 | 50 | Firmicutes | Bacilli | Bacillales | Planococcaceae | *Sporosarcina* | *ginsengi* |
| OTU_84 | 51 | Firmicutes | Bacilli | Bacillales | Bacillaceae | | |
| OTU_34 | 52 | Firmicutes | Bacilli | Bacillales | Bacillaceae | *Bacillus* | *cereus* |
| OTU_98 | 53 | Firmicutes | Bacilli | Bacillales | Paenibacillaceae | *Paenibacillus* | |
| OTU_152 | 54 | Firmicutes | Bacilli | Bacillales | Paenibacillaceae | *Paenibacillus* | |
| OTU_1178 | 55 | Firmicutes | Bacilli | Bacillales | Planococcaceae | *Planomicrobium* | |
| OTU_299 | 56 | Firmicutes | Bacilli | Lactobacillales | Leuconostocaceae | *Leuconostoc* | |
| OTU_241 | 57 | Firmicutes | Bacilli | Lactobacillales | Carnobacteriaceae | *Carnobacterium* | |
| OTU_203 | 58 | Firmicutes | Bacilli | Lactobacillales | Streptococcaceae | *Lactococcus* | |
| OTU_25 | 59 | Firmicutes | Bacilli | Bacillales | Paenibacillaceae | | |
| OTU_17 | 60 | Firmicutes | Bacilli | Bacillales | Bacillaceae | *Bacillus* | |
| OTU_330 | 61 | Firmicutes | Bacilli | Lactobacillales | Lactobacillaceae | | |
| OTU_211 | 62 | Firmicutes | Bacilli | Lactobacillales | Enterococcaceae | *Enterococcus* | |
| OTU_108 | 63 | Firmicutes | Bacilli | Bacillales | Staphylococcaceae | *Staphylococcus* | |
| OTU_19 | 64 | Firmicutes | Bacilli | Bacillales | Paenibacillaceae | *Paenibacillus* | *amylolyticus* |
| OTU_16 | 65 | Firmicutes | Bacilli | Bacillales | [Exiguobacteraceae] | *Exiguobacterium* | |
| OTU_372 | 66 | Firmicutes | Bacilli | Bacillales | Sporolactobacillaceae | *Bacillus* | *racemilacticus* |
| OTU_222 | 67 | Firmicutes | Bacilli | Bacillales | Bacillaceae | *Geobacillus* | |
| OTU_653 | 68 | Firmicutes | Bacilli | Bacillales | Bacillaceae | *Bacillus* | *endophyticus* |
| OTU_11 | 69 | Firmicutes | Bacilli | Bacillales | Paenibacillaceae | *Paenibacillus* | |
| OTU_71 | 70 | Firmicutes | Bacilli | Bacillales | Paenibacillaceae | *Saccharibacillus* | *kuerlensis* |
| OTU_13 | 71 | Firmicutes | Bacilli | Bacillales | Bacillaceae | *Bacillus* | *flexus* |
| OTU_10 | 72 | Firmicutes | Bacilli | Bacillales | Planococcaceae | *Sporosarcina* | *ginsengi* |
| OTU_118 | 73 | Proteobacteria | Betaproteobacteria | Burkholderiales | Comamonadaceae | *Comamonas* | |
| OTU_676 | 74 | Proteobacteria | Betaproteobacteria | Burkholderiales | Comamonadaceae | *Limnohabitans* | |
| OTU_1014 | 75 | Proteobacteria | Betaproteobacteria | Burkholderiales | Oxalobacteraceae | *Janthinobacterium* | |
| OTU_26 | 76 | Proteobacteria | Betaproteobacteria | Burkholderiales | Oxalobacteraceae | | |
| OTU_182 | 77 | Proteobacteria | Betaproteobacteria | Burkholderiales | Alcaligenaceae | *Pigmentiphaga* | |
| OTU_980 | 78 | Proteobacteria | Betaproteobacteria | Burkholderiales | Oxalobacteraceae | *Janthinobacterium* | *lividum* |
| OTU_35 | 79 | Proteobacteria | Betaproteobacteria | Burkholderiales | Comamonadaceae | *Polaromonas* | |
| OTU_1226 | 80 | Proteobacteria | Betaproteobacteria | Burkholderiales | Comamonadaceae | | |
| OTU_1068 | 81 | Proteobacteria | Betaproteobacteria | Burkholderiales | Oxalobacteraceae | | |
| OTU_1252 | 82 | Proteobacteria | Betaproteobacteria | Burkholderiales | Comamonadaceae | | |
| OTU_113 | 83 | Proteobacteria | Betaproteobacteria | Burkholderiales | Oxalobacteraceae | *Janthinobacterium* | |
| OTU_39 | 84 | Proteobacteria | Betaproteobacteria | Burkholderiales | Comamonadaceae | | |
| OTU_345 | 85 | Proteobacteria | Betaproteobacteria | Burkholderiales | Oxalobacteraceae | *Ralstonia* | |
| OTU_168 | 86 | Proteobacteria | Betaproteobacteria | Burkholderiales | Comamonadaceae | | |
| OTU_7 | 87 | Proteobacteria | Betaproteobacteria | Burkholderiales | Oxalobacteraceae | *Janthinobacterium* | |
| OTU_1344 | 88 | Proteobacteria | Betaproteobacteria | Burkholderiales | Oxalobacteraceae | | |
| OTU_87 | 89 | Firmicutes | Clostridia | Clostridiales | Clostridiaceae | *Clostridium* | *butyricum* |
| OTU_206 | 90 | Firmicutes | Clostridia | Clostridiales | Clostridiaceae | *Clostridium* | *intestinale* |
| OTU_258 | 91 | Firmicutes | Clostridia | Clostridiales | Clostridiaceae | | |

TABLE 3-continued

Exemplary bacterial endophytes present in all plants.

| OTU_ID | SEQ ID NO | Phylum | Class | Order | Family | Genus | Species |
|---|---|---|---|---|---|---|---|
| OTU_342 | 92 | Firmicutes | Clostridia | Clostridiales | Clostridiaceae | *Thermoanaero-bacterium* | *saccharolyticum* |
| OTU_259 | 93 | Firmicutes | Clostridia | Thermoanaero-bacterales | Caldicell-ulosiruptoraceae | *Caldicellulosiruptor* | *saccharolyticus* |
| OTU_428 | 94 | Firmicutes | Clostridia | Thermoanaero-bacterales | Carboxydocellaceae | *Carboxydocella* | |
| OTU_485 | 95 | Bacteroidetes | Cytophagia | Cytophagales | Cytophagaceae | *Hymenobacter* | |
| OTU_1306 | 96 | Bacteroidetes | Cytophagia | Cytophagales | Cytophagaceae | *Hymenobacter* | |
| OTU_735 | 97 | Bacteroidetes | Cytophasia | Cytophagales | Cytophagaceae | *Hymenobacter* | |
| OTU_37 | 98 | Bacteroidetes | Cytophagia | Cytophagales | Cytophagaceae | *Hymenobacter* | |
| OTU_775 | 99 | Bacteroidetes | Cytophagia | Cytophagales | Cytophagaceae | *Hymenobacter* | |
| OTU_141 | 100 | Bacteroidetes | Cytophagia | Cytophagales | Cytophagaceae | *Hymenobacter* | |
| OTU_149 | 101 | Proteobacteria | Deltaproteobacteria | Myxococcales | Cystobacterineae | | |
| OTU_70 | 102 | Bacteroidetes | Flavobacteriia | Flavobacteriales | [Weeksellaceae] | *Chryseobacterium* | |
| OTU_23 | 103 | Bacteroidetes | Flavobacteriia | Flavobacteriales | [Weeksellaceae] | *Chryseobacterium* | |
| OTU_236 | 104 | Bacteroidetes | Flavobacteriia | Flavobacteriales | [Weeksellaceae] | *Chryseobacterium* | |
| OTU_148 | 105 | Bacteroidetes | Flavobacteriia | Flavobacteriales | [Weeksellaceae] | *Chryseobacterium* | |
| OTU_181 | 106 | Bacteroidetes | Flavobacteriia | Flavobacteriales | [Weeksellaceae] | *Chryseobacterium* | |
| OTU_347 | 107 | Proteobacteria | Gammaproteobacteria | Enterobacteriales | Enterobacteriaceae | | |
| OTU_1190 | 108 | Proteobacteria | Gammaproteobacteria | Enterobacteriales | Enterobacteriaceae | *Yersinia* | |
| OTU_1201 | 109 | Proteobacteria | Gammaproteobacteria | Enterobacteriales | Enterobacteriaceae | *Enterobacter* | *hormaechei* |
| OTU_679 | 110 | Proteobacteria | Gammaproteobacteria | Pseudomonadales | Pseudomonadaceae | *Pseudomonas* | *fragi* |
| OTU_234 | 111 | Proteobacteria | Gammaproteobacteria | Pseudomonadales | Pseudomonadaceae | | |
| OTU_46 | 112 | Proteobacteria | Gammaproteobacteria | Pseudomonadales | Moraxellaceae | *Acinetobacter* | *lwoffii* |
| OTU_1274 | 113 | Proteobacteria | Gammaproteobacteria | Xanthomonadales | Xanthomonadaceae | *Stenotrophomonas* | *maltophilia* |
| OTU_1303 | 114 | Proteobacteria | Gammaproteobacteria | Enterobacteriales | Enterobacteriaceae | | |
| OTU_401 | 115 | Proteobacteria | Gammaproteobacteria | Enterobacteriales | Enterobacteriaceae | | |
| OTU_1261 | 116 | Proteobacteria | Gammaproteobacteria | Enterobacteriales | Enterobacteriaceae | | |
| OTU_548 | 117 | Proteobacteria | Gammaproteobacteria | Xanthomonadales | Xanthomonadaceae | *Stenotrophomonas* | |
| OTU_132 | 118 | Proteobacteria | Gammaproteobacteria | Pseudomonadales | Pseudomonadaceae | *Pseudomonas* | *veronii* |
| OTU_1343 | 119 | Proteobacteria | Gammaproteobacteria | Pseudomonadales | Pseudomonadaceae | | |
| OTU_22 | 120 | Proteobacteria | Gammaproteobacteria | Pseudomonadales | Pseudomonadaceae | | |
| OTU_163 | 121 | Proteobacteria | Gammaproteobacteria | Xanthomonadales | Xanthomonadaceae | *Stenotrophomonas* | |
| OTU_771 | 122 | Proteobacteria | Gammaproteobacteria | Pseudomonadales | Pseudomonadaceae | *Pseudomonas* | |
| OTU_826 | 123 | Proteobacteria | Gammaproteobacteria | Pseudomonadales | Pseudomonadaceae | *Pseudomonas* | |
| OTU_166 | 124 | Proteobacteria | Gammaproteobacteria | Xanthomonadales | Xanthomonadaceae | *Xanthomonas* | |
| OTU_1441 | 125 | Proteobacteria | Gammaproteobacteria | Enterobacteriales | Enterobacteriaceae | | |
| OTU_1158 | 126 | Proteobacteria | Gammaproteobacteria | Enterobacteriales | Enterobacteriaceae | *Serratia* | *marcescens* |
| OTU_1083 | 127 | Proteobacteria | Gammaproteobacteria | Pseudomonadales | Pseudomonadaceae | | |
| OTU_8 | 128 | Proteobacteria | Gammaproteobacteria | Pseudomonadales | Pseudomonadaceae | | |
| OTU_18 | 129 | Proteobacteria | Gammaproteobacteria | Xanthomonadales | Xanthomonadaceae | *Xanthomonas* | *axonopodis* |
| OTU_51 | 130 | Proteobacteria | Gammaproteobacteria | Oceanospirillales | Halomonadaceae | *Halomonas* | |
| OTU_72 | 131 | Proteobacteria | Gammaproteobacteria | Pseudomonadales | Pseudomonadaceae | *Pseudomonas* | *viridiflava* |
| OTU_9 | 132 | Proteobacteria | Gammaproteobacteria | Pseudomonadales | Pseudomonadaceae | *Pseudomonas* | |
| OTU_696 | 133 | Proteobacteria | Gammaproteobacteria | Enterobacteriales | Enterobacteriaceae | *Escherichia* | *coli* |
| OTU_53 | 134 | Proteobacteria | Gammaproteobacteria | Enterobacteriales | Enterobacteriaceae | *Enterobacter* | |
| OTU_4 | 135 | Proteobacteria | Gammaproteobacteria | Enterobacteriales | Enterobacteriaceae | *Pantoea* | *agglomeraris* |
| OTU_220 | 136 | Tenericutes | Mollicutes | Anaeroplasmatales | Anaeroplasmataceae | *Asteroleplasma* | |
| OTU_343 | 137 | Bacteroidetes | Sphingobacteriia | Sphingobacteriales | Sphingobacteriaceae | | |
| OTU_82 | 138 | Bacteroidetes | Sphingobacteriia | Sphingobacteriales | Sphingobacteriaceae | *Pedobacter* | |
| OTU_69 | 139 | Bacteroidetes | Sphingobacteriia | Sphingobacteriales | Sphingobacteriaceae | | |
| OTU_36 | 140 | Bacteroidetes | Sphingobacteriia | Sphingobacteriales | Sphingobacteriaceae | *Pedobacter* | |
| OTU_1386 | 141 | Bacteroidetes | Sphingobacteriia | Sphingobacteriales | Sphingobacteriaceae | *Pedobacter* | |
| OTU_1165 | 142 | Bacteroidetes | Sphingobacteriia | Sphingobacteriales | Sphingobacteriaceae | *Pedobacter* | *cryoconitis* |
| OTU_368 | 143 | Bacteroidetes | Sphingobacteriia | Sphingobacteriales | Sphingobacteriaceae | *Pedobacter* | |
| OTU_91 | 144 | Cyanobacteria | | | | | |

TABLE 4

Exemplary fungal endophytes present in all plants

| OTU_ID | SEQ ID NO | Phylum | Class | Order | Family | Genus | Species |
|---|---|---|---|---|---|---|---|
| OTU_288 | 145 | Basidiomycota | Agaricomycetes | Corticiales | Corticiaceae | *Waitea* | *circinata* var *circinata* |
| OTU_327 | 146 | Basidiomycota | Agaricomycetes | Cantharellales | Ceratobasidiaceae | *Thanatephorus* | *cucumeris* |
| OTU_1 | 147 | Ascomycota | Dothideomycetes | Pleosporales | Pleosporaceae | *Alternaria* | sp MY_2011 |
| OTU_2 | 148 | Ascomycota | Dothideomycetes | Capnodiales | Mycosphaerellaceae | *Cladosporium* | |
| OTU_12 | 149 | Ascomycota | Dothideomycetes | Capnodiales | Davidiellaceae | *Davidiella* | *tassiana* |

TABLE 4-continued

Exemplary fungal endophytes present in all plants

| OTU_ID | SEQ ID NO | Phylum | Class | Order | Family | Genus | Species |
|---|---|---|---|---|---|---|---|
| OTU_9 | 150 | Ascomycota | Dothideomycetes | Pleosporales | Pleosporaceae | *Lewia* | *infectoria* |
| OTU_29 | 151 | Ascomycota | Dothideomycetes | Pleosporales | Pleosporaceae | *Epicoccum* | *nigrum* |
| OTU_15 | 152 | Ascomycota | Dothideomycetes | Pleosporales | Pleosporaceae | *Ulocladium* | |
| OTU_55 | 153 | Ascomycota | Dothideomycetes | Capnodiales | Davidiellaceae | *Cladosporium* | |
| OTU_10 | 154 | Ascomycota | Dothideomycetes | Pleosporales | Incertae sedis | *Phoma* | sp P48E5 |
| OTU_133 | 155 | Ascomycota | Dothideomycetes | Capnodiales | Davidiellaceae | *Cladosporium* | sp ascomyc1 |
| OTU_26 | 156 | Ascomycota | Dothideomycetes | Pleosporales | Phaeosphaeriaceae | unidentified | Phaeosphaeriaceae sp MJ23 |
| OTU_47 | 157 | Ascomycota | Dothideomycetes | | | | |
| OTU_24 | 158 | Ascomycota | Dothideomycetes | Pleosporales | Phaeosphaeriaceae | | |
| OTU_522 | 159 | Ascomycota | Dothideomycetes | Pleosporales | Phaeosphaeriaceae | *Ampelomyces* | *quisqualis* |
| OTU_66 | 160 | Ascomycota | Dothideomycetes | Pleosporales | Pleosporaceae | *Dendryphiella* | *arenaria* |
| OTU_23 | 161 | Ascomycota | Dothideomycetes | Capnodiales | Mycosphaerellaceae | *Septoria* | *phalaridis* |
| OTU_71 | 162 | Ascomycota | Dothideomycetes | Pleosporales | | | |
| OTU_27 | 163 | Ascomycota | Dothideomycetes | Pleosporales | Incertae sedis | | |
| OTU_32 | 164 | Ascomycota | Dothideomycetes | Dothideales | Dothioraceae | *Aureobasidium* | |
| OTU_20 | 165 | Ascomycota | Dothideomycetes | Pleosporales | Phaeosphaeriaceae | unidentified | Phaeosphaeriaceae sp MJ23 |
| OTU_16 | 166 | Ascomycota | Dothideomycetes | Pleosporales | Incertae sedis | *Phoma* | |
| OTU_44 | 167 | Ascomycota | Dothideomycetes | Capnodiales | Davidiellaceae | *Cladosporium* | sp 234B |
| OTU_38 | 168 | Ascomycota | Dothideomycetes | Pleosporales | Phaeosphaeriaceae | | |
| OTU_104 | 169 | Ascomycota | Dothideomycetes | Pleosporales | Pleosporaceae | *Alternaria* | *brassicicola* |
| OTU_1123 | 170 | Ascomycota | Dothideomycetes | Pleosporales | Phaeosphaeriaceae | unidentified | Phaeosphaeriaceae sp MJ23 |
| OTU_90 | 171 | Ascomycota | Dothideomycetes | Pleosporales | Phaeosphaeriaceae | *Ampelomyces* | *quisqualis* |
| OTU_48 | 172 | Ascomycota | Dothideomycetes | Incertae sedis | Incertae sedis | *Leptospora* | *rubella* |
| OTU_73 | 173 | Ascomycota | Dothideomycetes | Pleosporales | Incertae sedis | *Phoma* | *rhei* |
| OTU_1432 | 174 | Ascomycota | Dothideomycetes | Pleosporales | Leptosphaeriaceae | unidentified | uncultured *Epicoccum* |
| OTU_1095 | 175 | Ascomycota | Dothideomycetes | Pleosporales | Pleosporaceae | *Lewia* | *infectoria* |
| OTU_486 | 176 | Ascomycota | Dothideomycetes | Pleosporales | Phaeosphaeriaceae | *Parastagonospora* | *caricis* |
| OTU_110 | 177 | Ascomycota | Dothideomycetes | Capnodiales | Davidiellaceae | *Cladosporium* | sp ascomyc1 |
| OTU_78 | 178 | Ascomycota | Dothideomycetes | Pleosporales | Phaeosphaeriaceae | *Phaeosphaeria* | |
| OTU_83 | 179 | Ascomycota | Dothideomycetes | unidentified | unidentified | unidentified | Dothideomycetes sp |
| OTU_815 | 180 | Ascomycota | Dothideomycetes | Pleosporales | Pleosporaceae | *Alternaria* | sp MY_2011 |
| OTU_244 | 181 | Ascomycota | Dothideomycetes | Capnodiales | Davidiellaceae | *Cladosporium* | *sphaerospermum* |
| OTU_775 | 182 | Ascomycota | Dothideomycetes | Pleosporales | Pleosporaceae | *Alternaria* | sp MY_2011 |
| OTU_259 | 183 | Ascomycota | Dothideomycetes | Pleosporales | Pleosporaceae | *Lewia* | *infectoria* |
| OTU_447 | 184 | Ascomycota | Dothideomycetes | Pleosporales | Incertae sedis | *Phoma* | *macrostoma* |
| OTU_1429 | 185 | Ascomycota | Dothideomycetes | Pleosporales | Incertae sedis | *Phoma* | sp P48E5 |
| OTU_122 | 186 | Ascomycota | Dothideomycetes | Pleosporales | Incertae sedis | *Phoma* | *macrostoma* |
| OTU_82 | 187 | Ascomycota | Dothideomycetes | Pleosporales | Phaeosphaeriaceae | unidentified | Phaeosphaeriaceae sp |
| OTU_324 | 188 | Ascomycota | Dothideomycetes | Pleosporales | Pleosporaceae | *Lewia* | *infectoria* |
| OTU_60 | 189 | Ascomycota | Dothideomycetes | Pleosporales | Pleosporaceae | *Cochliobolus* | |
| OTU_142 | 190 | Ascomycota | Dothideomycetes | Incertae sedis | Pseudeurotiaceae | *Pseudeurotium* | |
| OTU_92 | 191 | Ascomycota | Dothideomycetes | Capnodiales | Mycosphaerellaceae | *Cercospora* | *nicotianae* |
| OTU_87 | 192 | Ascomycota | Dothideomycetes | Capnodiales | Mycosphaerellaceae | *Mycosphaerella* | *punctiformis* |
| OTU_99 | 193 | Ascomycota | Dothideomycetes | Pleosporales | Leptosphaeriaceae | | |
| OTU_1316 | 194 | Ascomycota | Dothideomycetes | Pleosporales | Incertae sedis | *Phoma* | |
| OTU_138 | 195 | Ascomycota | Dothideomycetes | Capnodiales | Davidiellaceae | *Cladosporium* | |
| OTU_992 | 196 | Ascomycota | Dothideomycetes | Dothideales | Dothioraceae | *Aureobasidium* | *pullulans* |
| OTU_378 | 197 | Ascomycota | Dothideomycetes | Pleosporales | Incertae sedis | *Phoma* | |
| OTU_353 | 198 | Ascomycota | Dothideomycetes | Pleosporales | Incertae sedis | *Phoma* | |
| OTU_227 | 199 | Ascomycota | Dothideomycetes | Pleosporales | Incertae sedis | | |
| OTU_68 | 200 | Ascomycota | Dothideomycetes | Pleosporales | Incertae sedis | *Phoma* | *paspali* |
| OTU_680 | 201 | Ascomycota | Dothideomycetes | | | | |
| OTU_97 | 202 | Ascomycota | Dothideomycetes | Pleosporales | Phaeosphaeriaceae | unidentified | Phaeosphaeriaceae sp MJ23 |
| OTU_115 | 203 | Ascomycota | Dothideomycetes | Pleosporales | Phaeosphaeriaceae | *Phaeosphaeria* | |
| OTU_22 | 204 | Ascomycota | Eurotiomycetes | Eurotiales | Trichocomaceae | *Penicillium* | |
| OTU_262 | 205 | Ascomycota | Eurotiomycetes | Eurotiales | Trichocomaceae | *Penicillium* | *citrinum* |
| OTU_17 | 206 | Ascomycota | Eurotiomycetes | Eurotiales | Trichocomaceae | *Aspergillus* | *niger* |
| OTU_28 | 207 | Ascomycota | Eurotiomycetes | Eurotiales | Trichocomaceae | *Penicillium* | *bialowiezense* |
| OTU_21 | 208 | Ascomycota | Eurotiomycetes | Eurotiales | Trichocomaceae | unidentified | uncultured *Eurotium* |
| OTU_938 | 209 | Ascomycota | Eurotiomycetes | Eurotiales | Trichocomaceae | *Penicillium* | |
| OTU_64 | 210 | Ascomycota | Eurotiomycetes | Eurotiales | Trichocomaceae | *Penicillium* | *spinulosum* |
| OTU_105 | 211 | Ascomycota | Eurotiomycetes | Eurotiales | Trichocomaceae | *Emericella* | *nidulans* |
| OTU_527 | 212 | Ascomycota | Eurotiomycetes | Eurotiales | Trichocomaceae | *Penicillium* | *bialowiezense* |
| OTU_121 | 213 | Ascomycota | Eurotiomycetes | Eurotiales | Trichocomaceae | *Penicillium* | |
| OTU_77 | 214 | Ascomycota | Eurotiomycetes | Eurotiales | Trichocomaceae | *Aspergillus* | *flavus* |
| OTU_340 | 215 | Ascomycota | Eurotiomycetes | Eurotiales | Trichocomaceae | *Penicillium* | |
| OTU_186 | 216 | Ascomycota | Eurotiomycetes | Eurotiales | Trichocomaceae | *Talaromyces* | |
| OTU_131 | 217 | Ascomycota | Eurotiomycetes | Eurotiales | Trichocomaceae | *Emericella* | *nidulans* |

TABLE 4-continued

Exemplary fungal endophytes present in all plants

| OTU_ID | SEQ ID NO | Phylum | Class | Order | Family | Genus | Species |
|---|---|---|---|---|---|---|---|
| OTU_18 | 218 | Zygomycota | Incertae sedis | Mucorales | Rhizopodaceae | *Rhizopus* | *oryzae* |
| OTU_6 | 219 | Ascomycota | Leotiomycetes | Helotiales | Helotiaceae | | |
| OTU_42 | 220 | Ascomycota | Leotiomycetes | Erysiphales | Erysiphaceae | *Erysiphe* | *cruciferarum* |
| OTU_125 | 221 | Ascomycota | Leotiomycetes | Helotiales | Sclerotiniaceae | *Botrytis* | sp CID95 |
| OTU_50 | 222 | Basidiomycota | Microbotryomycetes | Sporidiobolales | Incertae sedis | *Sporobolomyces* | *oryzicola* |
| OTU_37 | 223 | Basidiomycota | Microbotryomycetes | Sporidiobolales | Incertae sedis | *Sporobolomyces* | *roseus* |
| OTU_1406 | 224 | Basidiomycota | Microbotryomycetes | Sporidiobolales | Incertae sedis | *Sporobolomyces* | |
| OTU_72 | 225 | Basidiomycota | Microbotryomycetes | Sporidiobolales | Incertae sedis | *Sporobolomyces* | *ruberrimus* |
| OTU_1184 | 226 | Basidiomycota | Microbotryomycetes | Sporidiobolales | Incertae sedis | *Sporobolomyces* | *roseus* |
| OTU_70 | 227 | Basidiomycota | Microbotryomycetes | Sporidiobolales | Incertae sedis | unidentified | Sporidiobolales sp |
| OTU_65 | 228 | Basidiomycota | Microbotryomycetes | Sporidiobolales | Incertae sedis | *Rhodosporidium* | *diobovatum* |
| OTU_103 | 229 | Basidiomycota | Microbotryomycetes | Sporidiobolales | Incertae sedis | *Sporobolomyces* | *symmetricus* |
| OTU_53 | 230 | Ascomycota | Saccharomycetes | Saccharomycetales | Pichiaceae | *Pichia* | *fermentans* |
| OTU_94 | 231 | Ascomycota | Saccharomycetes | Saccharomycetales | Saccharomycodaceae | *Hanseniaspora* | *uvarum* |
| OTU_86 | 232 | Ascomycota | Saccharomycetes | Saccharomycetales | Saccharomycodaceae | *Hanseniaspora* | *thailandica* |
| OTU_5 | 233 | Ascomycota | Sordariomycetes | Hypocreales | Nectriaceae | *Fusarium* | |
| OTU_11 | 234 | Ascomycota | Sordariomycetes | Xylariales | Incertae sedis | *Monographella* | sp 68 |
| OTU_13 | 235 | Ascomycota | Sordariomycetes | Hypocreales | Nectriaceae | *Fusarium* | *culmorum* |
| OTU_25 | 236 | Ascomycota | Sordariomycetes | Sordariales | | | |
| OTU_120 | 237 | Ascomycota | Sordariomycetes | Hypocreales | Incertae sedis | *Acremonium* | sp 2 J12 |
| OTU_1072 | 238 | Ascomycota | Sordariomycetes | Hypocreales | Nectriaceae | *Gibberella* | *intricans* |
| OTU_58 | 239 | Ascomycota | Sordariomycetes | Hypocreales | Nectriaceae | *Gibberella* | *intricans* |
| OTU_62 | 240 | Ascomycota | Sordariomycetes | Hypocreales | | | |
| OTU_30 | 241 | Ascomycota | Sordariomycetes | Hypocreales | Nectriaceae | *Gibberella* | *baccata* |
| OTU_56 | 242 | Ascomycota | Sordariomycetes | Hypocreales | Incertae sedis | *Acremonium* | sp 4053 |
| OTU_209 | 243 | Ascomycota | Sordariomycetes | Hypocreales | Nectriaceae | *Fusarium* | *petroliphilum* |
| OTU_34 | 244 | Ascomycota | Sordariomycetes | Incertae sedis | Plectosphaerellaceae | *Gibellulopsis* | sp YH_2012 |
| OTU_45 | 245 | Ascomycota | Sordariomycetes | Xylariales | Incertae sedis | *Monographella* | *cucumerina* |
| OTU_100 | 246 | Ascomycota | Sordariomycetes | Hypocreales | unidentified | unidentified | |
| OTU_877 | 247 | Ascomycota | Sordariomycetes | Hypocreales | Nectriaceae | *Fusarium* | *sporotrichioides* |
| OTU_682 | 248 | Ascomycota | Sordariomycetes | Hypocreales | Nectriaceae | | |
| OTU_81 | 249 | Ascomycota | Sordariomycetes | Diaporthales | Diaporthaceae | *Phomopsis* | sp MAFF 239532 |
| OTU_238 | 250 | Ascomycota | Sordariomycetes | Sordariales | Lasiosphaeriaceae | unidentified | Lasiosphaeriaceae sp |
| OTU_85 | 251 | Ascomycota | Sordariomycetes | Sordariales | Chaetomiaceae | *Chaetomium* | *globosum* |
| OTU_525 | 252 | Ascomycota | Sordariomycetes | | | | |
| OTU_106 | 253 | Ascomycota | Sordariomycetes | Incertae sedis | Glomerellaceae | *Colletotrichum* | *acutatum* |
| OTU_150 | 254 | Ascomycota | Sordariomycetes | Hypocreales | Incertae sedis | *Acremonium* | *dichromosporum* |
| OTU_1278 | 255 | Ascomycota | Sordariomycetes | Hypocreales | Nectriaceae | *Fusarium* | *sporotrichioides* |
| OTU_1403 | 256 | Ascomycota | Sordariomycetes | Xylariales | Incertae sedis | *Monographella* | sp 68 |
| OTU_160 | 257 | Ascomycota | Sordariomycetes | Incertae sedis | Plectosphaerellaceae | *Lectera* | *longa* |
| OTU_1214 | 258 | Ascomycota | Sordariomycetes | Hypocreales | Nectriaceae | *Gibberella* | *intricans* |
| OTU_181 | 259 | Ascomycota | Sordariomycetes | Hypocreales | Cordycipitaceae | *Engyodontium* | *album* |
| OTU_172 | 260 | Ascomycota | Sordariomycetes | Hypocreales | Nectriaceae | *Fusarium* | *poae* |
| OTU_19 | 261 | Basidiomycota | Tremellomycetes | unidentified | unidentified | unidentified | uncultured *Cryptococcus* |
| OTU_40 | 262 | Basidiomycota | Tremellomycetes | Filobasidiales | Filobasidiaceae | *Cryptococcus* | |
| OTU_74 | 263 | Basidiomycota | Tremellomycetes | Tremellales | Incertae sedis | *Cryptococcus* | *victoriae* |
| OTU_163 | 264 | Basidiomycota | Tremellomycetes | Tremellales | unidentified | unidentified | Tremellales sp TG05 |
| OTU_52 | 265 | Basidiomycota | Tremellomycetes | Tremellales | Incertae sedis | *Cryptococcus* | *victoriae* |
| OTU_325 | 266 | Basidiomycota | Tremellomycetes | Tremellales | Incertae sedis | *Hannaella* | |
| OTU_128 | 267 | Basidiomycota | Tremellomycetes | Filobasidiales | Filobasidiaceae | *Cryptococcus* | *wieringae* |
| OTU_180 | 268 | Basidiomycota | Tremellomycetes | Tremellales | Incertae sedis | *Cryptococcus* | *laurentii* |
| OTU_46 | 269 | Basidiomycota | Tremellomycetes | Filobasidiales | Filobasidiaceae | *Cryptococcus* | *oeirensis* |
| OTU_174 | 270 | Basidiomycota | Tremellomycetes | Tremellales | Incertae sedis | *Cryptococcus* | sp VP_2009b |
| OTU_69 | 271 | Basidiomycota | Tremellomycetes | Filobasidiales | Filobasidiaceae | *Cryptococcus* | *oeirensis* |
| OTU_80 | 272 | Basidiomycota | Tremellomycetes | Cystofilobasidiales | Cystofilobasidiaceae | *Udeniomyces* | *puniceus* |
| OTU_96 | 273 | Basidiomycota | Tremellomycetes | Cystofilobasidiales | Cystofilobasidiaceae | *Udeniomyces* | *pyricola* |
| OTU_51 | 274 | Basidiomycota | Tremellomycetes | Tremellales | Incertae sedis | *Bullera* | *Bullera unica* |
| OTU_109 | 275 | Basidiomycota | Tremellomycetes | Tremellales | Incertae sedis | *Dioszegia* | *fristingensis* |
| OTU_222 | 276 | Basidiomycota | Tremellomycetes | Cystofilobasidiales | Cystofilobasidiaceae | *Cystofilobasidium* | *infirmominiatum* |
| OTU_1054 | 277 | Basidiomycota | Tremellomycetes | Filobasidiales | Filobasidiaceae | *Cryptococcus* | *oeirensis* |
| OTU_971 | 278 | Basidiomycota | Tremellomycetes | unidentified | unidentified | unidentified | Tremellomycetes sp |
| OTU_79 | 279 | Basidiomycota | Tremellomycetes | Tremellales | Incertae sedis | *Hannaella* | *luteola* |
| OTU_135 | 280 | Basidiomycota | Tremellomycetes | Filobasidiales | Filobasidiaceae | *Cryptococcus* | *albidus* |
| OTU_166 | 281 | Basidiomycota | Tremellomycetes | Tremellales | Incertae sedis | *Cryptococcus* | *victoriae* |
| OTU_111 | 282 | Basidiomycota | Tremellomycetes | unidentified | unidentified | unidentified | Tremellomycetes sp |
| OTU_158 | 283 | Basidiomycota | Tremellomycetes | unidentified | unidentified | unidentified | Tremellomycetes sp |
| OTU_91 | 284 | Basidiomycota | Tremellomycetes | Filobasidiales | Filobasidiaceae | *Cryptococcus* | *albidus* |
| OTU_127 | 285 | Basidiomycota | Tremellomycetes | Tremellales | Incertae sedis | *Hannaella* | |
| OTU_1103 | 286 | Basidiomycota | Wallemiomycetes | Wallemiales | Wallemiaceae | *Wallemia* | *sebi* |
| OTU_54 | 287 | Basidiomycota | Wallemiomycetes | Wallemiales | Wallemiaceae | *Wallemia* | *muriae* |
| OTU_114 | 288 | Basidiomycota | Wallemiomycetes | Wallemiales | Wallemiaceae | *Wallemia* | *sebi* |
| OTU_1326 | 289 | Basidiomycota | Wallemiomycetes | Wallemiales | Wallemiaceae | *Wallemia* | *muriae* |

TABLE 1

| Exemplary core bacterial endophytes | | | | | | | |
|---|---|---|---|---|---|---|---|
| OTU_ID | SEQ ID NO | Phylum | Class | Order | Family | Genus | Species |
| OTU_47 | 39 | | Alphaproteobacteria | Rhizobiales | Methylobacteriaceae | *Methylobacterium* | |
| OTU_14 | 43 | | Alphaproteobacteria | Sphingomonadales | Sphingomonadaceae | *Sphingomonas* | |
| OTU_6 | 44 | | Alphaproteobacteria | Sphingomonadales | Sphingomonadaceae | *Sphingomonas* | |
| OTU_25 | 59 | | Bacilli | Bacillales | Paenibacillaceae | | |
| OTU_19 | 64 | | Bacilli | Bacillales | Paenibacillaceae | *Paenibacillus* | *amylolyticus* |
| OTU_16 | 65 | | Bacilli | Bacillales | [Exiguobacteraceae] | *Exiguobacterium* | |
| OTU_222 | 67 | | Bacilli | Bacillales | Bacillaceae | *Geobacillus* | |
| OTU_653 | 68 | | Bacilli | Bacillales | Bacillaceae | *Bacillus* | *endophyticus* |
| OTU_11 | 69 | | Bacilli | Bacillales | Paenibacillaceae | *Paenibacillus* | |
| OTU_71 | 70 | | Bacilli | Bacillales | Paenibacillaceae | *Saccharibacillus* | *kuerlensis* |
| OTU_13 | 71 | | Bacilli | Bacillales | Bacillaceae | *Bacillus* | *flexus* |
| OTU_1014 | 75 | | Betaproteobacteria | Burkholderiales | Oxalobacteraceae | *Janthinobacterium* | |
| OTU_168 | 86 | | Betaproteobacteria | Burkholderiales | Comamonadaceae | | |
| OTU_7 | 87 | | Betaproteobacteria | Burkholderiales | Oxalobacteraceae | *Janthinobacterium* | |
| OTU_1344 | 88 | | Betaproteobacteria | Burkholderiales | Oxalobacteraceae | | |
| OTU_1303 | 114 | | Gammaproteobacteria | Enterobacteriales | Enterobacteriaceae | | |
| OTU_401 | 115 | | Gammaproteobacteria | Enterobacteriales | Enterobacteriaceae | | |
| OTU_1261 | 116 | | Gammaproteobacteria | Enterobacteriales | Enterobacteriaceae | | |
| OTU_771 | 122 | | Gammaproteobacteria | Pseudomonadales | Pseudomonadaceae | *Pseudomonas* | |
| OTU_1441 | 125 | | Gammaproteobacteria | Enterobacteriales | Enterobacteriaceae | | |
| OTU_1158 | 126 | | Gammaproteobacteria | Enterobacteriales | Enterobacteriaceae | *Serratia* | *marcescens* |
| OTU_8 | 128 | | Gammaproteobacteria | Pseudomonadales | Pseudomonadaceae | | |
| OTU_18 | 129 | | Gammaproteobacteria | Xanthomonadales | Xanthomonadaceae | *Xanthomonas* | *axonopodis* |
| OTU_51 | 130 | | Gammaproteobacteria | Oceanospirillales | Halomonadaceae | *Halomonas* | |
| OTU_9 | 132 | | Gammaproteobacteria | Pseudomonadales | Pseudomonadaceae | *Pseudomonas* | |
| OTU_696 | 133 | | Gammaproteobacteria | Enterobacteriales | Enterobacteriaceae | *Escherichia* | *coli* |
| OTU_53 | 134 | | Gammaproteobacteria | Enterobacteriales | Enterobacteriaceae | *Enterobacter* | |
| OTU_4 | 135 | | Gammaproteobacteria | Enterobacteriales | Enterobacteriaceae | *Pantoea* | *agglomerans* |

TABLE 2

| Exemplary core fungal endophytes | | | | | | | |
|---|---|---|---|---|---|---|---|
| OTU_ID | SEQ ID NO | Phylum | Class | Order | Family | Genus | Species |
| OTU_1 | 147 | | Dothideomycetes | Pleosporales | Pleosporaceae | *Alternaria* | sp MY_2011 |
| OTU_2 | 148 | | Dothideomycetes | Capnodiales | Mycosphaerellaceae | unidentified | uncultured *Cladosporium* |
| OTU_12 | 149 | | Dothideomycetes | Capnodiales | Davidiellaceae | *Davidiella* | *tassiana* |
| OTU_9 | 150 | | Dothideomycetes | Pleosporales | Pleosporaceae | *Lewia* | *infectoria* |
| OTU_815 | 180 | | Dothideomycetes | Pleosporales | Pleosporaceae | *Alternaria* | sp MY_2011 |
| OTU_775 | 182 | | Dothideomycetes | Pleosporales | Pleosporaceae | *Alternaria* | sp MY_2011 |
| OTU_22 | 204 | | Eurotiomycetes | Eurotiales | Trichocomaceae | *Penicillium* | |
| OTU_6 | 219 | | Leotiomycetes | Helotiales | Helotiaceae | | |
| OTU_50 | 222 | | Microbotryomycetes | Sporidiobolales | Incertae sedis | *Sporobolomyces* | *oryzicola* |
| OTU_37 | 223 | | Microbotryomycetes | Sporidiobolales | Incertae sedis | *Sporobolomyces* | *roseus* |
| OTU_1406 | 224 | | Microbotryomycetes | Sporidiobolales | Incertae sedis | *Sporobolomyces* | |
| OTU_1184 | 226 | | Microbotryomycetes | Sporidiobolales | Incertae sedis | *Sporobolomyces* | *roseus* |
| OTU_5 | 233 | | Sordariomycetes | Hypocreales | Nectriaceae | *Fusarium* | |
| OTU_1072 | 238 | | Sordariomycetes | Hypocreales | Nectriaceae | *Gibberella* | *intricans* |
| OTU_58 | 239 | | Sordariomycetes | Hypocreales | Nectriaceae | *Gibberella* | *intricans* |
| OTU_682 | 248 | | Sordariomycetes | Hypocreales | Nectriaceae | | |
| OTU_19 | 261 | | Tremellomycetes | unidentified | unidentified | unidentified | uncultured *Cryptococcus* |
| OTU_40 | 262 | | Tremellomycetes | Filobasidiales | Filobasidiaceae | *Cryptococcus* | |
| OTU_52 | 265 | | Tremellomycetes | Tremellales | Incertae sedis | *Cryptococcus* | *victoriae* |
| OTU_166 | 281 | | Tremellomycetes | Tremellales | Incertae sedis | *Cryptococcus* | *victoriae* |

Example 2—Identification and Characterization of Culturable Bacterial and Fungal Endophytes Belonging to Core OTUs In order to better understand the role played by core seed-derived endophytic microbes in improving the vigor, general health and stress resilience of agricultural plants, we initiated a systematic screen to isolate and characterize endophytic microbes from seeds and tissues of commercially significant agricultural plants.

Seeds from diverse types of cereals, fruits, vegetables, grasses, oilseed, and other seeds were acquired and screened for cultivatable microbes, as described below. Culturable microbes (i.e., SYM strains) belonging to the same OTUs as the core OTUs described in Table 1 and Table 2 were isolated and identified.

Isolation of Bacteria and Fungi from the Interior of Seeds

Isolation of fungi and bacteria (including endophytes) from the interior of surface-sterilized seeds was performed using techniques known in the art. Surface sterilized seeds were ground, diluted in liquid media, and the suspension used to inoculate solid media plates. These were incubated under different conditions at room temperature.

Experiment Description

Approximately fifty surface-sterilized seeds were transferred aseptically to a sterile blender and ground. The ground seeds were resuspended in 50 mL of sterile R2A broth, and incubated for 4 h at room temperature. Ten 1 mL aliquots of the seed homogenates were collected and centrifuged, their supernatants discarded and the pellets gently resuspended in 1 mL of sterile 0.05 phosphate buffer; 0.5 mL of 50% glycerol is added to each of five tubes. These were stored at −80 C for further characterization. The remaining aliquots were diluted down twice in hundred-fold dilutions to $10^{-4}$. 100 microliters of the 1, $10^{-2}$, and $10^{-4}$ dilutions were used to inoculate three Petri dishes containing the following media in order to isolate of bacteria and/or fungi:

1. Tryptic Soy agar
2. R2A agar
3. Potato dextrose agar
4. Sabouraud Agar
5. Other media depending on target microorganism The plates were divided into three sets comprising each media type and incubated in different environments. The first set was incubated aerobically, the second under anaerobic conditions, and the third under microaerophilic conditions and all were inspected daily for up to 5 days. 1-2 individual colonies per morphotype were isolated and streaked for purity onto fresh plates of the same media/environment from which the microorganism was isolated. Plates were incubated at room temperature for 2-5 days. After an isolate grew it was streaked once more onto a fresh plate of the same media to ensure purity and incubated under the same environmental conditions.

From the second streaked plate, isolates were stored in Tryptic soy broth +15% glycerol at −80° C. for further characterization, by first scraping 2-3 colonies (about 10 μL) from the plate into a cryogenic tube containing 1.5 mL of the above-mentioned media and gently resuspending the cells. Alternatively, isolates were propagated in specialized media as recommended for the particular taxon of microorganism. The microbes obtained represent those that live in the seeds of the plant accession.

Isolation of Bacteria and Fungi from Plant Interior Tissues

Isolation of fungi and bacteria (including endophytes) from surface-sterilized plant tissues was performed using techniques known in the art. Surface sterilized plant tissues were ground, diluted in liquid media, and then this suspension was used to inoculate solid media plates. These were incubated under different environmental conditions at room temperature.

Experiment Description

Approximately fifty grams of surface-sterilized plant tissue were transferred aseptically to a sterile blender and ground. The ground tissue was resuspended in 50 mL of sterile R2A broth, and incubated for 4 h at room temperature. Ten 1 mL aliquots of the plant tissue homogenates were collected and centrifuged, their supernatants discarded and the pellets gently resuspended in 1 mL of sterile 0.05 phosphate buffer. 0.5 mL of 50% Glycerol was added to each of five tubes. These were stored at −80° C. for possible further characterization. The remaining aliquots were diluted down twice in hundred-fold dilutions to $10^{-4}$. One hundred microliters of the 1, $10^{-2}$, and $10^{-4}$ dilutions were used to inoculate three Petri dishes containing the following media in order to isolate of bacteria and/or fungi:

1. Tryptic Soy agar
2. R2A agar
3. Potato dextrose agar
4. Sabouraud Agar
5. Other media depending on target microorganism Plates were divided into three sets comprising each media type and incubated in different environments. The first set was incubated aerobically, the second under anaerobic conditions, and the third under microaerophilic conditions and all were inspected daily for up to 5 days. 1-2 individual colonies per morphotype were isolated and streaked for purity onto fresh plates of the same media/environment from which the microorganism was isolated. Plates were incubated at room temperature for 2-5 days. After an isolate grew it was streaked once more onto a fresh plate of the same media to ensure purity and incubated under the same environmental conditions.

From the second streaked plate, isolates were stored in Tryptic soy broth +15% glycerol at −80° C. for further characterization, by first scraping 2-3 colonies (about 10 μL) from the plate into a cryogenic tube containing 1.5 mL of the above-mentioned media and gently resuspending the cells. Alternatively, isolates were propagated in specialized media as recommended for the particular taxon of microorganism.

Isolation of Bacteria and Fungi from Plant or Seed Surfaces

To collect phyllosphere, rhizosphere, or spermosphere material for culturing of microbes, unwashed shoot, roots or seeds were shaken free/cleaned of any attached soil and stuffed into sterile 50 mL Falcon tubes. To these, 10 mL of sterile 0.1 M sodium phosphate buffer was added and shaken, followed by 5 minutes of sonication to dislodge microbes from plant surfaces, with the resulting cloudy or muddy wash collected in a separate 15 mL Falcon tube. 100 μL of this microbe filled wash was directly spread onto agar plates or nutrient broth for culturing and enrichment, or it was further diluted with sterile 0.1 M sodium phosphate buffer by 10×, 100×, 1,000×, 10,000× and even 100,000×, before microbial culturing on agar plates or nutrient broth. Glycerol stock preparations of the plant surface wash solution were made at this point by mixing 1 mL of the soil wash solution and 0.5 mL of sterile, 80% glycerol, flash freezing the preparation in a cryotube dipped in liquid nitrogen, and storing at −80° C. Nutrient broth inoculated with a mixture of plant surface bacteria forms a stable, mixed community of microbes which was used in plant inoculation experiments described herein, subcultured in subsequent broth incubations, or spread on agar plates and separated into individual colonies which were tested via methods described herein.

Characterization of Fungal and Bacterial Isolates

Characterization of fungi and bacteria isolated from surface-sterilized or non-sterilized plant or seed tissues was performed using techniques known in the art. These techniques take advantage of differential staining of microorganisms, morphological characteristics of cells, spores, or colonies, biochemical reactions that provide differential characterization, and DNA amplification and sequencing of diagnostic regions of genes, among other methods.

Experimental Description

Isolates of bacteria and/or fungi isolated as described herein (including endophytic bacteria and fungi) were categorized into three types: bacterial isolates, fungal isolates, and unknown isolates (since yeast colonies can resemble bacterial colonies in some cases) based on colony morphology, formation of visible mycelia, and/or formation of spores. To determine if an unknown isolate was bacterial or fungal, microscopic analysis of the isolates was performed. Some of the analyses known to the art to differentiate microorganisms include, but are not limited to: the 10% KOH test, positive staining with Lactophenol cotton blue, Gram staining, and growth on media with selective agents. The distinguishing features observed by these tests are relative cell size (yeast size is much larger than bacterial size), formation of hyphae and spores (filamentous bacteria form smaller hyphae than fungi, and do not form structures containing spores), or growth under selection agents (most bacteria can grow in the presence of antifungal compounds like nystatin, while most fungi cannot; likewise, most fungi are unaffected by the presence of broad-spectrum antibiotics like chloramphenicol and spectinomycin).

To identify the isolates, DNA sequence analysis of conserved genomic regions like the ribosomal DNA loci was performed. To obtain DNA to perform PCR amplifications, some cellular growth from solid media (approximately 5-10 μL) was resuspended in 30 μL of sterile Tris/EDTA buffer (pH 8.0). Samples were heated to 98° C. for 10 minutes followed by cooling down to 4° C. for 1 minute in a thermocycler. This cycle was repeated twice. Samples were then centrifuged at ~13,000 RCF for 1-5 minutes and used as DNA template for PCR reactions. Below is a series of exemplary primer combinations used to identify isolates to a genus level.

TABLE 5

Exemplary primer combinations for isolate identification at a genus level

| Primer 1 | Primer 2 | Target |
|---|---|---|
| V4_515F (5'-GTGCCAGCMGCCGCGGTAA-3') (SEQ ID NO: 453) | V4_806R (5'-GGACTACHVGGGTWTCTAAT-3') (SEQ ID NO: 454) | The 4$^{th}$ Variable region of the bacterial 16S rDNA |
| 27F (5'-AGAGTTTGATCCTGGCTCAG-3') (SEQ ID NO: 455) | 1492R (5'-GGTTACCTTGTTACGACTTT-3') (SEQ ID NO: 456) | Full length of the bacterial 16S rDNA, from position 8-1507. |
| ITS1 (5'-TCCGTAGGTGAACCTGCGG-3') (SEQ ID NO: 457) | ITS2 (5'-GCTGCGTTCTTCATCGATGC-3') (SEQ ID NO: 458) | ~240 bp ITS1 region of fungal genome |
| SR1R (5'-TACCTGGTTGATQCTGCCAGT-3') (SEQ ID NO: 459) | SR6 (5'-TGTTACGACTTTTACTT-3') (SEQ ID NO: 460) | Small subunit (18s) of the fungal rDNA gene |
| ITS1F (5'-CTTGGTCATTTAGAGGAAGTAA-3') (SEQ ID NO: 461) | ITS4 (5'-TCCTCCGCTTATTGATATGC-3') (SEQ ID NO: 462) | ~600-1000 bp ITS region of fungal genomes |
| ITS5 (Universal) (5'-GGAAGTAAAAGTCGTAACAAGG-3') (SEQ ID NO: 463) | ITS4Asco (Ascomycota-specific): 5' CGTTACTRRGGCAATCCCTGTTG3' (SEQ ID NO: 464) or ITS4Basidio (Basidiomycota-specific): 5' GCRCGGAARACGCTTCTC3' (SEQ ID NO: 465); or ITS4Chytrid (Chytridiomycota-specific): 5' TTTTCCCGTTTCATTCGCCA3' (SEQ ID NO: 466); or ITS4Oo (Oomycota-specific): 5' ATAGACTACAATTCGCC 3' (SEQ ID NO: 467); or ITS4Zygo (Zygomycota-specific): 5' AAAACGTWTCTTCAAA 3' (SEQ ID NO: 468) | ~500 bp fragment from different fungal Phyla |
| SSUmAf-(equimolar mix of 2 degenerate primers) and SSUmCf equimolar mix of 3 degenerate primers) | LSUmAr (equimolar mix of 4 degenerate primers) and LSUmBr (equimolar mix of 5 degenerate primers) | 1000-1600 bp fragment of the Glomerycota (arbuscular mycorrhizae) genome comprising partial SSU, whole internal transcribed spacer (ITS) rDNA region and partial LSU. |
| Arch 340F (5'-CCCTAYGGGGYGCASCAG-3') (SEQ ID NO: 469) | Arch 1000R (5'-GAGARGWRGTGCATGGCC-3') (SEQ ID NO: 470) | ~660 bp product of the 18S from Archaea |
| 27F-Degen (5'-AGRRTTYGATYMTGGYTYAG-3') (SEQ ID NO: 471) and 799f (5'-AACMGGATTAGATACCCKG-3') (SEQ ID NO: 473) | 27F-Degen (5'-HGGHTACCTTGTTACGACTT-3') (SEQ ID NO: 472) | Full length of the bacterial 16S rDNA, from position 8-1507. |

To decrease background noise due to the non-specific binding of primers to DNA, the thermocycler was programmed for a touchdown-PCR, which increased specificity of the reaction at higher temperatures and increased the efficiency towards the end by lowering the annealing temperature. Exemplary conditions for performing Touchdown PCR are shown in Table 6.

TABLE 6

Exemplary conditions for performing Touchdown PCR

| Step # | Cycle | Temperature | Time |
|---|---|---|---|
| 1 | Initial Denaturalization | 98° C.* | 5 m |
| 2 | Denaturalization | 98° C.* | 30 s |
| 3 | Annealing | Predicted optimal Tm for the primer set +10° C., minus 1° C./cycle | 30 s |
| 4 | Elongation | 72° C.* | 1 m/1 Kb |
| 5 | GoTo Step 2 × 10 times | | |
| 6 | Denaturalization | 98° C.* | 30 s |
| 7 | Annealing | Predicted optimal Tm for the primer set | 30 s |
| 8 | Elongation | 72° C.* | 1 m/1 Kb |
| 9 | GoTo Step 6 × 20 times | | |
| 10 | Final Elongation | 72° C.* | 5 m |
| 11 | Cool Down | 4° C. | 5 m |

*Or the temperature specified by the DNA polymerase manufacturer for this step.

PCR reactions were purified to remove primers, dNTPs, and other components by methods known in the art, for example by the use of commercially available PCR clean-up kits.

The resulting sequences were aligned as query sequences with the publicly available databases GenBank nucleotide, RDP, UNITE and PlutoF. RDP was specifically compiled and used for bacterial 16s classification. UNITE and PlutoF were specifically compiled and used for identification of fungi. In all the cases, the strains were identified to species level if their sequences were more than 95% similar to any identified accession from all databases analyzed. When the similarity percentage was between 90-97%, the strain was classified at genus, family, order, class, subdivision or phylum level depending on the information displayed in databases used. Isolates with lower similarity values (from 30-90%) were classified as "unknown" or "uncultured" depending on the information displayed after BLAST analysis. To compliment the molecular identification, fungal taxa were confirmed by inducing sporulation on PDA or V8 agar plates and using reported morphological criteria for identification of fruiting bodies structure and shape. Bacterial taxa were confirmed by using reported morphological criteria in specialized differential media for the particular taxon, or by biochemical differentiation tests, as described by the Bergey's Manual of Systematic Microbiology (Whitman, William B., et al., eds. Bergey's Manual® of systematic bacteriology. Vols. 1-5. Springer, 2012).

Culture-Independent Characterization of Fungal and Bacterial Communities in Seeds or Plants To understand the diversity of culturable and unculturable microbial (e.g., bacterial and fungal) taxa that reside inside of seeds or plants of agriculturally-relevant cultivars, landraces, and ancestral wild varieties, microbial DNA was extracted from surface sterilized seed or plant parts, as described herein, followed by amplification of conserved genomic regions, for example the ribosomal DNA loci. Amplified DNA represented a "snapshot" of the full microbial community inside seeds or plants.

Experimental Description

To obtain microbial DNA from seeds, plants or plant parts, the seeds, plants or plant parts were surface sterilized under aseptic conditions as described herein. Microbial DNA from seeds, plants, or plant parts was extracted using methods known in the art, for example using commercially available Seed-DNA or plant DNA extraction kits, or the following method.

1. A sample of each kind of seed or plant tissue is placed in a cold-resistant container and 10-50 mL of liquid nitrogen is applied. The seeds or plant tissues are then macerated to a powder.
2. Genomic DNA is extracted from each seed or plant tissue preparation, following a chloroform:isoamyl alcohol 24:1 protocol (Sambrook et al. 1989).

Fungal-specific primers were used to amplify the ITS (Internal Transcribed Spacer) region of nuclear ribosomal DNA. Bacterial specific primers were used to amplify region of the 16s rDNA gene of the bacterial genome. Sequences obtained through NGS platforms were analyzed against databases, such as the ones mentioned herein.

Exemplary primer pairs used for this analysis are listed in Table 5.

As an alternative to next generation sequencing, Terminal Restriction Fragment Length Polymorphism, (TRFLP) can be performed. Group specific, fluorescently labeled primers are used to amplify diagnostic regions of genes in the microbial population. This fluorescently labeled PCR product is cut by a restriction enzyme chosen for heterogeneous distribution in the PCR product population. The enzyme cut mixture of fluorescently labeled and unlabeled DNA fragments is then submitted for sequence analysis on a Sanger sequence platform such as the Applied Biosystems 3730 DNA Analyzer.

Determination of the Plant Pathogenic Potential of Microbial Isolates

Since a microbe that confers positive traits to one cultivar might be a pathogenic agent in a different plant species, a general assay was used to determine the pathogenic potential of microbial isolates. Surface and interior-sterilized seeds are germinated in water agar, and once the plant develops its first set of leaves, are inoculated with the isolate. Alternatively, the plants are inoculated as seeds. For inoculation the microbial isolate is grown on solid media, and inoculated into a plant or onto a seed via any of the methods described herein. Plants are allowed to grow under ideal conditions for 2-3 weeks and any pathogenic effect of the introduced microbe is evaluated against uninoculated control plants.

Identification of Culturable Microbial Isolates that Correspond to Core OTUs

To accurately characterize the isolated microbial endophytes, colonies were submitted for marker gene sequencing, and the sequences were analyzed to provide taxonomic classifications. Among the cultured microbes (SYM strains), those with at least 97% 16S or ITS sequence similarity to OTUs of Table 1 and Table 2 were identified. Exemplary isolated microbes that correspond to core OTUs are listed in Table 7 (bacteria) and Table 8 (fungi).

TABLE 7

| Exemplary bacterial endophytes | | |
|---|---|---|
| SEQ ID NO | SYM | Taxonomic Classification |
| 290 | SYM00003 | Bacteria; Proteobacteria; Betaproteobacteria; Burkholderiales; Oxalobacteraceae; *Ralstonia pickettii* |
| 291 | SYM00009 | Bacteria; Proteobacteria; Betaproteobacteria; Burkholderiales; Oxalobacteraceae; *Ralstonia pickettii* |
| 292 | SYM00013 | Bacteria; Proteobacteria; Gammaproteobacteria; Pseudomonadales; Pseudomonadaceae; *Pseudomonas oryzihabitans* |
| 293 | SYM00017A | Bacteria; Proteobacteria; Alphaproteobacteria; Rhizobiales; Rhizobiaceae; *Agrobacterium larrymoorei* |
| 294 | SYM00018 | Bacteria; Proteobacteria; Gammaproteobacteria; Enterobacteriales; Enterobacteriaceae; *Pantoea dispersa* |
| 295 | SYM00020 | Bacteria; Proteobacteria; Gammaproteobacteria; Enterobacteriales; Enterobacteriaceae; *Pantoea dispersa* |
| 296 | SYM00021b | Bacteria; Proteobacteria; Gammaproteobacteria; Enterobacteriales; Enterobacteriaceae; *Escherichia hermannii* |
| 297 | SYM00025 | Bacteria; Proteobacteria; Gammaproteobacteria; Enterobacteriales; Enterobacteriaceae; *Pantoea dispersa* |
| 298 | SYM00033 | Bacteria; Proteobacteria; Gammaproteobacteria; Enterobacteriales; Enterobacteriaceae; *Enterobacter ludwigii* |
| 300 | SYM00043 | Bacteria; Proteobacteria; Gammaproteobacteria; Enterobacteriales; Enterobacteriaceae; *Pantoea dispersa* |
| 301 | SYM00044 | Bacteria; Proteobacteria; Gammaproteobacteria; Enterobacteriales; Enterobacteriaceae; *Enterobacter hormaechei* |
| 302 | SYM00050 | Bacteria; Proteobacteria; Gammaproteobacteria; Enterobacteriales; Enterobacteriaceae; *Enterobacter cloacae* |
| 303 | SYM00053 | Bacteria; Proteobacteria; Gammaproteobacteria; Enterobacteriales; Enterobacteriaceae; *Escherichia hermannii* |
| 305 | SYM00062c | Bacteria; Firmicutes; Bacilli; Bacillales; Paenibacillaceae; *Saccharibacillus kuerlensis* |
| 306 | SYM00065 | Bacteria; Proteobacteria; Alphaproteobacteria; Sphingomonadales; Sphingomonadaceae; *Sphingomonas sanguinis* |
| 308 | SYM00068 | Bacteria; Proteobacteria; Gammaproteobacteria; Pseudomonadales; Pseudomonadaceae; *Pseudomonas psychrotolerans* |
| 309 | SYM00070 | Bacteria; Proteobacteria; Gammaproteobacteria; Enterobacteriales; Enterobacteriaceae; *Pantoea agglomerans* |
| 310 | SYM00074 | Bacteria; Proteobacteria; Gammaproteobacteria; Enterobacteriales; Enterobacteriaceae; *Enterobacter cloacae* |
| 311 | SYM00103 | Bacteria; Proteobacteria; Betaproteobacteria; Burkholderiales; Oxalobacteraceae; *Ralstonia pickettii* |
| 321 | SYM00170 | Bacteria; Firmicutes; Bacilli; Bacillales; Paenibacillaceae; *Paenibacillus hunanensis* |
| 322 | SYM00183 | Bacteria; Proteobacteria; Gammaproteobacteria; Xanthomonadales; Xanthomonadaceae; *Stenotrophomonas maltophilia* |
| 323 | SYM00184 | Bacteria; Proteobacteria; Gammaproteobacteria; Xanthomonadales; Xanthomonadaceae; *Stenotrophomonas maltophilia* |
| 324 | SYM00207 | Bacteria; Firmicutes; Bacilli; Bacillales; Bacillaceae; *Bacillus pumilus* |
| 325 | SYM00212 | Bacteria; Firmicutes; Bacilli; Bacillales; Bacillaceae; *Bacillus* sp. |
| 326 | SYM00219 | Bacteria; Firmicutes; Bacilli; Bacillales; Bacillaceae; *Bacillus* sp. |
| 327 | SYM00234 | Bacteria; Firmicutes; Bacilli; Bacillales; Paenibacillaceae; *Paenibacillus* sp. |
| 328 | SYM00236 | Bacteria; Proteobacteria; Alphaproteobacteria; Rhizobiales; Methylobacteriaceae; *Methylobacterium* sp. |
| 329 | SYM00248 | Bacteria; Proteobacteria; Gammaproteobacteria; Enterobacteriales; Enterobacteriaceae; *Pantoea* sp. |
| 330 | SYM00249 | Bacteria; Firmicutes; Bacilli; Bacillales; Bacillaceae; *Bacillus* sp. |
| 331 | SYM00506c | Bacteria; Firmicutes; Bacilli; Bacillales; Paenibacillaceae; *Paenibacillus* sp. |
| 332 | SYM00507 | Bacteria; Firmicutes; Bacilli; Bacillales; Bacillaceae; *Bacillus* sp. |
| 333 | SYM00508 | Bacteria; Proteobacteria; Gammaproteobacteria; Enterobacteriales; Enterobacteriaceae; *Enterobacter asburiae* |
| 334 | SYM00525 | Bacteria; Actinobacteria; incertae sedis; Actinomycetales; Microbacteriaceae; *Curtobacterium* sp. |
| 335 | SYM00538A | Bacteria; Proteobacteria; Alphaproteobacteria; Sphingomonadales; Sphingomonadaceae; *Sphingomonas aquatilis* |
| 336 | SYM00538B | Bacteria; Firmicutes; Bacilli; Bacillales; Paenibacillaceae; *Paenibacillus* sp. |
| 337 | SYM00538i | Bacteria; Bacteroidetes; Flavobacteriia; Flavobacteriales; [Weeksellaceae]; *Chryseobacterium* sp. |
| 338 | SYM00543 | Bacteria; Firmicutes; Bacilli; Bacillales; Bacillaceae; *Bacillus* sp. |
| 339 | SYM00545 | Bacteria; Firmicutes; Bacilli; Bacillales; Paenibacillaceae; *Paenibacillus* sp. |
| 340 | SYM00549 | Bacteria; Firmicutes; Bacilli; Bacillales; Paenibacillaceae; *Paenibacillus* sp. |

TABLE 7-continued

| Exemplary bacterial endophytes | | |
|---|---|---|
| SEQ ID NO | SYM | Taxonomic Classification |
| 341 | SYM00563 | Bacteria; Firmicutes; Bacilli; Bacillales; Bacillaceae; *Bacillus* sp. |
| 343 | SYM00574 | Bacteria; Proteobacteria; Betaproteobacteria; Burkholderiales; Burkholderiaceae; *Burkholderia gladioli* |
| 347 | SYM00617 | Bacteria; Firmicutes; Bacilli; Bacillales; Bacillaceae; *Bacillus* sp. |
| 348 | SYM00620 | Bacteria; Proteobacteria; Gammaproteobacteria; Enterobacteriales; Enterobacteriaceae; *Enterobacter* sp. |
| 350 | SYM00627 | Bacteria; Proteobacteria; Gammaproteobacteria; Enterobacteriales; Enterobacteriaceae; *Enterobacter* sp. |
| 351 | SYM00628 | Bacteria; Proteobacteria; Gammaproteobacteria; Enterobacteriales; Enterobacteriaceae; *Enterobacter* sp. |
| 353 | SYM00646 | Bacteria; Proteobacteria; Gammaproteobacteria; Pseudomonadales; Pseudomonadaceae; *Pseudomonas* sp. |
| 354 | SYM00650 | Bacteria; Proteobacteria; Gammaproteobacteria; Pseudomonadales; Pseudomonadaceae; *Pseudomonas* sp. |
| 355 | SYM00662 | Bacteria; Proteobacteria; Gammaproteobacteria; Pseudomonadales; Pseudomonadaceae; *Pseudomonas putida* |
| 358 | SYM00714 | Bacteria; Proteobacteria; Alphaproteobacteria; Rhizobiales; Rhizobiaceae; *Agrobacterium* sp. |
| 365 | SYM00905 | Bacteria; Proteobacteria; Gammaproteobacteria; Xanthomonadales; Xanthomonadaceae; *Stenotrophomonas* sp. |
| 366 | SYM00924 | Bacteria; Proteobacteria; Alphaproteobacteria; Rhizobiales; Methylobacteriaceae; *Methylobacterium* sp. |
| 367 | SYM00963 | Bacteria; Proteobacteria; Gammaproteobacteria; Enterobacteriales; Enterobacteriaceae; *Escherichia coli* |
| 368 | SYM00982 | Bacteria; Bacteroidetes; Flavobacteriia; Flavobacteriales; [Weeksellaceae]; *Chryseobacterium* sp. |
| 369 | SYM00987 | Bacteria; Proteobacteria; Gammaproteobacteria; Enterobacteriales; Enterobacteriaceae; *Escherichia coli* |
| 370 | SYM00978 | Bacteria; Proteobacteria; Alphaproteobacteria; Rhizobiales; Methylobacteriaceae; *Methylobacterium aquaticum* |
| 371 | SYM00991 | Bacteria; Proteobacteria; Beta Proteobacteria; Burkholderiales; Comamonadaceae; *Acidovorax avenae* |
| 372 | SYM00999 | Bacteria; Proteobacteria; Alphaproteobacteria; Rhizobiales; Methylobacteriaceae; *Methylobacterium* sp. |
| 373 | SYM01049 | Bacteria; Proteobacteria; Gammaproteobacteria; Enterobacteriales; Enterobacteriaceae; *Enterobacter* sp. |
| 426 | SYM00057B | Bacteria; Proteobacteria; Betaproteobacteria; Burkholderiales; Burkholderiaceae; *Burkholderia caledonica* |
| 427 | SYM00091 | Bacteria; Proteobacteria; Alphaproteobacteria; Rhizobiales; Rhizobiaceae; *Rhizobium* sp. |
| 428 | SYM00092D | Bacteria; Proteobacteria; Alphaproteobacteria; Caulobacterales; Caulobacteraceae; *Brevundimonas* sp. |
| 430 | SYM00290 | Bacteria; Proteobacteria; Gammaproteobacteria; Pseudomonadales; Moraxellaceae; *Acinetobacter lwoffii* |
| 433 | SYM00576 | Bacteria; Proteobacteria; Gammaproteobacteria; Enterobacteriales; Enterobacteriaceae; *Pantoea dispersa* |
| 434 | SYM00607 | Bacteria; Proteobacteria; Gammaproteobacteria; Enterobacteriales; Enterobacteriaceae; *Pantoea stewartii* |
| 435 | SYM00619 | Bacteria; Firmicutes; Bacilli; Bacillales; [Exiguobacteraceae]; *Exiguobacterium acetylicum* |
| 436 | SYM00786 | Bacteria; Proteobacteria; Gammaproteobacteria; Enterobacteriales; Enterobacteriaceae; *Pantoea dispersa* |
| 437 | SYM00879 | Bacteria; Proteobacteria; Alphaproteobacteria; Rhizobiales; Methylobacteriaceae; *Methylobacterium populi* |
| 438 | SYM00879B | Bacteria; Proteobacteria; Alphaproteobacteria; Sphingomonadales; Sphingomonadaceae; *Sphingomonas aquatilis* |
| 439 | SYM00906 | Bacteria; Proteobacteria; Gammaproteobacteria; Xanthmonadales; Xanthomonadaceae; *Stenotrophomonas rhizophila* |
| 440 | SYM00965 | Bacteria; Proteobacteria; Alphaproteobacteria; Sphingomonadales; Erythrobacteraceae; *Luteibacter yeojuensis* |
| 441 | SYM01004 | Bacteria; Proteobacteria; Alphaproteobacteria; Rhizobiales; Rhizobiaceae; *Agrobacterium larrymoorei* |
| 442 | SYM01022 | Bacteria; Actinobacteria; incertae sedis; Actinomycetales; Microbacteriaceae; *Curtobacterium flaccumfaciens;* |
| 451 | SYM00865 | Bacteria; Proteobacteria; Gammaproteobacteria; Xanthomonadales; Xanthomonadaceae; *Stenotrophomonas rhizophila* |
| 452 | SYM01158 | Bacteria; Proteobacteria; Gammaproteobacteria; Enterobacteriales; Enterobacteriaceae; *Pantoea agglomerans* |

TABLE 8

| Exemplary fungal endophytes | | |
|---|---|---|
| SEQ ID NO | SYM | Taxonomic Classification |
| 299 | SYM00034 | Fungi; Ascomycota; Sordariomycetes; Hypocreales; Incertae sedis; *Acremonium zeae* |
| 304 | SYM00061A | Fungi; Ascomycota; Sordariomycetes; Hypocreales; Incertae sedis; *Acremonium zeae* |
| 307 | SYM00066 | Fungi; Ascomycota; Sordariomycetes; Hypocreales; Incertae sedis; *Acremonium zeae* |
| 312 | SYM00120 | Fungi; Ascomycota; Dothideomycetes; Pleosporales; Pleosporaceae; *Alternaria alternata* |
| 313 | SYM00122 | Fungi; Ascomycota; Dothideomycetes; Pleosporales; Pleosporaceae; *Epicoccum nigrum* |
| 314 | SYM00123 | Fungi; Ascomycota; Dothideomycetes; Pleosporales; Pleosporaceae; *Epicoccum nigrum* |
| 315 | SYM00124 | Fungi; Ascomycota; Sordariomycetes; Hypocreales; Nectriaceae; *Fusarium graminearum* |
| 316 | SYM00129 | Fungi; Ascomycota; Sordariomycetes; Hypocreales; Nectriaceae; *Fusarium proliferatum* |
| 317 | SYM00135 | Fungi; Ascomycota; Sordariomycetes; Hypocreales; Nectriaceae; *Fusarium proliferatum* |
| 318 | SYM00136 | Fungi; Ascomycota; Sordariomycetes; Hypocreales; Nectriaceae; *Fusarium proliferatum* |
| 319 | SYM00151 | Fungi; Ascomycota; Sordariomycetes; Hypocreales; Nectriaceae; *Fusarium proliferatum* |
| 320 | SYM00154 | Fungi; Ascomycota; Sordariomycetes; Hypocreales; Nectriaceae; *Fusarium* sp. |
| 342 | SYM00566B | Fungi; Ascomycota; Sordariomycetes; Hypocreales; Incertae sedis; *Acremonium zeae* |
| 344 | SYM00577 | Fungi; Ascomycota; Sordariomycetes; Hypocreales; Incertae sedis; *Acremonium zeae* |
| 345 | SYM00590 | Fungi; Ascomycota; Sordariomycetes; Hypocreales; Incertae sedis; *Acremonium zeae* |
| 346 | SYM00603 | Fungi; Ascomycota; Sordariomycetes; Hypocreales; Incertae sedis; *Acremonium zeae* |
| 349 | SYM00622 | Fungi; Ascomycota; Sordariomycetes; Hypocreales; Incertae sedis; *Acremonium strictum* |
| 352 | SYM00629 | Fungi; Ascomycota; Sordariomycetes; Hypocreales; Incertae sedis; *Acremonium strictum* |
| 356 | SYM00663 | Fungi; Ascomycota; Dothideomycetes; Pleosporales; Pleosporaceae; *Alternaria alternata* |
| 357 | SYM00696 | Fungi; Ascomycota; Dothideomycetes; Pleosporales; Pleosporaceae; *Alternaria tenuissima* |
| 359 | SYM00741a | Fungi; Ascomycota; Dothideomycetes; Pleosporales; Incertae sedis; *Phoma herbarum* |
| 360 | SYM00741b | Fungi; Ascomycota; Dothideomycetes; Capnodiales; Davidiellaceae; *Cladosporium tenuissimum* |
| 361 | SYM00793 | Fungi; Ascomycota; Sordariomycetes; Hypocreales; Nectriaceae; *Fusarium verticillioides* |
| 362 | SYM00795 | Fungi; Ascomycota; Sordariomycetes; Hypocreales; Incertae sedis; *Acremonium zeae* |
| 363 | SYM00854 | Fungi; Ascomycota; Dothideomycetes; Pleosporales; Pleosporaceae; *Epicoccum sorghinum* |
| 364 | SYM00880 | Fungi; Ascomycota; Dothideomycetes; Pleosporales; Pleosporaceae; *Alternaria tenuissima* |
| 374 | SYM01300 | Fungi; Ascomycota; Sordariomycetes; Hypocreales; Incertae sedis; *Acremonium zeae* |
| 375 | SYM01303 | Fungi; Ascomycota; Sordariomycetes; Hypocreales; Nectriaceae; *Fusarium* sp. |
| 376 | SYM01310 | Fungi; Ascomycota; Sordariomycetes; Hypocreales; Nectriaceae; *Fusarium proliferatum* |
| 377 | SYM01311 | Fungi; Ascomycota; Sordariomycetes; Hypocreales; Nectriaceae; *Fusarium* sp. |
| 378 | SYM01314 | Fungi; Ascomycota; Sordariomycetes; Hypocreales; Incertae sedis; *Acremonium zeae* |
| 379 | SYM01315 | Fungi; Ascomycota; Dothideomycetes; Capnodiales; Davidiellaceae; *Cladosporium* sp. |
| 380 | SYM01325 | Fungi; Ascomycota; Dothideomycetes; Pleosporales; Pleosporaceae; *Alternaria* sp. |
| 381 | SYM01326 | Fungi; Ascomycota; Dothideomycetes; Pleosporales; Pleosporaceae; *Alternaria alternata* |
| 382 | SYM01327 | Fungi; Ascomycota; Dothideomycetes; Capnodiales; Davidiellaceae; *Cladosporium* sp. |
| 383 | SYM01328 | Fungi; Ascomycota; Dothideomycetes; Pleosporales; Pleosporaceae; *Alternaria* sp. |
| 384 | SYM01333 | Fungi; Ascomycota; Dothideomycetes; Pleosporales; Pleosporaceae; *Alternaria infectoria* |

TABLE 8-continued

| Exemplary fungal endophytes | | |
|---|---|---|
| SEQ ID NO | SYM | Taxonomic Classification |
| 385 | SYM15811 | Fungi; Ascomycota; Dothideomycetes; Pleosporales; Pleosporaceae; *Alternaria* sp. |
| 386 | SYM15820 | Fungi; Ascomycota; Sordariomycetes; Trichosphaeriales; incertae sedis; *Nigrospora oryzae* |
| 387 | SYM15821 | Fungi; Ascomycota; Sordariomycetes; Trichosphaeriales; incertae sedis; *Nigrospora oryzae* |
| 388 | SYM15825 | Fungi; Ascomycota; Sordariomycetes; Hypocreales; Nectriaceae; *Fusarium* sp. |
| 389 | SYM15828 | Fungi; Ascomycota; Sordariomycetes; Hypocreales; Nectriaceae; *Fusarium* sp. |
| 390 | SYM15831 | Fungi; Ascomycota; Sordariomycetes; Hypocreales; Nectriaceae; *Fusarium* sp. |
| 391 | SYM15837 | Fungi; Ascomycota; Sordariomycetes; Hypocreales; Nectriaceae; *Fusarium* sp. |
| 392 | SYM15839 | Fungi; Ascomycota; Sordariomycetes; Hypocreales; Nectriaceae; *Fusarium* sp. |
| 393 | SYM15847 | Fungi; Ascomycota; Sordariomycetes; Hypocreales; Nectriaceae; *Fusarium udum* |
| 394 | SYM15870 | Fungi; Ascomycota; Sordariomycetes; Hypocreales; Nectriaceae; *Fusarium* sp. |
| 395 | SYM15872 | Fungi; Ascomycota; Sordariomycetes; Hypocreales; Nectriaceae; *Fusarium* sp. |
| 396 | SYM15890 | Fungi; Ascomycota; Dothideomycetes; Capnodiales; Davidiellaceae; *Cladosporium* sp. |
| 397 | SYM15901 | Fungi; Ascomycota; Sordariomycetes; Hypocreales; Nectriaceae; *Fusarium* sp. |
| 398 | SYM15920 | Fungi; Ascomycota; Sordariomycetes; Hypocreales; Nectriaceae; *Fusarium equiseti* |
| 399 | SYM15926 | Fungi; Ascomycota; Dothideomycetes; Pleosporales; Pleosporaceae; *Alternaria* sp. |
| 400 | SYM15928 | Fungi; Ascomycota; Dothideomycetes; Pleosporales; Pleosporaceae; *Alternaria* sp. |
| 401 | SYM15932 | Fungi; Ascomycota; Sordariomycetes; Hypocreales; Nectriaceae; *Fusarium* sp. |
| 402 | SYM15939 | Fungi; Ascomycota; Sordariomycetes; Hypocreales; Nectriaceae; *Fusarium* sp. |
| 429 | SYM00157 | Fungi; Ascomycota; Dothideomycetes; incertae sedis; incertae sedis; *Leptosphaerulina chartarum* |
| 431 | SYM00299 | Fungi; Ascomycota; Dothideomycetes; Capnodiales; Davidiellaceae; *Cladosporium tenuissimum* |
| 432 | SYM00301 | Fungi; Ascomycota; Eurotiomycetes; Eurotiales; Trichocomaceae; *Penicillium chrysogenum* |
| 443 | SYM01324 | Fungi; Ascomycota; Eurotiomycetes; Eurotiales; Trichocomaceae; *Aspergillus pseudoglaucus* |
| 444 | SYM01329 | Fungi; Ascomycota; Dothideomycetes; Pleosporales; Didymellaceae; *Peyronellaea glomerata* |
| 445 | SYM01330 | Fungi; Zygomycota; incertae sedis; Mucorales; Rhizopodaceae; *Rhizopus oryzae* |
| 446 | SYM12462 | Fungi; Ascomycota; Dothideomycetes; Capnodiales; Davidiellaceae; *Cladosporium sphaerospermum* |
| 447 | SYM15774 | Fungi; Ascomycota; Dothideomycetes; Pleosporales; Incertae sedis; *Phoma medicaginis* |
| 448 | SYM15783 | Fungi; Ascomycota; Dothideomycetes; Pleosporales; Pleosporaceae; *Alternaria macrospora* |
| 449 | SYM00300 | Fungi; Ascomycota; Sordariomycetes; Hypocreales; Incertae sedis; *Acremonium strictum* |
| 450 | SYM01331 | Fungi; Ascomycota; Dothideomycetes; Pleosporales; Incertae sedis; *Phoma pedeiae* |
| 453 | SYM15810 | Fungi; Ascomycota; Sordariomycetes; Hypocreales; Nectriaceae; *Fusarium* sp. |
| 454 | SYM15879 | Fungi; Ascomycota; Sordariomycetes; Hypocreales; Nectriaceae; *Fusarium torulosum* |
| 455 | SYM15880 | Fungi; Ascomycota; Eurotiomycetes; Eurotiales; Trichocomaceae; *Penicillium chrysogenum* |
| 299 | SYM00034 | Fungi; Ascomycota; Sordariomycetes; Hypocreales; Incertae sedis; *Acremonium zeae* |

Example 2: Synthetic Compositions Comprising Plant Seeds and a Single Endophyte Strain or a Plurality of Endophytes Confer Benefits to Agricultural Plants This example describes the ability of synthetic compositions comprising plant seeds and a single endophyte strain or a plurality of endophyte strains described herein, to confer one or more benefits to a host plant. Among other things, this Example describe the ability of endophytes (e.g., bacterial and fungal endophytes described herein) to confer beneficial traits on a variety of host plants, including but not limited to, dicots (e.g., soy, peanut) and monocots (e.g., corn, soy, wheat, cotton, sorghum), and combinations thereof. Endophyte-inoculated seeds (e.g., seeds described herein) were tested under water-limited conditions (e.g., drought stress) in seed germination assays and seedling root, vigor assays to test whether one or more endophytes confer an increase in tolerance to these stresses. These growth tests were performed using growth assays (e.g., germination assays and seedling root vigor assays) on sterile filter papers. Seeds were treated either with a single bacterial or fungal strain, or with a combination of two bacterial or two fungal strains. In some embodiments, seeds were treated with a combination of at least one bacterial and at least one fungal strain.

Experimental Description

Growth & Scale-Up of Bacteria for Inoculation

Each bacterial endophyte was streaked out onto 20% Tryptic Soy Agar, forming a lawn on regular Petri dishes (9 cm in diameter). Once the bacteria grew to high density, which happened after one or two days depending on the bacterial growth rate, a plate per bacterial strain was scraped with the aid of a sterile loop (filling the entire hole of the loop and producing a droplet of bacterial biomass of about 20 mg). The bacteria collected in this way were transferred into 1 ml of sterile 50 mM Phosphate Buffer Saline (PBS) in a microcentrifuge tube and fully resuspended by vortexing for ~20 sec at maximum speed. This method achieves highly concentrated (~0.5-1 optical density, corresponding to about $10^8$ CFU/mL) and viable bacteria pre-adapted to live coating a surface.

Growth & Scale-Up of Fungi for Inoculation

Fungal isolates were grown from a frozen stock on Petri dishes containing potato dextrose agar and the plates were incubated at room temperature for about a week. After mycelia and spore development, four agar plugs (1 cm in diameter) were used to inoculate erlenmeyers containing 150 ml of potato dextrose broth. Liquid cultures were grown at room temperature and agitation on an orbital shaker at 115 rpm for 4 days. Then, the cultures were transferred to 50 ml sterile test tubes with conical bottoms. Mycelium mats were disrupted by pulse sonication at 75% setting and 3 pulses of 20 seconds each, using a Fisher Scientific sonicator (Model FB120) with a manual probe (CL-18). The sonicated cultures were used in the same manner as the bacterial suspensions for seed inoculation.

Surface Sterilization of Seeds

Un-treated seeds (e.g., soy seeds or wheat seeds) were sterilized overnight with chlorine gas as follows: 200 g of seeds were weighed and placed in a 250 mL glass bottle. The opened bottle and its cap were placed in a dessicator jar in a fume hood. A beaker containing 100 mL of commercial bleach (8.25% sodium hypochlorite) was placed in the dessicator jar. Immediately prior to sealing the jar, 3 mL of concentrated hydrochloric acid (34-37.5%) were carefully added to the bleach. The sterilization was left to proceed for 17-24 h. After sterilization, the bottle was closed with its sterilized cap, and reopened in a sterile flow hood. The opened bottle was left in the sterile hood for a couple hours to air out the seeds and remove chlorine gas leftover. The bottle was then closed and the seeds stored at room temperature in the dark until use.

Preparation of Synthetic Compositions Comprising Plant Seeds and Endophytes The following procedure was used to coat seeds with a plurality of fungal endophyte inocula for planting in greenhouse and field trials. First, 3% Sodium alginate (SA) was prepared and autoclaved in the following manner. Erlenmeyer flasks were filled with the appropriate amount of deionized water and warmed to about 50 degrees. C on a heat plate with agitation using a stirring bar. SA powder was poured slowly into the water until it all dissolved. The solution was autoclaved (121° C. @15PSI for 30 minutes). Talcum powder was autoclaved in dry cycle (121° C. @15PSI for 30 minutes) and aliquoted in Ziploc bags or 50 ml falcon tubes at a ratio of 15 g per kg of seed to be treated for formulation controls and 10 g per kg of seed for actual treatments.

The next day, seeds were treated with either powdered or liquid formulations.

For powdered formulations, 10 g per kg of seed was allocated to the seeds to be treated, according to the following procedure. Seeds were placed in large plastic container. 16.6 ml of 2% SA per Kg of seeds to be treated were poured on the seeds. The container was covered and shaken slowly in orbital motion for about 20 seconds to disperse the SA. Endophyte powder was mixed with an equal amount of talcum powder. The mix of endophytes and talc was added on top of the seeds, trying to disperse it evenly. The container was covered and seeds are shaken slowly in orbital motion for about 20 seconds. 13.3 ml of Flo-rite per kg of seed to be treated was poured on the seeds. Seeds were shaken again, slowly and in orbital motion.

For liquid formulations, 8.5 mL per seed was allocated to the seeds to be treated, according to the following procedure. Seeds were placed in large plastic container. 8.3 ml of 2% SA per kg of seed and the same amount of bacterial culture (8.3 ml per kg of seed) was poured on the seeds. The container was covered and shaken slowly in orbital motion for about 20 seconds to disperse the SA. 15 g of talcum powder per kg of seed was added, trying to disperse it evenly. The container was covered and seeds were shaken slowly in orbital motion for about 20 seconds. 13.3 ml of Flo-rite per kg of seed to be treated are poured on the seeds. Seeds were shaken again, slowly and in orbital motion. For soy seeds, 10 μL of sodium alginate and inoculum were applied for every one gram of seeds. For wheat seeds, the amount of SA and bacterial suspension or fungal inoculum was adjusted to 15 ml/kg to account for the larger surface to volume ratio of these small seeds.

Testing for Germination Enhancement Under Drought Stress

Polyethylene glycol (PEG) is an inert, water-binding polymer with a non-ionic and virtually impermeable long chain that accurately mimics drought stress under dry-soil conditions. The higher the concentration of PEG, the lower the water potential achieved, thus inducing higher water stress in a watery medium. To determine germination enhancement in seeds, the interiors of which are colonized by microbial strains, the effect of osmotic potential on germination is tested at a range of water potential representative of drought conditions following Perez-Fernandez et al. [J. Environ. Biol. 27: 669-685 (2006)]. The range of water potentials simulates those that are known to cause drought stress in a range of cultivars and wild plants, (−0.05 MPa to −5 MPa). The appropriate concentration of polyethylene glycol (6000) required to achieve a particular water potential was determined following Michel and Kaufmann (Plant Physiol., 51: 914-916 (1973)) and further modifications by Hardegree and Emmerich (Plant Physiol., 92, 462-466 (1990)). The final equation used to determine amounts of PEG is: $\Psi=0.130\,[PEG]^2\,T-13.7\,[PEG]^2$; where the osmotic potential ($\Psi$) is a function of temperature (T).

Soy Seedling Germination Assay in Drought Conditions

For each SYM tested in the germination assay, ten (10) SYM-coated soy seeds were placed on a 150 mm Petri plate that contained a single heavy germination paper (SD5-1/4 76# heavy weight seed germination paper, Anchor Paper Co., St. Paul, Minn.). To each petri plate, 10 mL 8% polyethylene glycol (PEG 6000) was added for germination screening assays in drought conditions. Plates were covered and incubated at in the dark at 22° Celcius and 60% relative humidity for four days for bacterial SYM strains) or five days for fungal SYM strains. All experiments were done in triplicate under sterile conditions. Seedlings were scored based on germination percentage relative to formulation only and non-treated seedling controls at the end of the incubation period. Exemplary soy germination results under drought conditions are shown in Table A.

TABLE A

Soy germination assay results

| Crop | SYM1 | SYM2 | Ave (% toNT) | Type |
|---|---|---|---|---|
| soy | SYM00057B | | 155.83 | bacteria |
| soy | SYM00074 | | 283.33 | bacteria |
| soy | SYM00091 | SYM00092D | 120.00 | bacterial plurality |
| soy | SYM00092D | | 175.83 | bacteria |
| soy | SYM00590 | | 141.18 | bacteria |
| soy | SYM00603 | | 135.29 | bacteria |
| soy | SYM00607 | SYM00091 | 115.00 | bacterial plurality |
| soy | SYM00607 | SYM00092D | 135.00 | bacterial plurality |
| soy | SYM00619 | | 212.50 | bacteria |
| soy | SYM00092D | SYM15879 | 140.00 | Bacterium-Fungus plurality |
| soy | SYM00092D | SYM15880 | 115.00 | Bacterium-Fungus plurality |
| soy | SYM00092D | SYM15934 | 115.00 | Bacterium-Fungus plurarlity |
| soy | SYM00299 | | 115.51 | fungi |
| soy | SYM00301 | | 123.02 | fungi |
| soy | SYM00577 | | 141.18 | fungi |
| soy | SYM01310 | | 135.29 | fungi |
| soy | SYM01311 | | 135.29 | fungi |
| soy | SYM01314 | | 135.29 | fungi |
| soy | SYM01330 | | 325.00 | fungi |
| soy | SYM15774 | | 115.98 | fungi |
| soy | SYM15783 | | 141.18 | fungi |
| soy | SYM15879 | SYM15934 | 110.00 | fungal plurality |
| soy | SYM15880 | SYM15884 | 158.82 | fungal plurality |

Soy Seedling Root Vigor Assay in Drought Conditions

For each SYM tested in the root vigor assay, ten (10) soy seeds were placed equidistant to each other on moistened heavy weight germination paper sandwiches. Each layer of the germination paper was pre-soaked in 25 mL of sterile distilled water. The germination paper sandwich was rolled, taped using surgical tape, placed in glass bottles and incubated at 22° Celcius with 60% relative humidity in dark for four (4) days to allow seed germination. On day five (5), bottle lids were removed and seed samples were placed in a growth chamber set to 25° Celcius, 70% RH, 250-300 microEinsten light for 12 hours and 18° Celcius, 60% RH dark 12 hours for five (5) days. Placement of bottles were randomized daily to reduce any positional effect throughout the incubation period. At the end of the experiment, each soy seedling was measured for total root length and compared relative to formulation only and non-treated seedling controls. Exemplary soy root vigor results under drought conditions are shown in Table B.

TABLE B

Soy root vigor assay results

| Crop | SYM1 | SYM2 | Ave(% toNT) | SE(% toNT) | Type |
|---|---|---|---|---|---|
| soy | SYM00057B | | 98.0 | 11.9 | bacteria |
| soy | SYM00074 | | 99.0 | 10.8 | bacteria |
| soy | SYM00091 | SYM00092D | 96.7 | 5.9 | bacterial plurality |
| soy | SYM00092D | | 87.9 | 12.9 | bacteria |
| soy | SYM00590 | | 100.6 | 11.8 | bacteria |
| soy | SYM00603 | | 118.2 | 9.3 | bacteria |
| soy | SYM00607 | SYM00091 | 82.3 | 5.1 | bacterial plurality |
| soy | SYM00607 | SYM00092D | 92.1 | 8.1 | bacterial plurality |
| soy | SYM00619 | | 99.0 | 12.4 | bacteria |
| soy | SYM00092D | SYM15879 | 72.6 | 8.7 | Bacterium - Fungus plurality |
| soy | SYM00092D | SYM15880 | 111.2 | 2.2 | Bacterium - Fungus plurality |
| soy | SYM00092D | SYM15934 | 82.8 | 9.7 | Bacterium - fungus plurality |
| soy | SYM00299 | | 92.5 | 10.0 | fungi |
| soy | SYM00301 | | 111.3 | 8.5 | fungi |
| soy | SYM00577 | | 132.4 | 3.3 | fungi |
| soy | SYM01310 | | 91.2 | 15.7 | fungi |
| soy | SYM01311 | | 97.6 | 12.3 | fungi |
| soy | SYM01314 | | 107.1 | 12.3 | fungi |
| soy | SYM01330 | | 97.6 | 16.0 | fungi |
| soy | SYM15774 | | 153.7 | 7.6 | fungi |
| soy | SYM15783 | | 137.1 | 7.6 | fungi |
| soy | SYM15879 | SYM15934 | 95.0 | 12.3 | fungal plurality |
| soy | SYM15880 | SYM15884 | 104.7 | 12.3 | fungal plurality |

Wheat Seedling Germination Assay in Drought Conditions

For each SYM tested, 25 uL of sonicated, 7-day old fungal culture or 3-day old bacteria culture was added into 15 mL of semi-solid solution [12.5% polyethylene glycol (PEG 6000) and 0.3% of agar] pre-aliquoted in a 90 mm deep well petri dish. After adding the SYM biomass, the petri dishes were horizontally shaken for even distribution of SYM biomass. Fifteen (15) surface-steriled wheat seeds were placed onto each petri dish. Plates were covered and incubated in the dark at 24° Celcius and 60% relative humidity for three days in a Conviron chamber. All experiments were done in triplicate under sterile conditions. Seedlings were scored by counting the number of germinated seedlings per dish and the performance of each SYM normalized as germination percentage relative to formulation only and non-treated seedling controls at the end of the incubation period. Exemplary wheat germination results under drought conditions are shown in Table C.

TABLE C

Wheat germination assay results

| Crop | SYM1 | SYM2 | Ave(% toNT) | SE(% toNT) | Type |
|---|---|---|---|---|---|
| wheat | SYM00044 | | 126.9 | 5.5 | bacteria |
| wheat | SYM00044 | SYM00021B | 150.0 | 0.0 | bacterial plurality |
| wheat | SYM00044 | SYM00074 | 136.4 | 7.9 | bacterial plurality |
| wheat | SYM00044 | SYM00879 | 145.5 | 18.2 | bacterial plurality |
| wheat | SYM00044 | SYM00879B | 136.4 | 7.9 | bacterial plurality |

TABLE C-continued

| Wheat germination assay results | | | | | |
|---|---|---|---|---|---|
| Crop | SYM1 | SYM2 | Ave(% toNT) | SE(% toNT) | Type |
| wheat | SYM00057B | | 107.4 | 11.5 | bacteria |
| wheat | SYM00057B | SYM00906 | 154.5 | 16.4 | bacterial plurality |
| wheat | SYM00057B | SYM01004 | 136.4 | 20.8 | bacterial plurality |
| wheat | SYM00074 | | 109.4 | 11.0 | bacteria |
| wheat | SYM00074 | SYM00092D | 131.8 | 9.1 | bacterial plurality |
| wheat | SYM00074 | SYM00290 | 131.8 | 12.0 | bacterial plurality |
| wheat | SYM00074 | SYM00879 | 131.8 | 12.0 | bacterial plurality |
| wheat | SYM00074 | SYM01004 | 136.4 | 7.9 | bacterial plurality |
| wheat | SYM00074 | SYM01022 | 154.5 | 16.4 | bacterial plurality |
| wheat | SYM00092D | | 118.6 | 7.4 | bacteria |
| wheat | SYM00092D | SYM00021B | 136.4 | 13.6 | bacterial plurality |
| wheat | SYM00092D | SYM00865 | 135.0 | 8.7 | bacterial plurality |
| wheat | SYM00092D | SYM00965 | 150.0 | 17.3 | bacterial plurality |
| wheat | SYM00212 | | 157.9 | 0.0 | bacteria |
| wheat | SYM00290 | | 119.6 | 6.8 | bacteria |
| wheat | SYM00290 | SYM00906 | 131.8 | 27.6 | bacterial plurality |
| wheat | SYM00290 | SYM01022 | 145.5 | 24.1 | bacterial plurality |
| wheat | SYM00696 | | 108.3 | 10.1 | bacteria |
| wheat | SYM00786 | SYM00865 | 140.0 | 18.0 | bacterial plurality |
| wheat | SYM00879 | | 111.4 | 7.2 | bacteria |
| wheat | SYM00879 | SYM01004 | 172.7 | 4.5 | bacterial plurality |
| wheat | SYM00879B | | 105.2 | 17.3 | bacteria |
| wheat | SYM00906 | | 125.0 | 7.2 | bacteria |
| wheat | SYM00906 | SYM01004 | 136.4 | 7.9 | bacterial plurality |
| wheat | SYM00965 | SYM00865 | 150.0 | 17.3 | bacterial plurality |
| wheat | SYM01004 | | 115.2 | 12.5 | bacteria |
| wheat | SYM01004 | SYM01022 | 140.9 | 16.4 | bacterial plurality |
| wheat | SYM01022 | | 115.5 | 9.3 | bacteria |
| wheat | SYM01158 | | 142.1 | 24.1 | bacteria |
| wheat | SYM01326 | | 103.8 | 8.5 | bacteria |
| wheat | SYM00157 | | 115.6 | 10.1 | fungi |
| wheat | SYM00157 | SYM15783 | 141.7 | 11.0 | fungal plurality |
| wheat | SYM00299 | | 121.4 | 10.6 | fungi |
| wheat | SYM00299 | SYM00696 | 145.8 | 11.0 | fungal plurality |
| wheat | SYM00299 | SYM01324 | 133.3 | 25.3 | fungal plurality |

TABLE C-continued

| Wheat germination assay results | | | | | |
|---|---|---|---|---|---|
| Crop | SYM1 | SYM2 | Ave(% toNT) | SE(% toNT) | Type |
| wheat | SYM00299 | SYM15783 | 137.5 | 0.0 | fungal plurality |
| wheat | SYM00301 | | 112.7 | 10.1 | fungi |
| wheat | SYM00301 | SYM01326 | 133.3 | 15.0 | fungal plurality |
| wheat | SYM00301 | SYM15774 | 145.8 | 11.0 | fungal plurality |
| wheat | SYM01324 | | 114.2 | 8.8 | fungi |
| wheat | SYM01326 | SYM12462 | 129.2 | 11.0 | fungal plurality |
| wheat | SYM12462 | SYM15774 | 133.3 | 18.2 | fungal plurality |
| wheat | SYM12462 | SYM15783 | 141.7 | 16.7 | fungal plurality |
| wheat | SYM15774 | | 122.4 | 9.5 | fungi |
| wheat | SYM15774 | SYM01324 | 137.5 | 12.5 | fungal plurality |
| wheat | SYM15783 | | 120.0 | 5.4 | fungi |
| wheat | SYM15783 | SYM01324 | 129.2 | 8.3 | fungal plurality |
| wheat | SYM15879 | | 99.4 | 8.5 | fungi |
| wheat | SYM15880 | SYM15888 | 159.1 | 12.0 | fungal plurality |

Wheat Seedling Root Vigor Assay in Drought Conditions

For each SYM tested, twelve (12) SYM-coated wheat seeds were placed onto a 125 mm filter paper pre-wet with 5 mL of 12.5% polyethylene glycol (PEG 6000). The seeds were arranged in a circular formation and with embryo facing toward the center of the filter paper. Plates were covered and incubated in the dark at 24° Celcius and 60% relative humidity for three days in a Conviron chamber. All experiments were done in triplicate under sterile conditions. At the end of the incubation period, images were taken for each plate and root length were measured (in pixel) on the images using ImageJ and the pixel was finally converted into cm based on an internal standard. The performance of each SYM was normalized as root length percentage relative to formulation only and non-treated seedling controls. Exemplary wheat root vigor results under drought conditions are shown in Table D.

TABLE D

| Wheat root vigor assay results | | | | | |
|---|---|---|---|---|---|
| Crop | SYM1 | SYM2 | Ave (% to NT) | SE (% to NT) | Type |
| wheat | SYM00021B | | 104.0 | 4.4 | bacteria |
| wheat | SYM00044 | | 101.4 | 4.0 | bacteria |
| wheat | SYM00044 | SYM00021B | 111.7 | 3.7 | bacterial plurality |
| wheat | SYM00044 | SYM00074 | 101.9 | 5.1 | bacterial plurality |
| wheat | SYM00044 | SYM00879 | 105.4 | 4.6 | bacterial plurality |
| wheat | SYM00044 | SYM00879B | 107.6 | 5.0 | bacterial plurality |
| wheat | SYM00057B | | 102.8 | 4.6 | bacteria |
| wheat | SYM00057B | SYM00906 | 118.7 | 5.4 | bacterial plurality |
| wheat | SYM00057B | SYM01004 | 104.1 | 4.8 | bacterial plurality |
| wheat | SYM00074 | | 111.2 | 5.6 | bacteria |
| wheat | SYM00074 | SYM00092D | 99.5 | 4.4 | bacterial plurality |
| wheat | SYM00074 | SYM00290 | 103.5 | 4.3 | bacterial plurality |
| wheat | SYM00074 | SYM00879 | 107.8 | 4.6 | bacterial plurality |
| wheat | SYM00074 | SYM01004 | 110.8 | 4.7 | bacterial plurality |
| wheat | SYM00074 | SYM01022 | 102.9 | 4.7 | bacterial plurality |
| wheat | SYM00092D | | 112.1 | 3.8 | bacteria |
| wheat | SYM00092D | SYM00021B | 103.5 | 5.8 | bacterial plurality |
| wheat | SYM00092D | SYM00865 | 105.2 | 5.5 | bacterial plurality |

TABLE D-continued

| Wheat root vigor assay results | | | | | |
|---|---|---|---|---|---|
| Crop | SYM1 | SYM2 | Ave (% to NT) | SE (% to NT) | Type |
| wheat | SYM00092D | SYM00965 | 119.2 | 4.5 | bacterial plurality |
| wheat | SYM00212 | | 117.7 | 5.6 | bacteria |
| wheat | SYM00290 | | 103.2 | 6.3 | bacteria |
| wheat | SYM00290 | SYM00906 | 103.1 | 5.5 | bacterial plurality |
| wheat | SYM00290 | SYM01022 | 112.7 | 4.0 | bacterial plurality |
| wheat | SYM00696 | | 162.0 | 19.6 | bacteria |
| wheat | SYM00786 | SYM00865 | 111.3 | 4.3 | bacterial plurality |
| wheat | SYM00879 | | 102.0 | 4.9 | bacteria |
| wheat | SYM00879 | SYM01004 | 111.5 | 5.3 | bacterial plurality |
| wheat | SYM00879B | | 102.3 | 5.8 | bacteria |
| wheat | SYM00906 | | 118.3 | 5.2 | bacteria |
| wheat | SYM00906 | SYM01004 | 111.1 | 5.3 | bacterial plurality |
| wheat | SYM00965 | SYM00865 | 111.3 | 5.5 | bacterial plurality |
| wheat | SYM01004 | | 111.6 | 4.9 | bacteria |
| wheat | SYM01004 | SYM01022 | 108.2 | 5.6 | bacterial plurality |
| wheat | SYM01022 | | 102.1 | 6.3 | bacteria |
| wheat | SYM01158 | | 117.0 | 5.6 | bacteria |
| wheat | SYM00157 | | 128.1 | 17.9 | fungi |
| wheat | SYM00157 | SYM15783 | 234.4 | 13.5 | fungal plurality |
| wheat | SYM00299 | | 140.3 | 11.2 | fungi |
| wheat | SYM00299 | SYM00696 | 47.4 | 11.5 | fungal plurality |
| wheat | SYM00299 | SYM01324 | 72.6 | 15.9 | fungal plurality |
| wheat | SYM00299 | SYM15783 | 90.2 | 14.2 | fungal plurality |
| wheat | SYM00301 | | 183.7 | 17.0 | fungi |
| wheat | SYM00301 | SYM01326 | 28.9 | 8.2 | fungal plurality |
| wheat | SYM00301 | SYM15774 | 226.9 | 17.2 | fungal plurality |
| wheat | SYM01324 | | 181.9 | 18.5 | fungi |
| wheat | SYM01326 | | 62.4 | 14.1 | fungi |
| wheat | SYM01326 | SYM12462 | 60.4 | 10.6 | fungal plurality |
| wheat | SYM01329 | | 195.7 | 15.0 | fungi |
| wheat | SYM01330 | | 102.7 | 8.2 | fungi |
| wheat | SYM12462 | | 96.3 | 15.7 | fungi |
| wheat | SYM12462 | SYM15774 | 17.6 | 7.8 | fungal plurality |
| wheat | SYM12462 | SYM15783 | 198.2 | 16.3 | fungal plurality |
| wheat | SYM15774 | | 143.4 | 5.2 | fungi |
| wheat | SYM15774 | SYM01324 | 102.5 | 16.2 | fungal plurality |
| wheat | SYM15783 | | 119.0 | 14.8 | fungi |
| wheat | SYM15783 | SYM01324 | 61.5 | 13.2 | fungal plurality |
| wheat | SYM15879 | | 158.9 | 15.2 | fungi |
| wheat | SYM15880 | SYM15888 | 148.6 | 13.3 | fungal plurality |

Discussion

Plant vigor and improved stress resilience are important components of providing fitness to a plant in an agricultural setting. These were measured in germination assays and seedling root vigor assays to test the improvement on plant phenotype as conferred by microbial inoculation. The collection of seed-derived endophytes produced a measurable response in soy and wheat when inoculated as compared to non-inoculated controls, as shown in Table A, Table B, Table C and Table D. For example, most of the strains tested were found to produce a favorable phenotype in any of the measured multiple parameters such as germination efficiency, root length, or shoot length, suggesting that the strains play an intimate role modulating and improving plant vigor and conferring stress resilience to the host plant. The stress responses in the strain collection can be seen by the ability of a subgroup to confer a beneficial response under different conditions such as water stress. These can be applicable to products for arid and marginal lands. In a large proportion of cases for the tested strains, the beneficial effect was measurable in several crops. In one aspect of the invention, it is understood that beneficial strains described herein are capable of colonizing multiple varieties and plant species.

Example 3: Synthetic Compositions Comprising Plant Seeds and a Single Endophyte Strain or a Plurality of Endophyte Strains Confer Benefits to Agricultural Plants This Example describes the ability of synthetic compositions comprising plant seeds and a single endophyte strain or a plurality of endophyte strains described herein, to confer beneficial traits to a host plant. Among other things, this Example describe the ability of endophytes (e.g., bacterial and fungal endophytes described herein) to confer beneficial traits on a variety of host plants, including but not limited to, dicots (e.g., soy, peanuts) and monocots (e.g., corn, soy, wheat, cotton, sorghum), and combinations thereof. Endophyte-inoculated seeds (e.g., seeds described herein) are tested under normal conditions, biotic stress, heat stress, cold stress, high salt stress, soil with high metal content, and combinations thereof, in seed germination assays and seedling root vigor assays to test whether one or more endophytes confer an increase in tolerance to one or more stresses. Growth tests are performed using growth assays (e.g., germination assays and seedling root vigor assays) on sterile filter papers. In some embodiments, seeds are treated either with a single bacterial or fungal strain, or with a combination of two bacterial or two fungal strains. In some embodiments, seeds are treated with two or more bacterial or fungal strains. In some embodiments, seeds are treated with a combination of at least one bacterial and at least one fungal strain.

Growth and scale-up of bacteria and fungi for inoculation, surface sterilization of seeds, and seed coating are performed as described herein.

Testing for Germination Enhancement in Normal Conditions

Standard Germination Tests are used to assess the ability of the endophyte to enhance the seeds' germination and early growth. Briefly, 400 seeds (e.g., seeds described herein) are coated with one or more endophytes described herein, and are placed in between wet brown paper towels (8 replicates with 50 seeds each). An equal number of seeds are treated with formulation only. Paper towels are placed on top of 1×2 feet plastic trays and maintained in a growth chamber set at 25° C. and 70% humidity for 7 days. Seedlings are scored based on germination percentage relative to formulation only and non-treated seedling controls Testing for Germination Enhancement Under Biotic Stress A modification of the method developed by Hodgson [Am. Potato. J. 38: 259-264 (1961)] is used to test germination enhancement in microbe-colonized seeds under biotic stress. Biotic stress is understood as a concentration of inocula in the form of cell (bacteria) or spore suspensions (fungus) of a known pathogen for a particular crop (e.g., *Pantoea stewartii* or *Fusarium graminearum* for *Zea mays* L.). Briefly, for each level of biotic stress, 400 seeds (e.g., seeds described herein), the interiors of which are colonized by microbial strains, and 400 seed controls (lacking the microbial strains), are placed in between brown paper towels: 8 replicates with 50 seeds each for each treatment (microbe-colonized and control). Each one of the replicates is placed inside a large petri dish (150 mm in diameter). The towels are then soaked with 10 mL of pathogen cell or spore suspension at a concentration of $10^4$ to $10^8$ cells/spores per mL. Each level corresponds with an order of magnitude increment in concentration (thus, 5 levels). The petri dishes are maintained in a growth chamber set at 25° C. and 70% humidity for 7 days. The proportion of seeds that germinate successfully is compared between the seeds coming from microbe-colonized plants with those coming from controls for each level of biotic stress.

Testing for Germination Enhancement in Heat Conditions

Standard Germination Tests are used to determine if a microbe colonizing the interior of a seed protects maize against heat stress during germination. Briefly, 400 seeds (e.g, seeds described herein), the interiors of which are colonized by microbial strains are placed in between wet brown paper towels (8 replicates with 50 seeds each). An equal number of seeds obtained from control plants that lack the microbe is treated in the same way. The paper towels are placed on top of 1×2 ft plastic trays and maintained in a growth chamber set at 16:8 hour light:dark cycle, 70% humidity, and at least 120 μE/m2/s light intensity for 7 days. A range of high temperatures (from 35° C. to 45° C., with increments of 2 degrees per assay) is tested to assess the germination of microbe-colonized seeds at each temperature. The proportion of seeds that germinate successfully is compared between the seeds coming from microbe-colonized plants and those coming from controls.

Testing for Germination Enhancement in Cold Conditions

Standard Germination Tests are used to determine if a microbe colonizing the interior of a seed protects maize against cold stress during germination. Briefly, 400 seeds (e.g., seeds described herein), the interiors of which are colonized by microbial strains are placed in between wet brown paper towels (8 replicates with 50 seeds each). An equal number of seeds obtained from control plants that lack the microbe is treated in the same way. The paper towels are placed on top of 1×2 ft plastic trays and maintained in a growth chamber set at 16:8 hour light:dark cycle, 70% humidity, and at least 120 μE/m2/s light intensity for 7 days. A range of low temperatures (from 0° C. to 10° C., with increments of 2 degrees per assay) is tested to assess the germination of microbe-colonized seeds at each temperature. The proportion of seeds that germinate successfully is compared between the seeds coming from microbe-colonized plants and those coming from controls.

Testing for Germination Enhancement in High Salt Concentrations

Germination experiments are conducted in 90 mm diameter petri dishes. Replicates consist of a Petri dish, watered with 10 mL of the appropriate solution and 20 seeds floating in the solution. 400 seeds (e.g., seeds described herein), the interiors of which are colonized by microbial strains, and 400 seed controls (lacking the microbial strains) are tested in this way (40 petri dishes total). To prevent large variations in salt concentration due to evaporation, dishes are sealed with parafilm and the saline solutions are renewed weekly by pouring out the existing saline solution in the petri dish and adding the same amount of fresh solution. A range of saline solutions (100-500 mM NaCl) is tested for to assess the germination of microbe-colonized seeds at varying salt levels. Petri dishes are maintained in a growth chamber set at 25° C., 16:8 hour light:dark cycle, 70% humidity, and at least 120 μE/m2/s light intensity. The proportion of seeds that germinates successfully after two weeks is compared between the seeds coming from inoculated plants and those coming from controls.

Testing for Germination Enhancement in Soils with High Metal Content

Standard Germination Tests are used to determine if a microbe colonizing the interior of a seed protects maize against stress due to high soil metal content during germination. Briefly, 400 seeds (e.g., seeds described herein), the interiors of which are colonized by microbial strains, are placed in between wet brown paper towels (8 replicates with 50 seeds each). An equal number of seeds obtained from control plants that lack the microbe (microbe-free) is treated in the same way. The paper towels are placed on top of 1×2 ft plastic trays with holes to allow water drainage. The paper towels are covered with an inch of sterile sand. For each metal to be tested, the sand needs to be treated appropriately to ensure the release and bioavailability of the metal. For example, in the case of aluminum, the sand is watered with pH 4.0+~1 g/Kg soil Al+3 (−621 uM). The trays are maintained in a growth chamber set at 25° C. and 70% humidity for 7 days. The proportion of seeds that germinates successfully is compared between the seeds coming from microbe-colonized plants and those coming from controls.

Testing for Growth Promotion in Growth Chamber in Normal Conditions

Soil is made from a mixture of 60% Sunshine Mix #5 (Sun Gro; Bellevue, Wash., USA) and 40% vermiculite. To determine if a particular microbe colonizing the interior of seeds is capable of promoting plant growth under normal conditions, 24 pots are prepared in two 12-pot no-hole flat trays with 28 grams of dry soil in each pot, and 2 L of filtered water is added to each tray. The water is allowed to soak into the soil and the soil surface is misted before seeding. For each seed-microbe combination, 12 pots are seeded with 3-5 seeds colonized by the microbe and 12 pots are seeded with 3-5 seeds lacking the microbe (microbe-free plants). The seeded pots are covered with a humidity dome and kept in the dark for 3 days, after which the pots are transferred to a growth chamber set at 25° C., 16:8 hour light:dark cycle, 70% humidity, and at least 120 μE/m2/s light intensity. The humidity domes are removed on day 5, or when cotyledons are fully expanded. After removal of the domes, each pot is irrigated to saturation with 0.5× Hoagland's solution, then allowing the excess solution to drain. Seedlings are then thinned to 1 per pot. In the following days, the pots are irrigated to saturation with filtered water, allowing the excess water to drain after about 30 minutes of soaking, and the weight of each 12-pot flat tray is recorded weekly. Canopy area is measured at weekly intervals. Terminal plant height, average leaf area and average leaf length are measured at the end of the flowering stage. The plants are allowed to dry and seed weight is measured. Significance of difference in growth between microbe-colonized plants and controls lacking the microbe is assessed with the appropriate statistical test depending on the distribution of the data at $p<0.05$.

Testing for Growth Promotion in Growth Chamber Under Biotic Stress

Soil is made from a mixture of 60% Sunshine Mix #5 (Sun Gro; Bellevue, Wash., USA) and 40% vermiculite. To determine if a particular microbe colonizing the interior of seeds is capable of promoting plant growth in the presence of biotic stress, 24 pots are prepared in two 12-pot no-hole flat trays with 28 grams of dry soil in each pot, and 2 L of filtered water is added to each tray. The water is allowed to soak into the soil before planting. For each seed-microbe combination test, 12 pots are seeded with 3-5 seeds colonized by the microbe and 12 pots are seeded with 3-5 seeds lacking the microbe (microbe-free plants). The seeded pots are covered with a humidity dome and kept in the dark for 3 days, after which the pots are transferred to a growth chamber set at 25° C., 16:8 hour light:dark cycle, 70% humidity, and at least 120 μE/m2/s light intensity. The humidity domes are removed on day 5, or when cotyledons are fully expanded. After removal of the domes, each pot is irrigated to saturation with 0.5× Hoagland's solution, allowing the excess solution to drain. Seedlings are then thinned to 1 per pot. In the following days, the pots are irrigated to saturation with filtered water, allowing the excess water to drain after about 30 minutes of soaking.

Several methods of inoculation are used depending on the lifestyle of the pathogen. For leaf pathogens (e.g., *Pseudomonas syringeae* or *Colletotrichum graminicola*), a suspension of cells for bacteria ($10^8$ cell/mL) or spores for fungi ($10^7$ spores/mL) is applied with an applicator on the adaxial surface of each of the youngest fully expanded leaves. Alternatively for fungal pathogens that do not form conidia easily, two agar plugs containing mycelium (~4 mm in diameter) are attached to the adaxial surface of each of the youngest leaves on each side of the central vein. For vascular pathogens (e.g., *Pantoea stewartii* or *Fusarium moniliforme*), the suspension of cells or spores is directly introduced into the vasculature (5-10 μL) through a minor injury inflected with a sterile blade. Alternatively, the seedlings can be grown hydroponically in the cell/spore or mycelium suspension. To test the resilience of the plant-microbe combination against insect stresses, such as *thrips* or aphids, plants are transferred to a specially-designated growth chamber containing the insects. Soil-borne insect or nematode pathogens are mixed into or applied topically to the potting soil. In all cases, care is taken to contain the fungal, insect, nematode or other pathogen and prevent release outside of the immediate testing area.

The weight of each 12-pot flat tray is recorded weekly. Canopy area is measured at weekly intervals. Terminal plant height, average leaf area and average leaf length are measured at the cease of flowering. The plants are allowed to dry and seed weight is measured. Significance of difference in growth between microbe-colonized plants and controls lacking the microbe is assessed with the appropriate statistical test depending on the distribution of the data at $p<0.05$.

Example 4—Functional Characterization of Endophytes

Auxin Production Assay

Auxin is an important plant hormone, which can promote cell enlargement and inhibit branch development (meristem activity) in above ground plant tissues, while below ground it has the opposite effect, promoting root branching and growth. Interestingly, plant auxin is manufactured above ground and transported to the roots. It thus follows that plant, and especially root inhabiting microbes which produce significant amounts of auxin, will be able to promote root branching and development even under conditions where the plant reduces its own production of auxin. Such conditions can exist for example when soil is flooded and roots encounter an anoxic environment.

Indole containing IAA is able to generate a pinkish chromophore under acidic conditions in the presence of ferric chloride. For auxin measurement, 1 μl of overnight-grown cultures of endophytic bacterial strains were inoculated into 750 μl of R2A broth supplemented with L-TRP (5 mM) in 2-mL 96 well culture plates. The plates were sealed with a breathable membrane and incubated at 23° C. with constant shaking at 200 rpm for 4 days. To measure auxin production by fungal strains, 3 μl of 5-day old liquid fungal cultures were inoculated into 1 ml R2A broth supplemented with L-TRP (5 mM) in 24-well culture plates. The plates were sealed with breathable tape and incubated at 23° C. with constant shaking at 130 rpm for 4 days. After 4 days, 100 μL of each culture was transferred to a 96 well plate. 25 μL of Salkowski reagent (1 mL of FeCl3 0.5 M solution to 50 mL of 35% HClO4) was added into each well and the plates were incubated in the dark for 30 minutes before taking picture and measuring 540 nm absorption using the SpectraMax M5 plate reader (Molecular Devices). Dark pink halos around colonies are visualized in the membrane by background illumination using a light table.

Endophytes were screened for their ability to produce auxins as possible root, growth promoting agents. Four replicates were performed for each strain assayed. Exemplary auxin production results for endophytes belonging to core OTUs are presented below in Table E, Table F, and Table G.

Acetoin and Diacetyl Production Assay

For acetoin measurements, microbial strains were cultured as described above in R2A broth supplemented with 5% glucose. After 4 days, 100 μL of each culture was transferred to a 96 well plate and mixed with 25 μL Barritt's Reagents A and B and 525 nm absorption was measured. Barritt's Reagents A and B were prepared by mixing 5 g/L creatine mixed 3:1 (v/v) with freshly prepared alpha-naphthol (75 g/L in 2.5 M sodium hydroxide). After 15 minutes, plates are scored for red or pink colouration against a copper coloured negative control. Four replicates were performed for each strain assayed. Exemplary acetoin production results for endophytes belonging to core OTUs are presented below in Table E, Table F, and Table G.

Siderophore Production Assay

To ensure no contaminating iron is carried over from previous experiments, all glassware is deferrated with 6 M HCl and water prior to media preparation. For siderophore measurements, microbial strains were cultured as described above in R2A broth. After 3 days of incubation at 25° C., plates are overlaid with 0-CAS overlay. Again using the cleaned glassware, 1 liter of 0-CAS overlay is made by mixing 60.5 mg of Chrome azurol S (CAS), 72.9 mg of hexadecyltrimethyl ammonium bromide (HDTMA), 30.24 g of finely crushed Piperazine-1,4-bis-2-ethanesulfonic acid (PIPES) with 10 mL of 1 mM $FeCl_3.6H_2O$ in 10 mM HCl solvent. The PIPES had to be finely powdered and mixed gently with stirring (not shaking) to avoid producing bubbles, until a dark blue colour is achieved. Melted 1% agarose is then added to pre-warmed O-CAS just prior pouring the overlay in a proportion of 1:3 (v/v). After 15 minutes, colour change is scored by looking for purple halos (catechol type siderophores) or orange colonies (hydroxamate siderophores). Four replicates were performed for each strain assayed.

In many environments, iron is a limiting nutrient for growth. A coping mechanism which many microbes have developed is to produce and secrete iron chelating compounds called siderophores which often only that particular species or strain has the means to re-uptake and interact with to release the bound iron, making it available for metabolism. A fringe effect of siderophore production and secretion is that a siderophore secreting microbes can remove all the bio-available iron in its environment, making it difficult for a competing species to invade and grow in that micro-environment.

Siderophore production by microbes on a plant surface or inside a plant may both show that a microbe is equipped to grow in a nutrient limited environment, and perhaps protect the plant environment from invasion by other, perhaps undesirable microbes. Exemplary siderophore production results for endophytes belonging to core OTUs are presented below in Table E, Table F, and Table G.

TABLE E

Auxin, siderophore, and acetoin production by bacterial endophytes belonging to core OTUs;

| Strain | SEQ ID NO. | Secretes siderophores | Produces Auxin/Indoles | Produces Acetoin |
|---|---|---|---|---|
| SYM00003 | 290 | 2 | 1 | 0 |
| SYM00009 | 291 | 1 | 1 | 0 |
| SYM00013 | 292 | 0 | 1 | 0 |
| SYM00017A | 293 | 1 | 3 | 0 |
| SYM00018 | 294 | 0 | 3 | 2 |
| SYM00020 | 295 | 0 | 2 | 2 |
| SYM00021b | 296 | 0 | 2 | 3 |
| SYM00025 | 297 | 1 | 3 | 2 |
| SYM00043 | 300 | 1 | 3 | 2 |
| SYM00044 | 301 | 1 | 1 | 3 |
| SYM00050 | 302 | 1 | 2 | 3 |
| SYM00053 | 303 | 1 | 1 | 2 |
| SYM00062C | 305 | 1 | 2 | 1 |
| SYM00068 | 308 | 2 | 2 | 0 |
| SYM00070 | 309 | 2 | 2 | 0 |
| SYM00074 | 310 | 2 | 3 | 0 |
| SYM00103 | 311 | 2 | 2 | 2 |
| SYM00183 | 322 | 0 | 2 | 1 |
| SYM00184 | 323 | 0 | 2 | 0 |
| SYM00207 | 324 | 1 | 2 | 2 |
| SYM00212 | 325 | 2 | 2 | 3 |
| SYM00219 | 326 | 3 | 2 | 3 |
| SYM00234 | 327 | 2 | 2 | 2 |
| SYM00236 | 328 | 0 | 2 | 0 |
| SYM00248 | 329 | 1 | 2 | 0 |
| SYM00249 | 330 | 2 | 2 | 2 |
| SYM00506c | 331 | 0 | 2 | 2 |
| SYM00507 | 332 | 1 | 2 | 2 |
| SYM00508 | 333 | 0 | 3 | 2 |
| SYM00525 | 525 | 2 | 2 | 3 |
| SYM00538A | 335 | 3 | 2 | 3 |
| SYM00538B | 336 | 2 | 2 | 2 |
| SYM00538i | 337 | 0 | 1 | 0 |
| SYM00543 | 338 | 0 | 3 | 1 |
| SYM00545 | 339 | 2 | 2 | 2 |
| SYM00549 | 340 | 2 | 2 | 2 |
| SYM00563 | 341 | 2 | 2 | 1 |
| SYM00574 | 343 | 3 | 1 | 0 |
| SYM00617 | 347 | 1 | 3 | 1 |
| SYM00620 | 348 | 1 | 3 | 0 |
| SYM00627 | 350 | 0 | 1 | 3 |
| SYM00628 | 351 | 2 | 2 | 3 |
| SYM00646 | 353 | 3 | 2 | 3 |
| SYM00650 | 354 | 2 | 2 | 0 |
| SYM00662 | 355 | 1 | 1 | 1 |
| SYM00714 | 358 | 1 | 2 | 2 |
| SYM00905 | 365 | 3 | 2 | 2 |
| SYM00924 | 366 | 2 | 2 | 2 |
| SYM00963 | 367 | 2 | 2 | 1 |
| SYM00978 | 370 | 2 | 2 | 1 |
| SYM00982 | 368 | 0 | 2 | 3 |
| SYM00987 | 369 | 1 | 3 | 2 |
| SYM00991 | 371 | 1 | 2 | 2 |
| SYM00999 | 372 | 1 | 1 | 3 |
| SYM01049 | 373 | 1 | 1 | 0 |

Legend:
0 = no production;
1 = low production;
2 = medium production;
3 = high production

TABLE F

Auxin, siderophore, and acetoin production by fungal endophytes belonging to core OTUs;

| Strain | SEQ ID NO. | Secretes siderophores | Produces Auxin/Indoles | Produces Acetoin |
|---|---|---|---|---|
| SYM00034 | 299 | 1 | 0 | 0 |
| SYM00061A | 304 | 1 | 0 | 2 |
| SYM00066 | 307 | 1 | 0 | 0 |
| SYM00120 | 312 | 1 | 0 | 0 |
| SYM00122 | 313 | 0 | 0 | 0 |
| SYM00123 | 314 | 1 | 0 | 3 |
| SYM00124 | 315 | 1 | 1 | 0 |
| SYM00129 | 316 | 0 | 1 | 0 |

TABLE F-continued

Auxin, siderophore, and acetoin production by fungal endophytes belonging to core OTUs;

| Strain | SEQ ID NO. | Secretes siderophores | Produces Auxin/Indoles | Produces Acetoin |
|---|---|---|---|---|
| SYM00135 | 317 | 0 | 1 | 0 |
| SYM00136 | 318 | 0 | 0 | 1 |
| SYM00151 | 319 | 1 | 1 | 0 |
| SYM00154 | 320 | 0 | 0 | 0 |
| SYM00566B | 342 | 3 | 0 | 0 |
| SYM00577 | 344 | 0 | 0 | 1 |
| SYM00590 | 345 | 0 | 1 | 2 |
| SYM00603 | 346 | 2 | 1 | 0 |
| SYM00622 | 349 | 1 | 0 | 2 |
| SYM00629 | 352 | 0 | 1 | 2 |
| SYM00663 | 356 | 2 | 1 | 2 |
| SYM00696 | 357 | 2 | 0 | 0 |
| SYM00741b | 360 | 0 | 0 | 0 |
| SYM00793 | 361 | 1 | 0 | 0 |
| SYM00795 | 362 | 1 | 0 | 1 |
| SYM00854 | 363 | 2 | 0 | 2 |
| SYM00880 | 364 | 2 | 1 | 2 |
| SYM01300 | 374 | 2 | 1 | 0 |
| SYM01310 | 376 | 0 | 2 | 0 |
| SYM01311 | 377 | 0 | 0 | 0 |
| SYM01314 | 378 | 2 | 1 | 0 |
| SYM01315 | 379 | 0 | 0 | 0 |
| SYM01325 | 380 | 0 | 0 | 2 |
| SYM01326 | 381 | 0 | 0 | 2 |
| SYM01327 | 382 | 2 | 1 | 2 |
| SYM01328 | 383 | 1 | 0 | 0 |
| SYM01333 | 384 | 0 | 0 | 0 |
| SYM15811 | 385 | 3 | 1 | 0 |
| SYM15820 | 386 | 1 | 0 | 0 |
| SYM15821 | 387 | 1 | 0 | 0 |
| SYM15825 | 388 | 0 | 0 | 2 |
| SYM15828 | 389 | 0 | 0 | 2 |
| SYM15831 | 390 | 2 | 1 | 2 |
| SYM15837 | 391 | 1 | 0 | 0 |
| SYM15839 | 392 | 2 | 0 | 0 |
| SYM15847 | 393 | 0 | 0 | 0 |
| SYM15870 | 394 | 0 | 0 | 0 |
| SYM15872 | 395 | 0 | 0 | 1 |
| SYM15890 | 396 | 0 | 0 | 2 |
| SYM15901 | 397 | 0 | 0 | 2 |
| SYM15920 | 398 | 2 | 0 | 2 |
| SYM15926 | 399 | 1 | 2 | 0 |
| SYM15928 | 400 | 0 | 0 | 0 |
| SYM15932 | 401 | 0 | 0 | 0 |
| SYM15939 | 402 | 0 | 1 | 0 |

Legend:
0 = no production;
1 = low production;
2 = medium production;
3 = high production

TABLE G

Exemplary siderophore, auxin, and acetoin production of microbial endophytes belonging to core OTUs;

| SYM | Taxonomy | Type | SEQ ID NO. | Secretes siderophores | Produces Auxin/Indoles | Produces Acetoin |
|---|---|---|---|---|---|---|
| SYM00021B | *Escherichia* sp. | bacteria | 296 | 1 | 1 | 3 |
| SYM00044 | *Escherichia* sp. | bacteria | 301 | 1 | 1 | 3 |
| SYM00057b | *Burkholderia* sp. | bacteria | 426 | 1 | 2 | 3 |
| SYM00074 | *Enterobacter* sp. | bacteria | 310 | 0 | 3 | 0 |
| SYM00091 | *Agrobacterium* sp. | bacteria | 427 | 2 | 2 | 0 |
| SYM00092D | *Brevundimonas* sp. | bacteria | 428 | 3 | 3 | 3 |
| SYM00157 | *Leptosphaerulina* sp. | fungi | 429 | 3 | 1 | 0 |
| SYM00212 | *Bacillus* sp. | bacteria | 325 | 0 | 0 | 3 |
| SYM00290 | *Acinetobacter* sp. | bacteria | 430 | 1 | 0 | 0 |
| SYM00300 | *Acremonium* sp. | fungi | 449 | 2 | 0 | 2 |
| SYM00301 | *Penicillium* sp. | fungi | 432 | 0 | 0 | 2 |
| SYM00577 | *Acremonium* sp. | fungi | 344 | 0 | 0 | 0 |
| SYM00619 | *Exiguobacterium* sp. | bacteria | 435 | 0 | 0 | 0 |
| SYM00865 | *Stenotrophomonas* sp. | bacteria | 451 | 2 | 1 | 1 |
| SYM00879 | *Methylobacterium* sp. | bacteria | 437 | 0 | 0 | 0 |
| SYM00879B | *Sphingomonas* sp. | bacteria | 438 | 3 | 1 | 0 |
| SYM00906 | *Stenotrophomonas* sp. | bacteria | 439 | 1 | 1 | 1 |
| SYM00965 | *Luteibacter* sp. | bacteria | 440 | 2 | 3 | 3 |
| SYM01004 | *Agrobacterium* sp. | bacteria | 441 | 1 | 2 | 2 |
| SYM01022 | *Curtobacterium* sp. | bacteria | 442 | 3 | 2 | 3 |
| SYM01158 | *Pantoea* sp. | bacteria | 452 | 1 | 1 | 1 |
| SYM01314 | *Fusarium* sp. | fungi | 378 | 2 | 1 | 0 |
| SYM01324 | *Aspergillus* sp. | fungi | 443 | 2 | 1 | 0 |
| SYM01326 | *Alternaria* sp. | fungi | 381 | 0 | 0 | 0 |
| SYM01329 | *Phoma* sp. | fungi | 444 | 1 | 0 | 2 |
| SYM01330 | *Rhizopus* sp. | fungi | 445 | 0 | 0 | 0 |
| SYM01331 | *Phoma* sp. | fungi | 450 | 0 | 0 | 1 |
| SYM12462 | *Cladosporium* sp. | fungi | 446 | 0 | 0 | 2 |
| SYM15774 | *Phoma* sp. | fungi | 447 | 0 | 0 | 1 |
| SYM15783 | *Alternaria* sp. | fungi | 448 | 0 | 0 | 2 |
| SYM15810 | *Fusarium* sp. | fungi | 453 | 0 | 2 | 1 |

TABLE G-continued

Exemplary siderophore, auxin, and acetoin production of microbial endophytes belonging to core OTUs;

| SYM | Taxonomy | Type | SEQ ID NO. | Secretes siderophores | Produces Auxin/Indoles | Produces Acetoin |
|---|---|---|---|---|---|---|
| SYM15879 | *Fusarium* sp. | fungi | 454 | 0 | 0 | 0 |
| SYM15880 | *Penicillium* sp. | fungi | 455 | 0 | 0 | 1 |

Legend:
0 = no production;
1 = low production;
2 = medium production;
3 = high production Assay for Growth on Nitrogen Free LGI Media All glassware is cleaned with 6 M HCl before media preparation. A new 96 deep-well plate (2 mL well volume) is filled with 250 ul/well of sterile LGI broth [per. L, 50 g Sucrose, 0.01 g $FeCl_3$-$6H_2O$, 0.8 g $K_3PO_4$, 0.2 g $MgSO_4$-$7H_2O$, 0.002 g $Na_2MoO_4$-$2H_2O$, pH 7.5]. Microbes are inoculated into the 96 wells simultaneously with a flame-sterilized 96 pin replicator. The plate is sealed with a breathable membrane, incubated at 28° C. without shaking for 3 days, and $OD_{600}$ readings taken with a 96 well plate reader.

A nitrogen fixing plant associated bacterium is able theoretically to add to the host's nitrogen metabolism, and the most famous beneficial plant associated bacteria, *rhizobia*, are able to do this within specially adapted organs leguminous plant grows for them to be able to do this. In some embodiments, seed associated microbes described herein are, able to fix nitrogen in association with developing seedling, regardless of whether they colonize the plant's surfaces or interior, and thereby add to the plant's nitrogen nutrition.

ACC Deaminase Activity Assay

Microbes are assayed for growth with ACC as their sole source of nitrogen. Prior to media preparation all glassware is cleaned with 6 M HCl. A 2 M filter sterilized solution of ACC (#1373A, Research Organics, USA) is prepared in water. 1 μl/mL of this is added to autoclaved LGI broth (see above), and 1 mL aliquots are placed in a new 96 well plate. The plate is sealed with a breathable membrane, incubated at 25° C. with gentle shaking for 5 days, and OD600 readings taken. Only wells that are significantly more turbid than their corresponding nitrogen free LGI wells are considered to display ACC deaminase activity.

Plant stress reactions are strongly impacted by the plant's own production and overproduction of the gaseous hormone ethylene. Ethylene is metabolized from its precursor 1-aminocyclopropane-1-carboxylate (ACC) which can be diverted from ethylene metabolism by microbial and plant enzymes having ACC deaminase activity. As the name implies, ACC deaminase removes molecular nitrogen from the ethylene precursor, removing it as a substrate for production of the plant stress hormone and providing for the microbe a source of valuable nitrogen nutrition.

Mineral Phosphate Solubilization Assay

Microbes are plated on tricalcium phosphate media. This is prepared as follows: 10 g/L glucose, 0.373 g/L $NH_4NO_3$, 0.41 g/L $MgSO_4$, 0.295 g/L NaCl, 0.003 $FeCl_3$, 0.7 g/L $Ca_3HPO_4$ and 20 g/L Agar, pH 6, then autoclaved and poured into 150 mm plates. After 3 days of growth at 25° C. in darkness, clear halos are measured around colonies able to solubilize the tricalcium phosphate.

RNAse Activity Assay 1.5 g of torula yeast RNA (# R6625, Sigma) is dissolved in 1 mL of 0.1 M $Na_2HPO_4$ at pH 8, filter sterilized and added to 250 mL of autoclaved R2A agar media which is poured into 150 mm plates. The bacteria from a glycerol stock plate are inoculated using a flame-sterilized 96 pin replicator, and incubated at 25° C. for 3 days. On day three, plates are flooded with 70% perchloric acid (#311421, Sigma) for 15 minutes and scored for clear halo production around colonies.

Pectinase Activity Assay

Adapting a previous protocol 0.2% (w/v) of citrus pectin (#76280, Sigma) and 0.1% triton X-100 are added to R2A media, autoclaved and poured into 150 mm plates. Bacteria are inoculated using a 96 pin plate replicator. After 3 days of culturing in the darkness at 25° C., pectinase activity is visualized by flooding the plate with Gram's iodine. Positive colonies are surrounded by clear halos.

Cellulase Activity Assay

Adapting a previous protocol, 0.2% carboxymethylcellulose (CMC) sodium salt (# C5678, Sigma) and 0.1% triton X-100 are added to R2A media, autoclaved and poured into 150 mm plates. Bacteria are inoculated using a 96 pin plate replicator. After 3 days of culturing in the darkness at 25° C., cellulose activity is visualized by flooding the plate with Gram's iodine. Positive colonies are surrounded by clear halos.

Antibiosis Assay

Bacteria or fungi are inoculated using a 96 pin plate replicator onto 150 mm Petri dishes containing R2A agar, then grown for 3 days at 25° C. At this time, colonies of either *E. coli* DH5α (gram negative tester), *Bacillus subtillus* ssp. *Subtilis* (gram positive tester), or yeast strain AH109 (fungal tester) are resuspended in 1 mL of 50 mM $Na_2HPO_4$ buffer to an $OD_{600}$ of 0.2, and 30 μl of this is mixed with 30 mL of warm LB agar. This is quickly poured completely over a microbe array plate, allowed to solidify and incubated at 37° C. for 16 hours. Antibiosis is scored by looking for clear halos around microbial colonies.

BIOLOG Characterization of Endophyte Substrate Metabolism

In addition to the auxin, acetoin, and siderophore assays described above, endophytes described herein were characterized for their ability to metabolize a variety of carbon substrates. Liquid cultures of microbe were first sonicated to achieve homogeneity. 1 mL culture of each strain was harvested by centrifugation for 10 minutes at 4500 RPM and subsequently washed three times with sterile distilled water to remove any traces of residual media. Microbial samples were resuspended in sterile distilled water to a final $OD_{590}$ of 0.2. Measurements of absorbance were taken using a SpectraMax M microplate reader (Molecular Devices, Sunnyvale, Calif.).

Sole carbon substrate assays were done using BIOLOG Phenotype MicroArray (PM) 1 and 2A MicroPlates (Hayward, Calif.). An aliquot of each bacterial cell culture (2.32 mL) were inoculated into 20 mL sterile IF-0a GN/GP Base inoculating fluid (IF-0), 0.24 mL 100× Dye F obtained from BIOLOG, and brought to a final volume of 24 mL with sterile distilled water. Negative control PM1 and PM2A assays were also made similarly minus bacterial cells to detect abiotic reactions. An aliquot of fungal culture (0.05 mL) of each strain were inoculated into 23.95 mL FF-1F medium obtained from BIOLOG. Microbial cell suspensions were stirred in order to achieve uniformity. One hundred microliters of the microbial cell suspension was added per well using a multichannel pipettor to the 96-well BIOLOG PM1 and PM2A MicroPlates that each contained 95 carbon sources and one water-only (negative control) well.

MicroPlates were sealed in paper surgical tape (Dynarex, Orangeburg, N.Y.) to prevent plate edge effects, and incubated stationary at 24° C. in an enclosed container for 70 hours. Absorbance at 590 nm was measured for all MicroPlates at the end of the incubation period to determine carbon substrate utilization for each strain and normalized relative to the negative control (water only) well of each plate (Garland and Mills, 1991; Barua et al., 2010; Siemens et al., 2012; Blumenstein et al., 2015). The bacterial assays were also calibrated against the negative control (no cells) PM1 and PM2A MicroPlates data to correct for any biases introduced by media on the colorimetric analysis (Borglin et al., 2012). Corrected absorbance values that were negative were considered as zero for subsequent analysis (Garland and Mills, 1991; Blumenstein et al., 2015) and a threshold value of 0.1 and above was used to indicate the ability of a particular microbial strain to use a given carbon substrate (Barua et al., 2010; Blumenstein et al., 2015). Additionally, bacterial MicroPlates were visually examined for the irreversible formation of violet color in wells indicating the reduction of the tetrazolium redox dye to formazan that result from cell respiration (Garland and Mills, 1991). Fungal PM tests were measured as growth assays and visual observation of mycelial growth in each well was made. Exemplary BIOLOG substrate utilization by endophytes described herein are presented in Table H, Table I, Table J, Table K, Table L, Table M, Table N, Table O, Table P, Table Q, Table R, Table S, Table T, and Table U.

TABLE H

Substrate utilization as determined by BIOLOG PM1 MicroPlates by bacterial endophytes belonging to OTUs present in landrace and wild corn and wheat seeds that are present in lower levels in modern corn and wheat seeds.

| | Strain/Substrate | | | | | |
|---|---|---|---|---|---|---|
| | SYM00013 | SYM00018 | SYM00183 | SYM00184 | SYM00219 | SYM00043 |
| D-Serine | NO | NO | NO | NO | NO | NO |
| D-Glucose-6-Phosphate | NO | NO | NO | NO | NO | YES |
| L-Asparagine | NO | NO | NO | NO | NO | NO |
| L-glutamine | NO | NO | NO | NO | NO | NO |
| Glycyl-L-Aspartic acid | YES | NO | NO | NO | NO | YES |
| Glycyl-L-Glutamic acid | NO | NO | YES | YES | NO | NO |
| Glycyl-L-Proline | NO | NO | YES | YES | NO | NO |
| L-Arabinose | YES | YES | NO | YES | NO | YES |
| D-Sorbitol | NO | NO | NO | YES | NO | NO |
| D-Galactonic acid-?-lactone | YES | YES | NO | NO | YES | YES |
| D-Aspartic acid | NO | NO | NO | NO | NO | NO |
| m-Tartaric acid | YES | YES | NO | NO | NO | YES |
| Citric acid | NO | NO | NO | NO | NO | NO |
| Tricarballylic acid | NO | NO | NO | NO | NO | NO |
| p-Hydroxy Phenyl acetic acid | NO | NO | NO | NO | NO | NO |
| N-Acetyl-D-Glucosamine | YES | YES | YES | YES | YES | YES |
| Glycerol | NO | NO | NO | NO | NO | YES |
| D-L-Malic acid | NO | NO | NO | YES | NO | YES |
| D-Glucosaminic acid | NO | YES | NO | NO | NO | YES |
| D-Glucose-1-Phosphate | NO | YES | NO | NO | NO | YES |
| m-Inositol | NO | YES | NO | YES | NO | YES |
| L-Serine | NO | NO | NO | NO | NO | NO |
| m-Hydroxy Phenyl Acetic acid | NO | NO | NO | NO | NO | NO |
| D-Saccharic acid | NO | NO | NO | YES | NO | YES |
| L-Fucose | NO | NO | NO | NO | NO | NO |
| D-Ribose | NO | YES | YES | YES | NO | YES |
| 1,2-Propanediol | NO | NO | NO | NO | NO | NO |
| D-Fructose-6-Phosphate | NO | YES | NO | NO | NO | NO |
| D-Threonine | NO | NO | NO | NO | NO | NO |
| L-Threonine | NO | NO | NO | NO | NO | NO |
| Tyramine | YES | YES | YES | NO | YES | NO |
| Succinic acid | NO | NO | NO | NO | NO | NO |
| D-Glucuronic acid | NO | NO | NO | NO | NO | NO |
| Tween 20 | NO | NO | NO | YES | NO | NO |
| Tween 40 | NO | NO | NO | NO | NO | YES |
| Tween 80 | NO | NO | YES | YES | NO | NO |
| Fumaric acid | NO | NO | NO | NO | NO | NO |
| L-Alanine | YES | YES | YES | YES | YES | YES |
| D-Psicose | NO | YES | NO | NO | NO | YES |
| D-Galactose | YES | YES | NO | YES | YES | YES |
| D-Gluconic acid | NO | YES | NO | NO | NO | YES |
| L-Rhamnose | NO | YES | NO | NO | YES | YES |
| a-Keto-Glutaric acid | NO | NO | YES | NO | NO | NO |

TABLE H-continued

Substrate utilization as determined by BIOLOG PM1 MicroPlates by bacterial endophytes belonging to OTUs present in landrace and wild corn and wheat seeds that are present in lower levels in modern corn and wheat seeds.

| | | | | | | |
|---|---|---|---|---|---|---|
| a-Hydroxy Glutaric acid-?-lactone | YES | NO | NO | YES | NO | NO |
| Bromo succinic acid | NO | NO | NO | NO | NO | NO |
| L-Alanyl-Glycine | YES | YES | YES | YES | NO | NO |
| L-Lyxose | NO | YES | NO | NO | NO | YES |
| L-Aspartic acid | NO | NO | YES | NO | NO | NO |
| D-L-a-Glycerol phosphate | NO | NO | NO | NO | NO | NO |
| D-Fructose | NO | NO | NO | YES | NO | YES |
| a-Keto-Butyric acid | NO | NO | NO | NO | NO | NO |
| a-Hydroxy Butyric acid | NO | NO | NO | NO | NO | NO |
| Propionic acid | NO | YES | NO | NO | NO | NO |
| Acetoacetic acid | NO | NO | NO | NO | NO | NO |
| Glucuronamide | NO | NO | NO | NO | NO | NO |
| L-Proline | NO | YES | YES | NO | NO | NO |
| D-Xylose | YES | YES | YES | YES | NO | YES |
| Acetic acid | NO | YES | NO | YES | NO | YES |
| a-Methyl-D-Galactoside | NO | NO | NO | NO | YES | NO |
| β-Methyl-D-glucoside | NO | YES | NO | YES | YES | YES |
| Mucic acid | YES | YES | YES | NO | NO | YES |
| N-acetyl-β-D-Mannosamine | NO | NO | NO | NO | NO | NO |
| Pyruvic acid | NO | YES | YES | YES | YES | YES |
| D-Alanine | YES | YES | YES | YES | YES | NO |
| L-Lactic acid | NO | NO | NO | NO | NO | YES |
| a-D-Glucose | NO | YES | YES | YES | NO | YES |
| a-D-Lactose | NO | NO | YES | YES | NO | NO |
| Adonitol | NO | YES | YES | NO | NO | NO |
| Glycolic acid | NO | NO | NO | NO | NO | NO |
| Mono Methyl Succinate | NO | NO | NO | NO | NO | NO |
| L-Galactonic-acid-?-lactone | NO | YES | YES | YES | YES | YES |
| D-Trehalose | NO | NO | NO | NO | NO | YES |
| Formic acid | NO | YES | NO | NO | NO | YES |
| Maltose | NO | YES | YES | YES | YES | YES |
| Lactulose | NO | NO | YES | YES | NO | NO |
| Maltotriose | NO | YES | YES | YES | YES | YES |
| Glyoxylic acid | NO | NO | NO | NO | NO | NO |
| Methyl Pyruvate | NO | NO | NO | NO | NO | NO |
| D-Galacturonic acid | NO | NO | YES | NO | NO | YES |
| D-Mannose | NO | YES | YES | YES | NO | YES |
| D-Mannitol | NO | YES | NO | YES | NO | YES |
| D-Melibiose | NO | YES | YES | YES | YES | YES |
| Sucrose | NO | NO | YES | YES | NO | YES |
| 2-Deoxy adenosine | NO | YES | NO | NO | NO | YES |
| D-Cellobiose | NO | YES | YES | YES | YES | YES |
| D-Malic acid | NO | NO | NO | NO | NO | NO |
| Phenylethyl-amine | NO | NO | NO | NO | NO | NO |
| Dulcitol | NO | NO | NO | NO | YES | YES |
| L-Glutamic acid | NO | NO | NO | NO | NO | NO |
| Thymidine | NO | YES | NO | NO | NO | YES |
| Uridine | YES | YES | YES | YES | NO | NO |
| Adenosine | NO | YES | NO | NO | YES | YES |
| Inosine | NO | NO | NO | YES | NO | NO |
| L-Malic acid | NO | NO | NO | NO | NO | NO |
| 2-Aminoethanol | NO | YES | YES | YES | NO | NO |

| | Strain/Substrate | | | | | |
|---|---|---|---|---|---|---|
| | SYM00050 | SYM00508 | SYM00617 | SYM00620 | SYM00068 | SYM00905 |
| D-Serine | YES | NO | NO | NO | NO | NO |
| D-Glucose-6-Phosphate | YES | YES | NO | YES | NO | NO |
| L-Asparagine | NO | NO | NO | NO | NO | NO |
| L-glutamine | NO | NO | NO | NO | NO | NO |
| Glycyl-L-Aspartic acid | YES | NO | NO | NO | NO | NO |
| Glycyl-L-Glutamic acid | NO | NO | NO | NO | YES | NO |
| Glycyl-L-Proline | YES | NO | NO | NO | YES | YES |
| L-Arabinose | YES | NO | NO | NO | YES | NO |
| D-Sorbitol | YES | NO | NO | NO | NO | NO |
| D-Galactonic acid-?-lactone | NO | NO | NO | NO | NO | NO |
| D-Aspartic acid | NO | NO | NO | NO | NO | NO |
| m-Tartaric acid | NO | NO | NO | NO | NO | NO |
| Citric acid | NO | NO | NO | NO | YES | NO |
| Tricarballylic acid | NO | NO | NO | NO | NO | NO |
| p-Hydroxy Phenyl acetic acid | YES | NO | NO | NO | NO | NO |
| N-Acetyl-D-Glucosamine | YES | NO | NO | NO | NO | NO |
| Glycerol | YES | NO | NO | NO | NO | NO |
| D-L-Malic acid | NO | YES | YES | NO | YES | NO |
| D-Glucosaminic acid | NO | YES | NO | NO | NO | NO |

TABLE H-continued

Substrate utilization as determined by BIOLOG PM1 MicroPlates by bacterial endophytes belonging to OTUs present in landrace and wild corn and wheat seeds that are present in lower levels in modern corn and wheat seeds.

| | | | | | | |
|---|---|---|---|---|---|---|
| D-Glucose-1-Phosphate | YES | YES | NO | NO | NO | NO |
| m-Inositol | YES | NO | NO | NO | NO | NO |
| L-Serine | NO | NO | NO | NO | NO | NO |
| m-Hydroxy Phenyl Acetic acid | YES | NO | NO | YES | NO | NO |
| D-Saccharic acid | YES | YES | NO | NO | NO | NO |
| L-Fucose | NO | NO | NO | NO | NO | NO |
| D-Ribose | NO | NO | NO | NO | YES | NO |
| 1,2-Propanediol | NO | NO | NO | NO | NO | NO |
| D-Fructose-6-Phosphate | YES | YES | NO | YES | NO | NO |
| D-Threonine | NO | NO | NO | NO | NO | NO |
| L-Threonine | NO | NO | NO | NO | NO | NO |
| Tyramine | NO | NO | NO | NO | YES | NO |
| Succinic acid | NO | NO | NO | NO | NO | NO |
| D-Glucuronic acid | YES | NO | NO | NO | NO | NO |
| Tween 20 | NO | NO | NO | NO | NO | NO |
| Tween 40 | NO | NO | NO | NO | NO | NO |
| Tween 80 | NO | NO | NO | NO | NO | YES |
| Fumaric acid | NO | NO | NO | NO | NO | NO |
| L-Alanine | YES | NO | NO | YES | YES | YES |
| D-Psicose | NO | NO | NO | NO | NO | NO |
| D-Galactose | YES | YES | NO | NO | NO | NO |
| D-Gluconic acid | YES | YES | NO | YES | NO | NO |
| L-Rhamnose | YES | YES | YES | YES | YES | NO |
| a-Keto-Glutaric acid | YES | NO | NO | NO | YES | NO |
| a-Hydroxy Glutaric acid-?-lactone | YES | NO | NO | NO | YES | NO |
| Bromo succinic acid | NO | NO | NO | NO | NO | NO |
| L-Alanyl-Glycine | YES | NO | NO | NO | YES | NO |
| L-Lyxose | YES | YES | NO | NO | YES | NO |
| L-Aspartic acid | YES | YES | NO | NO | NO | NO |
| D-L-a-Glycerol phosphate | NO | NO | NO | NO | NO | NO |
| D-Fructose | YES | NO | NO | NO | YES | NO |
| a-Keto-Butyric acid | NO | NO | NO | NO | NO | NO |
| a-Hydroxy Butyric acid | NO | NO | NO | NO | NO | NO |
| Propionic acid | NO | NO | NO | NO | YES | NO |
| Acetoacetic acid | NO | NO | NO | NO | NO | NO |
| Glucuronamide | NO | NO | NO | NO | NO | NO |
| L-Proline | NO | NO | NO | NO | YES | NO |
| D-Xylose | YES | NO | NO | NO | YES | NO |
| Acetic acid | NO | NO | NO | NO | NO | NO |
| a-Methyl-D-Galactoside | YES | NO | NO | YES | NO | NO |
| β-Methyl-D-glucoside | YES | YES | NO | NO | NO | NO |
| Mucic acid | YES | YES | NO | NO | YES | NO |
| N-acetyl-β-D-Mannosamine | YES | NO | YES | NO | NO | NO |
| Pyruvic acid | YES | YES | NO | NO | YES | NO |
| D-Alanine | NO | NO | NO | NO | NO | NO |
| L-Lactic acid | YES | NO | NO | NO | NO | NO |
| a-D-Glucose | YES | NO | YES | NO | NO | NO |
| a-D-Lactose | NO | NO | NO | NO | NO | NO |
| Adonitol | NO | NO | NO | NO | NO | NO |
| Glycolic acid | NO | NO | NO | NO | NO | NO |
| Mono Methyl Succinate | NO | NO | NO | NO | NO | NO |
| L-Galactonic-acid-?-lactone | YES | YES | NO | YES | YES | NO |
| D-Trehalose | YES | NO | NO | NO | NO | NO |
| Formic acid | NO | NO | NO | NO | NO | NO |
| Maltose | YES | YES | YES | NO | NO | YES |
| Lactulose | NO | NO | NO | NO | NO | NO |
| Maltotriose | YES | YES | YES | NO | NO | YES |
| Glyoxylic acid | NO | NO | NO | NO | NO | NO |
| Methyl Pyruvate | YES | YES | NO | NO | YES | NO |
| D-Galacturonic acid | YES | NO | NO | YES | NO | NO |
| D-Mannose | YES | NO | NO | NO | NO | YES |
| D-Mannitol | YES | NO | NO | NO | NO | NO |
| D-Melibiose | YES | NO | YES | NO | NO | NO |
| Sucrose | YES | NO | NO | NO | NO | NO |
| 2-Deoxy adenosine | YES | YES | NO | YES | NO | NO |
| D-Cellobiose | YES | YES | YES | NO | NO | YES |
| D-Malic acid | NO | NO | NO | NO | YES | NO |
| Phenylethyl-amine | NO | NO | NO | NO | NO | NO |
| Dulcitol | NO | NO | YES | NO | NO | NO |
| L-Glutamic acid | YES | NO | NO | NO | NO | NO |
| Thymidine | YES | YES | NO | NO | NO | NO |
| Uridine | YES | YES | NO | NO | NO | NO |
| Adenosine | NO | YES | NO | YES | NO | NO |
| Inosine | NO | NO | NO | NO | NO | NO |

TABLE H-continued

Substrate utilization as determined by BIOLOG PM1 MicroPlates by bacterial endophytes belonging to OTUs present in landrace and wild corn and wheat seeds that are present in lower levels in modern corn and wheat seeds.

| | | | | | | |
|---|---|---|---|---|---|---|
| L-Malic acid | NO | NO | NO | NO | NO | NO |
| 2-Aminoethanol | NO | NO | NO | NO | NO | NO |

TABLE I

Substrate utilization as determined by BIOLOG PM2A MicroPlates by bacterial endophytes belonging to OTUs present in landrace and wild corn and wheat seeds that are present in lower levels in modern corn and wheat seeds.

| | Strain/Substrate | | | | | |
|---|---|---|---|---|---|---|
| | SYM00013 | SYM00018 | SYM00183 | SYM00184 | SYM00219 | SYM00043 |
| N-acetyl-D-Galactosamine | NO | NO | YES | YES | NO | NO |
| Gentiobiose | NO | YES | YES | YES | YES | YES |
| D-Raffinose | NO | NO | NO | NO | YES | NO |
| Capric acid | NO | NO | NO | NO | NO | NO |
| D-lactic acid methyl ester | NO | NO | NO | NO | NO | NO |
| Acetamide | NO | NO | NO | NO | NO | NO |
| L-Ornithine | YES | YES | NO | YES | YES | NO |
| Chondrointin sulfate C | NO | NO | NO | NO | NO | NO |
| N-acetyl-neuraminic acid | NO | NO | NO | NO | NO | NO |
| L-glucose | NO | NO | NO | NO | NO | NO |
| Salicin | NO | NO | YES | YES | YES | NO |
| Caproic acid | NO | NO | NO | NO | NO | NO |
| Malonic acid | NO | NO | NO | NO | NO | NO |
| L-Alaninamide | NO | NO | YES | YES | NO | NO |
| L-Phenylalanine | YES | NO | NO | NO | NO | NO |
| a-Cyclodextrin | NO | NO | NO | NO | NO | NO |
| β-D-allose | NO | NO | NO | NO | NO | NO |
| Lactitol | NO | NO | YES | YES | NO | NO |
| Sedoheptulosan | NO | NO | NO | NO | NO | NO |
| Citraconic acid | YES | NO | NO | NO | NO | NO |
| Melibionic acid | NO | NO | NO | NO | YES | NO |
| N-Acetyl-L-Glutamic acid | NO | NO | NO | YES | NO | NO |
| L-Pyroglutamic acid | YES | YES | YES | YES | YES | NO |
| β-Cyclodextrin | NO | NO | NO | NO | YES | NO |
| Amygdalin | NO | NO | YES | YES | NO | NO |
| D-Melezitose | NO | NO | NO | NO | NO | NO |
| L-Sorbose | NO | NO | NO | NO | NO | NO |
| Citramalic acid | NO | NO | NO | NO | NO | NO |
| Oxalic acid | NO | NO | NO | NO | NO | NO |
| L-Arginine | NO | NO | NO | NO | NO | NO |
| L-Valine | YES | YES | NO | YES | YES | NO |
| γ-Cyclodextrin | NO | NO | NO | NO | YES | NO |
| D-arabinose | NO | NO | NO | NO | NO | NO |
| Maltitol | NO | NO | YES | YES | NO | NO |
| Stachyose | NO | NO | NO | NO | NO | NO |
| D-Glucosamine | YES | YES | YES | YES | YES | YES |
| Oxalomalic acid | YES | YES | YES | YES | NO | YES |
| Glycine | NO | NO | NO | NO | NO | NO |
| D,L-Carnitine | YES | YES | NO | NO | NO | NO |
| Dextrin | NO | NO | NO | YES | YES | NO |
| D-arabitol | NO | NO | NO | NO | NO | NO |
| a-Methyl-D-Glucoside | NO | NO | NO | NO | NO | NO |
| D-Tagatose | NO | NO | NO | NO | NO | NO |
| 2-Hydroxy benzoic acid | NO | NO | NO | NO | NO | NO |
| Quinic acid | NO | NO | NO | NO | NO | NO |
| L-Histidine | NO | NO | NO | NO | NO | YES |
| Sec-Butylamine | NO | NO | NO | NO | NO | NO |
| Gelatin | NO | NO | YES | YES | NO | NO |
| L-arabitol | NO | NO | NO | NO | NO | NO |
| D-Methyl-D-Galactoside | NO | NO | NO | YES | NO | NO |
| Turanose | NO | NO | YES | YES | NO | NO |
| 4-Hydroxy benzoic acid | NO | NO | NO | NO | NO | NO |
| D-Ribono-1,4-Lactone | NO | NO | NO | NO | NO | NO |
| L-Homoserine | NO | NO | NO | NO | NO | NO |
| D,L-Octopamine | YES | YES | YES | YES | YES | NO |
| Glycogen | NO | NO | NO | NO | NO | NO |
| Arbutin | NO | NO | YES | YES | YES | NO |
| 3-Methyl Glucose | NO | NO | NO | NO | NO | NO |
| Xylitol | NO | NO | NO | YES | NO | NO |
| β-Hydroxy butyric acid | NO | NO | NO | NO | NO | NO |

TABLE I-continued

Substrate utilization as determined by BIOLOG PM2A MicroPlates by bacterial endophytes belonging to OTUs present in landrace and wild corn and wheat seeds that are present in lower levels in modern corn and wheat seeds.

| | | | | | | |
|---|---|---|---|---|---|---|
| Sebacic acid | NO | NO | NO | NO | NO | NO |
| Hydroxy-L-Proline | NO | NO | NO | NO | NO | NO |
| Putrescine | NO | YES | NO | NO | NO | NO |
| Inulin | NO | NO | YES | YES | YES | YES |
| 2-Deoxy-D-Ribose | NO | NO | NO | NO | NO | NO |
| β-Methyl-D-Glucuronic acid | NO | NO | NO | NO | NO | NO |
| N-Acetyl-D-glucosaminitol | NO | NO | NO | NO | NO | NO |
| γ-Hydroxy butyric acid | NO | NO | NO | NO | NO | NO |
| Sorbic acid | NO | NO | NO | NO | NO | NO |
| L-Isoleucine | YES | NO | NO | NO | NO | NO |
| Dihydroxy acetone | NO | NO | NO | YES | NO | NO |
| Laminarin | NO | NO | NO | NO | NO | NO |
| i-Erythritol | NO | NO | NO | NO | NO | NO |
| a-Methyl-D-Mannoside | NO | NO | NO | NO | NO | NO |
| γ-amino butyric acid | YES | YES | NO | NO | NO | YES |
| a-Keto-valeric acid | NO | NO | NO | NO | NO | NO |
| Succinamic acid | NO | NO | NO | NO | NO | NO |
| L-Leucine | YES | NO | NO | NO | NO | NO |
| 2,3-Butanediol | YES | NO | NO | NO | NO | NO |
| Mannan | NO | NO | NO | NO | NO | NO |
| D-Fucose | NO | NO | NO | NO | NO | NO |
| β-Methyl-D-Xyloside | NO | NO | NO | NO | NO | NO |
| d-amino valeric acid | NO | NO | NO | NO | NO | NO |
| Itaconic acid | NO | NO | NO | NO | NO | NO |
| D-Tartaric acid | NO | NO | NO | NO | NO | NO |
| L-Lysine | NO | NO | NO | NO | NO | NO |
| 2,3-Butanone | NO | NO | NO | NO | NO | NO |
| Pectin | NO | NO | NO | NO | NO | NO |
| 3-0-β-D-Galactopyranosyl-D-arabinose | NO | NO | NO | NO | NO | NO |
| Palatinose | NO | NO | YES | YES | YES | NO |
| Butyric acid | NO | NO | NO | NO | NO | NO |
| 5-Keto-D-Gluconic acid | NO | YES | NO | NO | NO | YES |
| L-Tartaric acid | YES | YES | NO | NO | NO | YES |
| L-Methionine | NO | NO | NO | NO | NO | NO |
| 3-Hydroxy 2-Butanone | NO | NO | NO | NO | NO | NO |

| | Strain/Substrate | | | | | |
|---|---|---|---|---|---|---|
| | SYM00050 | SYM00508 | SYM00617 | SYM00620 | SYM00068 | SYM00905 |
| N-acetyl-D-Galactosamine | YES | NO | NO | NO | NO | YES |
| Gentiobiose | YES | YES | YES | YES | NO | YES |
| D-Raffinose | YES | NO | NO | YES | NO | NO |
| Capric acid | NO | NO | NO | NO | NO | NO |
| D-lactic acid methyl ester | YES | NO | NO | NO | NO | NO |
| Acetamide | NO | NO | NO | NO | YES | NO |
| L-Ornithine | YES | NO | NO | NO | YES | NO |
| Chondrointin sulfate C | NO | NO | NO | NO | NO | NO |
| N-acetyl-neuraminic acid | NO | NO | NO | YES | NO | NO |
| L-glucose | NO | NO | NO | NO | NO | NO |
| Salicin | YES | YES | YES | NO | NO | YES |
| Caproic acid | NO | YES | NO | NO | NO | NO |
| Malonic acid | NO | NO | NO | NO | NO | NO |
| L-Alaninamide | NO | NO | NO | NO | NO | YES |
| L-Phenylalanine | NO | NO | NO | NO | YES | NO |
| a-Cyclodextrin | NO | NO | NO | NO | NO | NO |
| β-D-allose | NO | NO | NO | NO | NO | NO |
| Lactitol | NO | NO | NO | NO | NO | YES |
| Sedoheptulosan | NO | NO | NO | NO | NO | NO |
| Citraconic acid | NO | NO | NO | NO | YES | NO |
| Melibionic acid | YES | NO | NO | YES | YES | NO |
| N-Acetyl-L-Glutamic acid | YES | NO | NO | NO | NO | NO |
| L-Pyroglutamic acid | NO | YES | NO | NO | YES | NO |
| β-Cyclodextrin | NO | NO | NO | NO | NO | NO |
| Amygdalin | NO | NO | YES | NO | NO | NO |
| D-Melezitose | NO | NO | YES | NO | NO | NO |
| L-Sorbose | NO | NO | NO | NO | NO | NO |
| Citramalic acid | NO | NO | NO | NO | NO | NO |
| Oxalic acid | NO | NO | NO | NO | NO | NO |
| L-Arginine | NO | NO | NO | NO | NO | NO |
| L-Valine | NO | NO | NO | NO | YES | NO |
| γ-Cyclodextrin | NO | NO | NO | NO | NO | NO |
| D-arabinose | NO | YES | NO | NO | NO | NO |
| Maltitol | NO | NO | NO | NO | NO | YES |
| Stachyose | NO | NO | NO | NO | NO | NO |

TABLE I-continued

Substrate utilization as determined by BIOLOG PM2A MicroPlates by bacterial endophytes belonging to OTUs present in landrace and wild corn and wheat seeds that are present in lower levels in modern corn and wheat seeds.

| | | | | | | |
|---|---|---|---|---|---|---|
| D-Glucosamine | YES | YES | YES | NO | YES | YES |
| Oxalomalic acid | NO | NO | YES | NO | YES | YES |
| Glycine | NO | NO | NO | NO | NO | NO |
| D,L-Carnitine | NO | NO | NO | NO | NO | NO |
| Dextrin | NO | YES | YES | YES | NO | NO |
| D-arabitol | NO | YES | NO | NO | NO | NO |
| a-Methyl-D-Glucoside | NO | NO | NO | NO | NO | NO |
| D-Tagatose | NO | YES | NO | NO | NO | NO |
| 2-Hydroxy benzoic acid | NO | NO | NO | NO | NO | NO |
| Quinic acid | NO | NO | NO | NO | NO | NO |
| L-Histidine | NO | NO | NO | YES | NO | NO |
| Sec-Butylamine | NO | NO | NO | NO | NO | NO |
| Gelatin | NO | NO | NO | NO | NO | YES |
| L-arabitol | NO | NO | NO | NO | NO | NO |
| D-Methyl-D-Galactoside | NO | YES | NO | YES | NO | NO |
| Turanose | NO | NO | NO | NO | NO | NO |
| 4-Hydroxy benzoic acid | NO | NO | NO | NO | NO | NO |
| D-Ribono-1,4-Lactone | NO | NO | NO | NO | NO | NO |
| L-Homoserine | NO | NO | NO | NO | NO | NO |
| D,L-Octopamine | NO | NO | YES | NO | YES | YES |
| Glycogen | NO | YES | NO | NO | NO | NO |
| Arbutin | YES | YES | YES | NO | NO | YES |
| 3-Methyl Glucose | NO | YES | NO | NO | NO | NO |
| Xylitol | NO | NO | NO | NO | NO | NO |
| β-Hydroxy butyric acid | YES | YES | NO | NO | NO | NO |
| Sebacic acid | NO | NO | NO | NO | NO | NO |
| Hydroxy-L-Proline | YES | NO | NO | NO | NO | NO |
| Putrescine | YES | NO | NO | NO | NO | NO |
| Inulin | NO | NO | NO | NO | NO | NO |
| 2-Deoxy-D-Ribose | NO | YES | NO | YES | NO | NO |
| β-Methyl-D-Glucuronic acid | NO | NO | NO | NO | NO | NO |
| N-Acetyl-D-glucosaminitol | NO | NO | NO | NO | NO | NO |
| γ-Hydroxy butyric acid | NO | NO | NO | NO | NO | NO |
| Sorbic acid | NO | NO | NO | NO | NO | NO |
| L-Isoleucine | NO | YES | NO | NO | YES | NO |
| Dihydroxy acetone | YES | YES | NO | NO | NO | NO |
| Laminarin | NO | NO | NO | NO | NO | NO |
| i-Erythritol | NO | NO | NO | NO | NO | NO |
| a-Methyl-D-Mannoside | NO | NO | NO | NO | NO | NO |
| γ-amino butyric acid | NO | NO | NO | NO | NO | NO |
| a-Keto-valeric acid | NO | NO | NO | NO | NO | NO |
| Succinamic acid | NO | NO | NO | NO | NO | NO |
| L-Leucine | NO | NO | NO | NO | NO | NO |
| 2,3-Butanediol | NO | NO | NO | NO | NO | NO |
| Mannan | NO | NO | NO | NO | NO | NO |
| D-Fucose | NO | NO | NO | NO | NO | NO |
| β-Methyl-D-Xyloside | NO | NO | NO | NO | NO | NO |
| d-amino valeric acid | NO | NO | NO | NO | NO | NO |
| Itaconic acid | YES | YES | NO | NO | NO | NO |
| D-Tartaric acid | NO | NO | NO | NO | NO | NO |
| L-Lysine | NO | NO | NO | NO | NO | NO |
| 2,3-Butanone | NO | NO | NO | NO | NO | NO |
| Pectin | NO | YES | NO | NO | NO | NO |
| 3-0-β-D-Galactopyranosyl-D-arabinose | NO | NO | NO | NO | NO | NO |
| Palatinose | NO | NO | NO | NO | NO | YES |
| Butyric acid | NO | NO | NO | NO | NO | NO |
| 5-Keto-D-Gluconic acid | NO | YES | NO | NO | NO | NO |
| L-Tartaric acid | NO | YES | NO | NO | NO | NO |
| L-Methionine | NO | NO | NO | NO | NO | NO |
| 3-Hydroxy 2-Butanone | NO | NO | NO | NO | NO | NO |

Twelve SYM strains of culturable bacteria belonging to OTUs present in landrace and wild corn and wheat seeds that are present in lower levels in modern corn and wheat seeds were tested for sole carbon substrate utilization using BIOLOG PM1 and PM2A MicroPlates. The most utilized substrates by these strains are L-alanine, L-galactonic-acid-γ-lactone, maltose, maltotriose, D-cellobiose, gentiobiose, and D-glucosamine. The least utilized substrates by these strains are L-asparagine, L-glutamine, D-aspartic acid, tricarballylic acid, L-serine, L-fucose, 1,2-propanediol, D-threonine, L-threonine, succinic acid, fumaric acid, bromo succinic acid, D-L-a-glycerol phosphate, a-keto-butyric acid, a-hydroxy butyric acid, acetoacetic acid, glucuronamide, glycolic acid, mono methyl succinate, glyoxylic acid, phenylethyl-amine, and L-malic acid.

The substrates most utilized by a large number of the culturable bacteria belonging to core OTUs are mucic acid, L-arabinose, L-galactonic-acid-γ-lactone, N-acetyl-D-glucosamine, maltose, maltotriose, and D-cellobiose. These core bacteria did not utilize sedoheptulosan, oxalic acid, 2-hydroxy benzoic acid, quinic acid, mannan, L-methionine, N-acetyl-D-glucosaminitol, sorbic acid, 2,3-butanone, succinic acid, phenylethyl-amine, and 3-hydroxy 2-butanone as sole carbon sources. Results for the culturable fungi belonging to core OTUs indicate that D-sorbitol, L-arabinose, N-acetyl-D-glucosamine, glycerol, tween 40, tween 80, D-gluconic acid, L-proline, a-D-glucose, D-trehalose, maltose, lactulose, D-mannose, D-mannitol, sucrose, D-cellobiose, L-glutamic acid, L-ornithine, and L-pyroglutamic acid are carbon substrates that are utilized by a large number of the endophyte strains examined here. The carbon substrate that seemed to be not utilized by fungi in these assays is 2-deoxy-D-ribose. All other substrates could be utilized as a sole carbon nutrient by at least one fungal SYM strain.

TABLE J

Substrate utilization as determined by BIOLOG PM1 MicroPlates by bacterial endophytes belonging to core OTUs.

| | Strain/Substrate | | | | | | | |
|---|---|---|---|---|---|---|---|---|
| | SYM00103 | SYM01049 | SYM00013 | SYM00017A | SYM00018 | SYM00183 | SYM00184 | SYM00020 |
| D-Serine | NO | NO | NO | NO | NO | NO | NO | NO |
| D-Glucose-6-Phosphate | NO | NO | NO | YES | NO | NO | NO | NO |
| L-Asparagine | NO | NO | NO | YES | NO | NO | NO | NO |
| L-glutamine | NO | NO | NO | NO | NO | NO | NO | NO |
| Glycyl-L-Aspartic acid | NO | YES | YES | NO | NO | NO | NO | NO |
| Glycyl-L-Glutamic acid | YES | NO | NO | NO | NO | YES | YES | NO |
| Glycyl-L-Proline | NO | NO | NO | NO | NO | YES | YES | NO |
| L-Arabinose | NO | YES | YES | YES | YES | NO | YES | YES |
| D-Sorbitol | NO | NO | NO | YES | NO | NO | YES | NO |
| D-Galactonic acid-?-lactone | NO | YES | YES | NO | YES | NO | NO | YES |
| D-Aspartic acid | NO | NO | NO | NO | NO | NO | NO | NO |
| m-Tartaric acid | NO | YES | YES | NO | YES | NO | NO | YES |
| Citric acid | NO | NO | NO | NO | NO | NO | NO | NO |
| Tricarballylic acid | NO | NO | NO | NO | NO | NO | NO | NO |
| p-Hydroxy Phenyl acetic acid | NO | NO | NO | YES | NO | NO | NO | NO |
| N-Acetyl-D-Glucosamine | NO | NO | YES | YES | YES | YES | YES | YES |
| Glycerol | NO | NO | NO | YES | NO | NO | NO | NO |
| D-L-Malic acid | NO | NO | NO | YES | NO | NO | YES | NO |
| D-Glucosaminic acid | NO | NO | NO | YES | YES | NO | NO | YES |
| D-Glucose-1-Phosphate | NO | NO | NO | YES | YES | NO | NO | YES |
| m-Inositol | NO | NO | NO | YES | YES | NO | YES | YES |
| L-Serine | NO | NO | NO | NO | NO | NO | NO | NO |
| m-Hydroxy Phenyl Acetic acid | NO | NO | NO | NO | NO | NO | NO | NO |
| D-Saccharic acid | NO | NO | NO | YES | NO | NO | YES | NO |
| L-Fucose | NO | NO | NO | YES | NO | NO | NO | NO |
| D-Ribose | NO | YES | NO | YES | YES | YES | YES | NO |
| 1,2-Propanediol | NO | NO | NO | NO | NO | NO | NO | NO |
| D-Fructose-6-Phosphate | NO | NO | NO | YES | YES | NO | NO | NO |
| D-Threonine | NO | NO | NO | NO | NO | NO | NO | NO |
| L-Threonine | NO | NO | NO | NO | NO | NO | NO | NO |
| Tyramine | NO | NO | YES | YES | YES | YES | NO | YES |
| Succinic acid | NO | NO | NO | NO | NO | NO | NO | NO |
| D-Glucuronic acid | NO | NO | NO | NO | NO | NO | NO | NO |
| Tween 20 | NO | NO | NO | NO | NO | NO | YES | NO |
| Tween 40 | NO | NO | NO | NO | NO | NO | NO | NO |
| Tween 80 | YES | YES | NO | NO | NO | YES | YES | NO |
| Fumaric acid | NO | NO | NO | NO | NO | NO | NO | NO |
| L-Alanine | YES | NO | YES | YES | YES | YES | YES | YES |
| D-Psicose | NO | NO | NO | YES | YES | NO | NO | YES |
| D-Galactose | NO | YES | YES | YES | YES | NO | YES | YES |
| D-Gluconic acid | YES | NO | NO | NO | YES | NO | NO | NO |
| L-Rhamnose | NO | NO | NO | YES | YES | NO | NO | YES |
| a-Keto-Glutaric acid | YES | NO | NO | YES | NO | YES | NO | NO |
| a-Hydroxy Glutaric acid-?-lactone | NO | NO | YES | YES | NO | NO | YES | NO |
| Bromo succinic acid | NO | NO | NO | NO | NO | NO | NO | NO |
| L-Alanyl-Glycine | YES | NO | YES | YES | YES | YES | YES | YES |
| L-Lyxose | NO | NO | NO | NO | YES | NO | NO | YES |
| L-Aspartic acid | YES | NO | NO | NO | NO | YES | NO | NO |
| D-L-a-Glycerol phosphate | NO | NO | NO | NO | NO | NO | NO | NO |
| D-Fructose | NO | NO | NO | YES | NO | NO | YES | YES |
| a-Keto-Butyric acid | NO | NO | NO | NO | NO | NO | NO | NO |
| a-Hydroxy Butyric acid | NO | NO | NO | NO | NO | NO | NO | NO |
| Propionic acid | NO | NO | NO | YES | YES | NO | NO | NO |
| Acetoacetic acid | NO | NO | NO | NO | NO | NO | NO | NO |
| Glucuronamide | NO | NO | NO | NO | NO | NO | NO | NO |
| L-Proline | NO | NO | NO | NO | YES | YES | NO | NO |
| D-Xylose | YES | YES | YES | YES | YES | YES | YES | YES |
| Acetic acid | NO | NO | NO | YES | YES | NO | YES | NO |
| a-Methyl-D-Galactoside | NO | NO | NO | YES | NO | NO | NO | NO |
| β-Methyl-D-glucoside | NO | NO | NO | YES | YES | NO | YES | YES |
| Mucic acid | YES | YES | YES | YES | YES | YES | NO | YES |
| N-acetyl-β-D-Mannosamine | NO | NO | NO | NO | NO | NO | NO | NO |
| Pyruvic acid | NO | YES | NO | YES | YES | YES | YES | YES |
| D-Alanine | YES | NO | YES | YES | YES | YES | YES | YES |

TABLE J-continued

Substrate utilization as determined by BIOLOG PM1 MicroPlates by bacterial endophytes belonging to core OTUs.

| | | | | | | | | |
|---|---|---|---|---|---|---|---|---|
| L-Lactic acid | NO | NO | NO | NO | NO | NO | NO | NO |
| a-D-Glucose | NO | YES | NO | YES | YES | YES | YES | NO |
| a-D-Lactose | NO | NO | NO | NO | NO | YES | YES | NO |
| Adonitol | NO | NO | NO | YES | YES | YES | NO | NO |
| Glycolic acid | YES | NO | NO | NO | NO | NO | NO | NO |
| Mono Methyl Succinate | NO | YES | NO | NO | NO | NO | NO | NO |
| L-Galactonic-acid-?-lactone | YES | YES | NO | YES | YES | YES | YES | YES |
| D-Trehalose | YES | NO | NO | YES | NO | NO | NO | NO |
| Formic acid | NO | NO | NO | NO | YES | NO | NO | YES |
| Maltose | NO | YES | NO | YES | YES | YES | YES | YES |
| Lactulose | NO | NO | NO | YES | NO | YES | YES | NO |
| Maltotriose | NO | NO | NO | YES | YES | YES | YES | YES |
| Glyoxylic acid | NO | NO | NO | NO | NO | NO | NO | NO |
| Methyl Pyruvate | NO | NO | NO | NO | NO | NO | NO | NO |
| D-Galacturonic acid | YES | NO | NO | YES | NO | YES | NO | NO |
| D-Mannose | NO | YES | NO | YES | YES | YES | YES | NO |
| D-Mannitol | NO | NO | NO | YES | YES | NO | YES | NO |
| D-Melibiose | NO | NO | NO | YES | YES | YES | YES | NO |
| Sucrose | NO | NO | NO | YES | NO | YES | YES | NO |
| 2-Deoxy adenosine | NO | NO | NO | NO | YES | NO | NO | NO |
| D-Cellobiose | NO | YES | NO | YES | YES | YES | YES | YES |
| D-Malic acid | NO | YES | NO | NO | NO | NO | NO | NO |
| Phenylethyl-amine | NO | NO | NO | NO | NO | NO | NO | NO |
| Dulcitol | NO | NO | NO | NO | NO | NO | NO | NO |
| L-Glutamic acid | NO | NO | NO | NO | NO | NO | NO | NO |
| Thymidine | NO | NO | NO | NO | YES | NO | NO | NO |
| Uridine | YES | NO | YES | YES | YES | YES | YES | NO |
| Adenosine | YES | NO | NO | YES | YES | NO | NO | NO |
| Inosine | NO | NO | NO | NO | NO | NO | YES | NO |
| L-Malic acid | NO | NO | NO | NO | NO | NO | NO | NO |
| 2-Aminoethanol | YES | NO | NO | YES | YES | YES | YES | NO |

| | Strain/Substrate | | | | | | | |
|---|---|---|---|---|---|---|---|---|
| | SYM00207 | SYM00212 | SYM00219 | SYM00234 | SYM00236 | SYM00248 | SYM00249 | SYM00260 |
| D-Serine | NO | NO | NO | NO | NO | YES | NO | NO |
| D-Glucose-6-Phosphate | NO | YES | NO | NO | NO | YES | YES | NO |
| L-Asparagine | NO | NO | NO | NO | NO | NO | YES | YES |
| L-glutamine | NO | NO | NO | NO | NO | NO | YES | NO |
| Glycyl-L-Aspartic acid | NO | YES | NO | NO | NO | NO | NO | NO |
| Glycyl-L-Glutamic acid | YES | YES | NO | NO | NO | NO | NO | YES |
| Glycyl-L-Proline | NO | NO | NO | NO | NO | NO | NO | NO |
| L-Arabinose | NO | YES | NO | YES | YES | YES | YES | YES |
| D-Sorbitol | NO | NO | NO | NO | NO | NO | NO | NO |
| D-Galactonic acid-?-lactone | NO | NO | YES | NO | NO | NO | NO | NO |
| D-Aspartic acid | NO | YES | NO | NO | NO | NO | NO | NO |
| m-Tartaric acid | NO | YES | NO | NO | NO | NO | NO | NO |
| Citric acid | NO | NO | NO | NO | NO | NO | YES | YES |
| Tricarballylic acid | NO | YES | NO | NO | NO | NO | NO | NO |
| p-Hydroxy Phenyl acetic acid | NO | NO | NO | NO | NO | NO | NO | NO |
| N-Acetyl-D-Glucosamine | YES | YES | YES | YES | NO | YES | YES | NO |
| Glycerol | NO | YES | NO | YES | NO | YES | NO | YES |
| D-L-Malic acid | YES | YES | NO | YES | NO | NO | NO | YES |
| D-Glucosaminic acid | NO | NO | NO | NO | NO | NO | NO | NO |
| D-Glucose-1-Phosphate | NO | YES | NO | NO | NO | NO | YES | NO |
| m-Inositol | NO | YES | NO | NO | NO | YES | YES | YES |
| L-Serine | NO | NO | NO | NO | NO | NO | NO | YES |
| m-Hydroxy Phenyl Acetic acid | YES | NO | NO | NO | NO | NO | NO | NO |
| D-Saccharic acid | NO | YES | NO | NO | NO | NO | NO | YES |
| L-Fucose | NO | YES | NO | NO | NO | NO | NO | NO |
| D-Ribose | NO | YES | NO | NO | NO | YES | YES | NO |
| 1,2-Propanediol | NO | YES | NO | NO | NO | NO | NO | YES |
| D-Fructose-6-Phosphate | NO | YES | NO | NO | NO | NO | YES | NO |
| D-Threonine | NO | NO | NO | NO | NO | NO | NO | NO |
| L-Threonine | YES | NO | NO | NO | NO | NO | NO | YES |
| Tyramine | YES | YES | YES | YES | NO | YES | YES | NO |
| Succinic acid | NO | NO | NO | NO | NO | NO | NO | NO |
| D-Glucuronic acid | NO | NO | NO | NO | NO | NO | YES | NO |
| Tween 20 | NO | NO | NO | NO | NO | NO | NO | YES |
| Tween 40 | NO | NO | NO | NO | NO | NO | NO | YES |
| Tween 80 | NO | NO | NO | NO | NO | NO | NO | YES |
| Fumaric acid | NO | YES | NO | NO | NO | NO | NO | YES |
| L-Alanine | YES | YES | YES | YES | YES | YES | NO | YES |
| D-Psicose | NO | NO | NO | NO | NO | NO | NO | NO |
| D-Galactose | NO | NO | YES | NO | NO | YES | YES | NO |
| D-Gluconic acid | NO | YES | NO | YES | NO | NO | NO | YES |

TABLE J-continued

Substrate utilization as determined by BIOLOG PM1 MicroPlates by bacterial endophytes belonging to core OTUs.

| | | | | | | | | |
|---|---|---|---|---|---|---|---|---|
| L-Rhamnose | NO | YES | YES | YES | NO | YES | YES | NO |
| a-Keto-Glutaric acid | YES | YES | NO | NO | YES | NO | NO | YES |
| a-Hydroxy Glutaric acid-?-lactone | NO | YES | NO | NO | YES | NO | NO | YES |
| Bromo succinic acid | NO | NO | NO | NO | NO | NO | NO | YES |
| L-Alanyl-Glycine | YES | YES | NO | YES | NO | YES | NO | YES |
| L-Lyxose | NO | NO | NO | NO | NO | YES | NO | NO |
| L-Aspartic acid | YES | NO | NO | NO | YES | YES | YES | YES |
| D-L-a-Glycerol phosphate | NO | NO | NO | NO | NO | NO | NO | YES |
| D-Fructose | NO | YES | NO | YES | NO | YES | NO | NO |
| a-Keto-Butyric acid | YES | YES | NO | NO | NO | NO | NO | NO |
| a-Hydroxy Butyric acid | NO | YES | NO | NO | NO | NO | NO | YES |
| Propionic acid | YES | YES | NO | NO | NO | NO | NO | YES |
| Acetoacetic acid | NO | NO | NO | NO | NO | NO | NO | YES |
| Glucuronamide | NO | NO | NO | NO | NO | NO | NO | NO |
| L-Proline | YES | YES | NO | YES | YES | YES | NO | YES |
| D-Xylose | NO | YES | NO | YES | YES | YES | NO | YES |
| Acetic acid | YES | YES | NO | YES | YES | NO | NO | YES |
| a-Methyl-D-Galactoside | NO | YES | YES | YES | NO | YES | NO | NO |
| β-Methyl-D-glucoside | NO | YES | YES | YES | NO | YES | YES | YES |
| Mucic acid | YES | YES | NO | YES | NO | YES | NO | YES |
| N-acetyl-β-D-Mannosamine | NO | NO | NO | YES | NO | NO | NO | YES |
| Pyruvic acid | YES | YES | YES | YES | NO | NO | YES | YES |
| D-Alanine | NO | NO | YES | NO | NO | NO | YES | NO |
| L-Lactic acid | NO | NO | NO | NO | NO | NO | NO | YES |
| a-D-Glucose | NO | YES | NO | YES | NO | YES | NO | NO |
| a-D-Lactose | NO | YES | NO | YES | NO | YES | NO | NO |
| Adonitol | YES | NO | NO | YES | NO | NO | NO | NO |
| Glycolic acid | YES | YES | NO | NO | NO | NO | NO | YES |
| Mono Methyl Succinate | YES | NO | NO | YES | NO | NO | NO | YES |
| L-Galactonic-acid-?-lactone | YES | YES | YES | YES | NO | NO | NO | YES |
| D-Trehalose | NO | NO | NO | YES | NO | YES | NO | NO |
| Formic acid | NO | NO | NO | NO | NO | YES | NO | YES |
| Maltose | NO | YES | YES | YES | NO | YES | YES | YES |
| Lactulose | NO | YES | NO | YES | NO | NO | NO | NO |
| Maltotriose | NO | YES | YES | YES | NO | YES | YES | YES |
| Glyoxylic acid | NO | NO | NO | NO | NO | NO | NO | YES |
| Methyl Pyruvate | NO | YES | NO | YES | NO | NO | NO | YES |
| D-Galacturonic acid | YES | NO | NO | NO | NO | NO | NO | YES |
| D-Mannose | NO | NO | NO | YES | NO | YES | NO | NO |
| D-Mannitol | NO | NO | NO | YES | NO | YES | YES | YES |
| D-Melibiose | NO | YES | YES | YES | NO | YES | NO | NO |
| Sucrose | NO | NO | NO | YES | NO | NO | YES | NO |
| 2-Deoxy adenosine | NO | NO | NO | NO | NO | YES | NO | YES |
| D-Cellobiose | YES | YES | YES | YES | NO | YES | YES | YES |
| D-Malic acid | NO | NO | NO | NO | NO | YES | NO | YES |
| Phenylethyl-amine | NO | NO | NO | NO | NO | NO | NO | NO |
| Dulcitol | NO | NO | YES | NO | NO | NO | NO | NO |
| L-Glutamic acid | NO | NO | NO | NO | NO | NO | NO | NO |
| Thymidine | YES | YES | NO | YES | NO | NO | YES | YES |
| Uridine | YES | YES | NO | YES | NO | NO | YES | YES |
| Adenosine | NO | YES | YES | YES | NO | YES | NO | YES |
| Inosine | YES | NO | NO | YES | NO | NO | NO | NO |
| L-Malic acid | YES | NO | NO | NO | NO | NO | NO | YES |
| 2-Aminoethanol | NO | NO | NO | YES | NO | NO | NO | YES |

TABLE K

Substrate utilization as determined by BIOLOG PM1 MicroPlates by bacterial endophytes belonging to core OTUs.

| | Strain/Substrate | | | | | | | | |
|---|---|---|---|---|---|---|---|---|---|
| | SYM00290 | SYM00292 | SYM00003 | SYM00043 | SYM00050 | SYM05066 | SYM00508 | SYM00525 | SYM00053 |
| D-Serine | NO | YES | NO | NO | YES | NO | NO | NO | YES |
| D-Glucose-6-Phosphate | NO | NO | NO | YES | YES | NO | YES | NO | YES |
| L-Asparagine | NO | NO | NO | NO | NO | NO | NO | NO | NO |
| L-glutamine | NO | NO | NO | NO | NO | NO | NO | NO | NO |
| Glycyl-L-Aspartic acid | NO | NO | NO | YES | YES | NO | NO | NO | YES |
| Glycyl-L-Glutamic acid | NO | NO | NO | NO | NO | NO | NO | NO | NO |

TABLE K-continued

Substrate utilization as determined by BIOLOG PM1 MicroPlates by bacterial endophytes belonging to core OTUs.

| | | | | | | | | | |
|---|---|---|---|---|---|---|---|---|---|
| Glycyl-L-Proline | NO | NO | NO | NO | YES | NO | NO | NO | YES |
| L-Arabinose | YES | YES | YES | YES | YES | NO | NO | NO | YES |
| D-Sorbitol | NO | NO | NO | NO | YES | NO | NO | YES | YES |
| D-Galactonic acid-?-lactone | NO | NO | NO | YES | NO | NO | NO | NO | NO |
| D-Aspartic acid | NO | NO | NO | NO | NO | NO | NO | NO | NO |
| m-Tartaric acid | NO | NO | NO | YES | NO | NO | NO | NO | NO |
| Citric acid | NO | YES | NO | NO | NO | NO | NO | NO | NO |
| Tricarballylic acid | NO | NO | NO | NO | NO | NO | NO | NO | NO |
| p-Hydroxy Phenyl acetic acid | NO | NO | NO | NO | YES | NO | NO | NO | NO |
| N-Acetyl-D-Glucosamine | YES | YES | YES | YES | YES | NO | NO | YES | YES |
| Glycerol | YES | YES | NO | YES | YES | NO | NO | NO | NO |
| D-L-Malic acid | YES | YES | NO | YES | NO | NO | YES | YES | NO |
| D-Glucosaminic acid | NO | NO | YES | YES | NO | NO | YES | NO | NO |
| D-Glucose-1-Phosphate | NO | NO | NO | YES | YES | NO | YES | NO | NO |
| m-Inositol | NO | YES | NO | YES | YES | NO | NO | YES | YES |
| L-Serine | NO | NO | NO | NO | NO | NO | NO | NO | NO |
| m-Hydroxy Phenyl Acetic acid | NO | NO | NO | NO | YES | NO | NO | NO | YES |
| D-Saccharic acid | NO | YES | NO | YES | YES | NO | YES | NO | NO |
| L-Fucose | YES | NO | NO | NO | NO | NO | NO | NO | NO |
| D-Ribose | YES | YES | YES | YES | NO | NO | NO | YES | NO |
| 1,2-Propanediol | YES | NO | NO | NO | NO | NO | NO | NO | NO |
| D-Fructose-6-Phosphate | NO | NO | NO | NO | YES | NO | YES | NO | YES |
| D-Threonine | YES | NO | NO | NO | NO | NO | NO | NO | NO |
| L-Threonine | YES | NO | NO | NO | NO | NO | NO | NO | NO |
| Tyramine | NO | YES | YES | NO | NO | NO | NO | NO | NO |
| Succinic acid | NO | NO | NO | NO | NO | NO | NO | NO | NO |
| D-Glucuronic acid | NO | NO | NO | NO | YES | NO | NO | NO | NO |
| Tween 20 | YES | NO | NO | NO | NO | NO | NO | NO | NO |
| Tween 40 | YES | NO | NO | YES | NO | NO | NO | NO | NO |
| Tween 80 | YES | NO | NO | NO | NO | NO | NO | NO | NO |
| Fumaric acid | YES | YES | NO | NO | NO | NO | NO | NO | NO |
| L-Alanine | YES | YES | YES | YES | YES | NO | NO | YES | YES |
| D-Psicose | NO | NO | NO | YES | NO | NO | NO | NO | NO |
| D-Galactose | YES | YES | NO | YES | YES | NO | YES | YES | NO |
| D-Gluconic acid | YES | YES | NO | YES | YES | NO | YES | NO | YES |
| L-Rhamnose | YES | YES | NO | YES | YES | NO | YES | YES | YES |
| a-Keto-Glutaric acid | NO | YES | NO | NO | YES | NO | NO | NO | YES |
| a-Hydroxy Glutaric acid-?-lactone | NO | NO | NO | NO | YES | NO | NO | NO | NO |
| Bromo succinic acid | NO | YES | NO | NO | NO | NO | NO | NO | NO |
| L-Alanyl-Glycine | YES | YES | YES | NO | YES | NO | NO | YES | NO |
| L-Lyxose | NO | NO | NO | YES | YES | NO | YES | NO | NO |
| L-Aspartic acid | NO | YES | NO | NO | YES | NO | YES | YES | NO |
| D-L-a-Glycerol phosphate | NO | NO | NO | NO | NO | NO | NO | NO | NO |
| D-Fructose | YES | YES | NO | YES | YES | NO | NO | YES | YES |
| a-Keto-Butyric acid | NO | NO | NO | NO | NO | NO | NO | NO | NO |
| a-Hydroxy Butyric acid | YES | NO | NO | NO | NO | NO | NO | NO | NO |
| Propionic acid | YES | YES | YES | NO | NO | NO | NO | NO | NO |
| Acetoacetic acid | YES | YES | NO | NO | NO | NO | NO | NO | NO |
| Glucuronamide | YES | NO | NO | NO | NO | NO | NO | NO | NO |
| L-Proline | NO | YES | NO | NO | NO | NO | NO | NO | NO |
| D-Xylose | YES | YES | YES | YES | YES | NO | NO | NO | YES |
| Acetic acid | YES | YES | NO | YES | NO | NO | NO | YES | NO |
| a-Methyl-D-Galactoside | YES | YES | NO | NO | YES | NO | NO | NO | YES |
| β-Methyl-D-glucoside | YES | YES | NO | YES | YES | NO | YES | YES | YES |
| Mucic acid | NO | YES | YES | YES | YES | NO | YES | YES | YES |
| N-acetyl-β-D-Mannosamine | YES | YES | NO | NO | YES | NO | NO | NO | YES |

TABLE K-continued

Substrate utilization as determined by BIOLOG PM1 MicroPlates by bacterial endophytes belonging to core OTUs.

| | | | | | | | | | |
|---|---|---|---|---|---|---|---|---|---|
| Pyruvic acid | YES | YES | YES | YES | YES | NO | YES | NO | NO |
| D-Alanine | YES | NO | NO | NO | NO | NO | NO | NO | NO |
| L-Lactic acid | NO | YES | NO | YES | YES | NO | NO | NO | YES |
| a-D-Glucose | YES | YES | NO | YES | YES | NO | NO | NO | YES |
| a-D-Lactose | YES | YES | NO | NO | NO | NO | NO | YES | NO |
| Adonitol | NO | NO | NO | NO | NO | NO | NO | NO | NO |
| Glycolic acid | NO | NO | NO | NO | NO | NO | NO | NO | NO |
| Mono Methyl Succinate | YES | YES | NO | NO | NO | NO | NO | NO | NO |
| L-Galactonic-acid-?-lactone | YES | YES | YES | YES | YES | NO | YES | YES | YES |
| D-Trehalose | YES | YES | NO | YES | YES | NO | NO | NO | YES |
| Formic acid | NO | YES | NO | YES | NO | NO | NO | NO | NO |
| Maltose | YES | YES | NO | YES | YES | NO | YES | YES | YES |
| Lactulose | YES | YES | NO | NO | NO | NO | NO | YES | NO |
| Maltotriose | YES | YES | NO | YES | YES | NO | YES | YES | YES |
| Glyoxylic acid | NO | YES | YES | NO | NO | NO | NO | NO | NO |
| Methyl Pyruvate | YES | YES | NO | NO | YES | NO | YES | NO | NO |
| D-Galacturonic acid | NO | YES | NO | YES | YES | NO | NO | NO | NO |
| D-Mannose | NO | YES | NO | YES | YES | NO | NO | NO | YES |
| D-Mannitol | YES | YES | NO | YES | YES | NO | NO | YES | YES |
| D-Melibiose | YES | YES | NO | YES | YES | NO | NO | YES | YES |
| Sucrose | YES | YES | NO | YES | YES | NO | NO | YES | YES |
| 2-Deoxy adenosine | NO | YES | NO | YES | YES | NO | YES | NO | YES |
| D-Cellobiose | YES | YES | NO | YES | YES | NO | YES | YES | YES |
| D-Malic acid | NO | YES | NO | NO | NO | NO | NO | NO | NO |
| Phenylethyl-amine | NO | NO | NO | NO | NO | NO | NO | NO | NO |
| Dulcitol | YES | NO | NO | YES | NO | NO | NO | NO | NO |
| L-Glutamic acid | NO | NO | NO | NO | YES | NO | NO | NO | NO |
| Thymidine | YES | YES | NO | YES | YES | NO | YES | NO | YES |
| Uridine | YES | YES | YES | NO | YES | NO | YES | YES | YES |
| Adenosine | YES | YES | YES | YES | NO | NO | YES | NO | NO |
| Inosine | NO | YES | NO | NO | NO | NO | NO | NO | NO |
| L-Malic acid | NO | YES | NO | NO | NO | NO | NO | NO | NO |
| 2-Aminoethanol | NO | NO | NO | NO | NO | NO | NO | NO | NO |

| | Strain/Substrate | | | | | | | |
|---|---|---|---|---|---|---|---|---|
| | SYM00538A | SYM00538B | SYM00538i | SYM00543 | SYM00563 | SYM00574 | SYM00057B | SYM00617 |
| D-Serine | NO | NO | NO | YES | NO | NO | NO | NO |
| D-Glucose-6-Phosphate | NO | NO | NO | YES | NO | NO | NO | NO |
| L-Asparagine | NO | NO | NO | YES | NO | NO | NO | NO |
| L-glutamine | NO | NO | NO | NO | NO | NO | NO | NO |
| Glycyl-L-Aspartic acid | NO | NO | NO | NO | NO | NO | NO | NO |
| Glycyl-L-Glutamic acid | NO | NO | NO | YES | NO | YES | NO | NO |
| Glycyl-L-Proline | NO | NO | NO | NO | NO | NO | YES | NO |
| L-Arabinose | NO | YES | YES | YES | YES | YES | YES | NO |
| D-Sorbitol | NO | NO | NO | NO | NO | NO | NO | NO |
| D-Galactonic acid-?-lactone | NO | NO | NO | NO | NO | NO | NO | NO |
| D-Aspartic acid | NO | NO | NO | NO | NO | NO | NO | NO |
| m-Tartaric acid | NO | NO | NO | NO | NO | NO | NO | NO |
| Citric acid | NO | NO | YES | YES | NO | YES | NO | NO |
| Tricarballylic acid | NO | NO | NO | NO | NO | NO | NO | NO |
| p-Hydroxy Phenyl acetic acid | NO | NO | NO | NO | NO | NO | NO | NO |
| N-Acetyl-D-Glucosamine | YES | YES | YES | YES | NO | YES | NO | NO |
| Glycerol | NO | YES | NO | YES | NO | YES | NO | NO |
| D-L-Malic acid | YES | YES | YES | YES | NO | YES | NO | YES |
| D-Glucosaminic acid | NO | NO | NO | NO | NO | NO | NO | NO |
| D-Glucose-1-Phosphate | NO | NO | NO | NO | NO | NO | NO | NO |
| m-Inositol | NO | YES | YES | YES | NO | YES | NO | NO |
| L-Serine | NO | NO | NO | YES | NO | YES | NO | NO |
| m-Hydroxy Phenyl Acetic acid | NO | NO | NO | NO | NO | NO | YES | NO |

TABLE K-continued

Substrate utilization as determined by BIOLOG PM1 MicroPlates by bacterial endophytes belonging to core OTUs.

| | | | | | | | | |
|---|---|---|---|---|---|---|---|---|
| D-Saccharic acid | NO | NO | YES | YES | NO | YES | NO | NO |
| L-Fucose | NO | NO | NO | YES | NO | NO | YES | NO |
| D-Ribose | NO | NO | NO | YES | NO | NO | NO | NO |
| 1,2-Propanediol | NO | NO | NO | NO | NO | YES | NO | NO |
| D-Fructose-6-Phosphate | NO | NO | NO | NO | NO | NO | NO | NO |
| D-Threonine | NO | NO | NO | NO | NO | NO | NO | NO |
| L-Threonine | NO | NO | NO | YES | NO | YES | NO | NO |
| Tyramine | NO | NO | NO | YES | NO | NO | NO | NO |
| Succinic acid | NO | NO | NO | NO | NO | NO | NO | NO |
| D-Glucuronic acid | NO | NO | NO | NO | NO | NO | NO | NO |
| Tween 20 | NO | YES | NO | NO | NO | YES | YES | NO |
| Tween 40 | NO | NO | NO | NO | NO | YES | NO | NO |
| Tween 80 | NO | NO | NO | YES | NO | YES | NO | NO |
| Fumaric acid | NO | NO | NO | NO | NO | YES | NO | NO |
| L-Alanine | NO | NO | NO | YES | NO | YES | NO | NO |
| D-Psicose | NO | NO | NO | NO | NO | NO | NO | NO |
| D-Galactose | NO | YES | NO | NO | NO | NO | YES | NO |
| D-Gluconic acid | NO | YES | NO | YES | NO | YES | NO | NO |
| L-Rhamnose | NO | YES | NO | NO | YES | NO | YES | YES |
| a-Keto-Glutaric acid | YES | YES | YES | YES | NO | YES | NO | NO |
| a-Hydroxy Glutaric acid-?-lactone | NO | NO | YES | NO | NO | YES | NO | NO |
| Bromo succinic acid | NO | NO | NO | YES | NO | YES | NO | NO |
| L-Alanyl-Glycine | YES | YES | YES | YES | NO | YES | NO | NO |
| L-Lyxose | NO | NO | NO | NO | NO | NO | NO | NO |
| L-Aspartic acid | NO | YES | YES | YES | NO | YES | NO | NO |
| D-L-a-Glycerol phosphate | NO | NO | NO | NO | NO | YES | NO | NO |
| D-Fructose | NO | YES | NO | YES | NO | NO | NO | NO |
| a-Keto-Butyric acid | NO | NO | NO | NO | NO | NO | NO | NO |
| a-Hydroxy Butyric acid | NO | NO | NO | NO | NO | YES | NO | NO |
| Propionic acid | NO | NO | YES | NO | NO | YES | NO | NO |
| Acetoacetic acid | NO | NO | NO | YES | NO | YES | NO | NO |
| Glucuronamide | NO | NO | NO | NO | NO | NO | NO | NO |
| L-Proline | YES | NO | YES | NO | NO | YES | NO | NO |
| D-Xylose | NO | YES | NO | NO | NO | YES | NO | NO |
| Acetic acid | NO | YES | YES | YES | NO | YES | YES | NO |
| a-Methyl-D-Galactoside | NO | YES | NO | NO | NO | NO | NO | NO |
| β-Methyl-D-glucoside | NO | YES | NO | YES | NO | YES | NO | NO |
| Mucic acid | NO | NO | YES | YES | NO | YES | YES | NO |
| N-acetyl-β-D-Mannosamine | NO | YES | NO | NO | NO | YES | NO | YES |
| Pyruvic acid | NO | YES | NO | YES | NO | YES | NO | NO |
| D-Alanine | NO | NO | NO | NO | NO | NO | YES | NO |
| L-Lactic acid | NO | NO | NO | YES | NO | YES | NO | NO |
| a-D-Glucose | NO | YES | NO | YES | NO | NO | YES | YES |
| a-D-Lactose | NO | YES | NO | NO | NO | NO | NO | NO |
| Adonitol | NO | NO | NO | NO | NO | NO | NO | NO |
| Glycolic acid | NO | NO | NO | NO | NO | YES | NO | NO |
| Mono Methyl Succinate | NO | YES | NO | NO | NO | YES | NO | NO |
| L-Galactonic-acid-?-lactone | YES | NO | YES | NO | NO | YES | NO | NO |
| D-Trehalose | NO | YES | NO | NO | NO | NO | NO | NO |
| Formic acid | NO | YES | NO | YES | NO | YES | YES | NO |
| Maltose | YES | YES | NO | YES | YES | YES | NO | YES |
| Lactulose | NO | YES | NO | NO | NO | NO | NO | NO |
| Maltotriose | YES | YES | NO | YES | YES | YES | NO | YES |
| Glyoxylic acid | NO | NO | NO | NO | NO | YES | NO | NO |
| Methyl Pyruvate | YES | YES | NO | YES | NO | YES | NO | NO |
| D-Galacturonic acid | NO | YES | YES | NO | NO | YES | NO | NO |
| D-Mannose | YES | YES | NO | NO | YES | NO | NO | NO |
| D-Mannitol | NO | YES | YES | NO | NO | YES | NO | NO |
| D-Melibiose | NO | YES | NO | NO | NO | NO | NO | YES |
| Sucrose | NO | YES | YES | NO | NO | NO | NO | NO |
| 2-Deoxy adenosine | NO | NO | NO | YES | NO | YES | NO | NO |

TABLE K-continued

Substrate utilization as determined by BIOLOG PM1 MicroPlates by bacterial endophytes belonging to core OTUs.

| | | | | | | | | |
|---|---|---|---|---|---|---|---|---|
| D-Cellobiose | NO | YES | NO | YES | YES | YES | NO | YES |
| D-Malic acid | NO | NO | NO | NO | NO | YES | NO | NO |
| Phenylethyl-amine | NO | NO | NO | NO | NO | NO | NO | NO |
| Dulcitol | NO | NO | NO | NO | NO | NO | NO | YES |
| L-Glutamic acid | NO | NO | NO | NO | NO | NO | NO | NO |
| Thymidine | NO | YES | NO | YES | NO | YES | NO | NO |
| Uridine | NO | YES | YES | YES | NO | YES | NO | NO |
| Adenosine | NO | YES | NO | YES | NO | YES | NO | NO |
| Inosine | YES | YES | NO | YES | NO | NO | NO | NO |
| L-Malic acid | NO | NO | NO | YES | NO | YES | NO | NO |
| 2-Aminoethanol | NO | YES | YES | NO | NO | YES | NO | NO |

TABLE L

Substrate utilization as determined by BIOLOG PM1 MicroPlates by bacterial endophytes belonging to core OTUs.

| | Strain/Substrate | | | | | |
|---|---|---|---|---|---|---|
| | SYM00620 | SYM00627 | SYM00628 | SYM00062C | SYM00650 | SYM00068 |
| D-Serine | NO | NO | YES | NO | NO | NO |
| D-Glucose-6-Phosphate | YES | YES | YES | NO | NO | NO |
| L-Asparagine | NO | NO | NO | NO | NO | NO |
| L-glutamine | NO | NO | NO | NO | NO | NO |
| Glycyl-L-Aspartic acid | NO | NO | NO | NO | YES | NO |
| Glycyl-L-Glutamic acid | NO | NO | NO | NO | NO | YES |
| Glycyl-L-Proline | NO | NO | NO | NO | NO | YES |
| L-Arabinose | NO | NO | YES | NO | YES | YES |
| D-Sorbitol | NO | NO | NO | NO | NO | NO |
| D-Galactonic acid-?-lactone | NO | YES | YES | NO | NO | NO |
| D-Aspartic acid | NO | NO | NO | NO | NO | NO |
| m-Tartaric acid | NO | NO | NO | NO | NO | NO |
| Citric acid | NO | NO | NO | NO | NO | YES |
| Tricarballylic acid | NO | NO | NO | NO | NO | NO |
| p-Hydroxy Phenyl acetic acid | NO | NO | NO | NO | NO | NO |
| N-Acetyl-D-Glucosamine | NO | YES | YES | NO | NO | NO |
| Glycerol | NO | NO | NO | NO | NO | NO |
| D-L-Malic acid | NO | NO | NO | NO | NO | YES |
| D-Glucosaminic acid | NO | NO | NO | NO | NO | NO |
| D-Glucose-1-Phosphate | NO | NO | NO | NO | NO | NO |
| m-Inositol | NO | NO | YES | NO | NO | NO |
| L-Serine | NO | NO | NO | NO | NO | NO |
| m-Hydroxy Phenyl Acetic acid | YES | NO | YES | NO | NO | NO |
| D-Saccharic acid | NO | NO | NO | NO | NO | NO |
| L-Fucose | NO | NO | YES | NO | NO | NO |
| D-Ribose | NO | NO | NO | NO | NO | YES |
| 1,2-Propanediol | NO | NO | NO | NO | NO | NO |
| D-Fructose-6-Phosphate | YES | YES | YES | NO | NO | NO |
| D-Threonine | NO | NO | NO | NO | NO | NO |
| L-Threonine | NO | NO | NO | NO | NO | NO |
| Tyramine | NO | NO | NO | NO | NO | YES |
| Succinic acid | NO | NO | NO | NO | NO | NO |
| D-Glucuronic acid | NO | NO | NO | NO | NO | NO |
| Tween 20 | NO | NO | NO | NO | NO | NO |
| Tween 40 | NO | NO | NO | NO | NO | NO |
| Tween 80 | NO | NO | NO | NO | NO | NO |
| Fumaric acid | NO | NO | NO | NO | NO | NO |
| L-Alanine | YES | NO | YES | NO | NO | YES |
| D-Psicose | NO | NO | NO | NO | NO | NO |
| D-Galactose | NO | NO | YES | NO | NO | NO |
| D-Gluconic acid | YES | YES | NO | NO | NO | NO |
| L-Rhamnose | YES | YES | YES | NO | YES | YES |
| a-Keto-Glutaric acid | NO | NO | NO | NO | NO | YES |
| a-Hydroxy Glutaric acid-?-lactone | NO | NO | NO | NO | NO | YES |
| Bromo succinic acid | NO | NO | NO | NO | NO | NO |
| L-Alanyl-Glycine | NO | NO | NO | NO | NO | YES |
| L-Lyxose | NO | NO | NO | NO | NO | YES |
| L-Aspartic acid | NO | NO | NO | NO | NO | NO |
| D-L-a-Glycerol phosphate | NO | NO | NO | NO | NO | NO |
| D-Fructose | NO | NO | NO | NO | NO | YES |
| a-Keto-Butyric acid | NO | NO | NO | NO | NO | NO |

TABLE L-continued

Substrate utilization as determined by BIOLOG PM1 MicroPlates by bacterial endophytes belonging to core OTUs.

| | | | | | | |
|---|---|---|---|---|---|---|
| a-Hydroxy Butyric acid | NO | NO | NO | NO | NO | NO |
| Propionic acid | NO | NO | NO | NO | NO | YES |
| Acetoacetic acid | NO | NO | NO | NO | NO | NO |
| Glucuronamide | NO | NO | NO | NO | NO | NO |
| L-Proline | NO | NO | YES | NO | NO | YES |
| D-Xylose | NO | YES | YES | NO | YES | YES |
| Acetic acid | NO | NO | NO | NO | NO | NO |
| a-Methyl-D-Galactoside | YES | YES | YES | NO | NO | NO |
| β-Methyl-D-glucoside | NO | YES | YES | NO | NO | NO |
| Mucic acid | NO | YES | YES | NO | YES | YES |
| N-acetyl-β-D-Mannosamine | NO | NO | YES | NO | NO | NO |
| Pyruvic acid | NO | YES | NO | NO | NO | YES |
| D-Alanine | NO | NO | YES | NO | NO | NO |
| L-Lactic acid | NO | NO | NO | NO | NO | NO |
| a-D-Glucose | NO | NO | NO | NO | YES | NO |
| a-D-Lactose | NO | NO | NO | YES | NO | NO |
| Adonitol | NO | NO | NO | NO | NO | NO |
| Glycolic acid | NO | NO | NO | NO | NO | NO |
| Mono Methyl Succinate | NO | NO | NO | NO | YES | NO |
| L-Galactonic-acid-?-lactone | YES | YES | YES | NO | NO | YES |
| D-Trehalose | NO | NO | NO | NO | YES | NO |
| Formic acid | NO | YES | NO | NO | NO | NO |
| Maltose | NO | YES | YES | YES | YES | NO |
| Lactulose | NO | NO | NO | YES | NO | NO |
| Maltotriose | NO | YES | YES | NO | NO | NO |
| Glyoxylic acid | NO | NO | NO | NO | NO | NO |
| Methyl Pyruvate | NO | NO | NO | NO | NO | YES |
| D-Galacturonic acid | YES | NO | NO | NO | NO | NO |
| D-Mannose | NO | NO | NO | NO | NO | NO |
| D-Mannitol | NO | NO | NO | NO | NO | NO |
| D-Melibiose | NO | YES | YES | YES | NO | NO |
| Sucrose | NO | YES | NO | NO | NO | NO |
| 2-Deoxy adenosine | YES | YES | YES | NO | NO | NO |
| D-Cellobiose | NO | YES | YES | NO | NO | NO |
| D-Malic acid | NO | NO | NO | NO | YES | YES |
| Phenylethyl-amine | NO | NO | NO | NO | NO | NO |
| Dulcitol | NO | YES | NO | YES | NO | NO |
| L-Glutamic acid | NO | NO | NO | NO | NO | NO |
| Thymidine | NO | YES | YES | YES | NO | NO |
| Uridine | NO | NO | YES | NO | NO | NO |
| Adenosine | YES | NO | YES | NO | NO | NO |
| Inosine | NO | NO | NO | NO | NO | NO |
| L-Malic acid | NO | NO | NO | NO | NO | NO |
| 2-Aminoethanol | NO | NO | NO | NO | NO | NO |

| | Strain/Substrate | | | | | |
|---|---|---|---|---|---|---|
| | SYM00070 | SYM00714 | SYM00009 | SYM00905 | SYM00924 | SYM00963 |
| D-Serine | NO | NO | NO | NO | NO | NO |
| D-Glucose-6-Phosphate | NO | YES | NO | NO | NO | NO |
| L-Asparagine | NO | NO | NO | NO | NO | NO |
| L-glutamine | NO | NO | NO | NO | NO | NO |
| Glycyl-L-Aspartic acid | NO | NO | NO | NO | NO | NO |
| Glycyl-L-Glutamic acid | NO | NO | NO | NO | NO | NO |
| Glycyl-L-Proline | NO | NO | NO | YES | NO | NO |
| L-Arabinose | YES | YES | YES | NO | NO | NO |
| D-Sorbitol | NO | YES | NO | NO | NO | NO |
| D-Galactonic acid-?-lactone | NO | YES | NO | NO | NO | NO |
| D-Aspartic acid | NO | NO | NO | NO | NO | NO |
| m-Tartaric acid | NO | NO | NO | NO | NO | NO |
| Citric acid | NO | NO | NO | NO | NO | NO |
| Tricarballylic acid | NO | NO | NO | NO | NO | NO |
| p-Hydroxy Phenyl acetic acid | NO | NO | NO | NO | NO | NO |
| N-Acetyl-D-Glucosamine | YES | YES | NO | NO | NO | NO |
| Glycerol | YES | YES | NO | NO | NO | NO |
| D-L-Malic acid | YES | YES | NO | NO | NO | NO |
| D-Glucosaminic acid | NO | NO | YES | NO | NO | NO |
| D-Glucose-1-Phosphate | NO | YES | NO | NO | NO | NO |
| m-Inositol | NO | YES | NO | NO | NO | NO |
| L-Serine | NO | YES | NO | NO | NO | NO |
| m-Hydroxy Phenyl Acetic acid | NO | NO | NO | NO | NO | NO |
| D-Saccharic acid | YES | YES | NO | NO | NO | NO |
| L-Fucose | YES | YES | NO | NO | NO | YES |
| D-Ribose | YES | NO | NO | NO | NO | NO |
| 1,2-Propanediol | NO | NO | NO | NO | NO | NO |
| D-Fructose-6-Phosphate | YES | YES | NO | NO | YES | NO |

TABLE L-continued

Substrate utilization as determined by BIOLOG PM1 MicroPlates by bacterial endophytes belonging to core OTUs.

| | | | | | | |
|---|---|---|---|---|---|---|
| D-Threonine | NO | NO | NO | NO | NO | NO |
| L-Threonine | NO | NO | NO | NO | NO | NO |
| Tyramine | YES | NO | NO | NO | NO | NO |
| Succinic acid | NO | NO | NO | NO | NO | NO |
| D-Glucuronic acid | NO | NO | NO | NO | NO | NO |
| Tween 20 | NO | NO | NO | NO | NO | NO |
| Tween 40 | NO | NO | NO | NO | NO | NO |
| Tween 80 | NO | NO | YES | YES | NO | YES |
| Fumaric acid | NO | NO | NO | NO | NO | NO |
| L-Alanine | YES | YES | NO | YES | NO | NO |
| D-Psicose | NO | YES | NO | NO | NO | NO |
| D-Galactose | YES | NO | NO | NO | NO | NO |
| D-Gluconic acid | NO | YES | NO | NO | NO | NO |
| L-Rhamnose | YES | YES | NO | NO | NO | NO |
| a-Keto-Glutaric acid | YES | YES | NO | NO | NO | NO |
| a-Hydroxy Glutaric acid-?-lactone | YES | YES | NO | NO | NO | NO |
| Bromo succinic acid | NO | NO | NO | NO | NO | NO |
| L-Alanyl-Glycine | YES | NO | NO | NO | NO | NO |
| L-Lyxose | YES | YES | NO | NO | NO | NO |
| L-Aspartic acid | YES | YES | NO | NO | YES | NO |
| D-L-a-Glycerol phosphate | NO | NO | NO | NO | NO | NO |
| D-Fructose | YES | YES | NO | NO | NO | NO |
| a-Keto-Butyric acid | NO | NO | NO | NO | NO | NO |
| a-Hydroxy Butyric acid | NO | NO | NO | NO | NO | NO |
| Propionic acid | NO | YES | NO | NO | NO | YES |
| Acetoacetic acid | NO | NO | NO | NO | NO | NO |
| Glucuronamide | NO | NO | NO | NO | NO | NO |
| L-Proline | YES | NO | NO | NO | NO | NO |
| D-Xylose | YES | YES | YES | NO | NO | NO |
| Acetic acid | YES | YES | NO | NO | NO | NO |
| a-Methyl-D-Galactoside | NO | YES | NO | NO | NO | YES |
| β-Methyl-D-glucoside | YES | YES | NO | NO | NO | NO |
| Mucic acid | YES | YES | YES | NO | NO | YES |
| N-acetyl-β-D-Mannosamine | NO | NO | NO | NO | NO | NO |
| Pyruvic acid | NO | NO | NO | NO | NO | NO |
| D-Alanine | YES | NO | NO | NO | NO | NO |
| L-Lactic acid | NO | YES | NO | NO | NO | NO |
| a-D-Glucose | YES | YES | NO | NO | NO | NO |
| a-D-Lactose | NO | YES | NO | NO | NO | YES |
| Adonitol | YES | YES | NO | NO | NO | NO |
| Glycolic acid | NO | NO | NO | NO | NO | NO |
| Mono Methyl Succinate | NO | NO | NO | NO | YES | NO |
| L-Galactonic-acid-?-lactone | YES | YES | YES | NO | NO | NO |
| D-Trehalose | NO | YES | NO | NO | NO | NO |
| Formic acid | YES | YES | NO | NO | NO | NO |
| Maltose | YES | YES | NO | YES | NO | YES |
| Lactulose | NO | YES | NO | NO | NO | YES |
| Maltotriose | YES | YES | NO | YES | NO | YES |
| Glyoxylic acid | NO | NO | NO | NO | YES | NO |
| Methyl Pyruvate | NO | NO | NO | NO | NO | YES |
| D-Galacturonic acid | NO | YES | NO | NO | NO | NO |
| D-Mannose | NO | YES | NO | YES | NO | NO |
| D-Mannitol | NO | YES | NO | NO | NO | NO |
| D-Melibiose | YES | YES | NO | NO | NO | NO |
| Sucrose | NO | NO | NO | NO | NO | NO |
| 2-Deoxy adenosine | YES | NO | NO | NO | NO | NO |
| D-Cellobiose | NO | YES | NO | YES | NO | NO |
| D-Malic acid | NO | YES | NO | NO | NO | YES |
| Phenylethyl-amine | NO | NO | NO | NO | NO | NO |
| Dulcitol | NO | NO | NO | NO | NO | YES |
| L-Glutamic acid | NO | NO | NO | NO | NO | NO |
| Thymidine | NO | NO | NO | NO | NO | YES |
| Uridine | YES | NO | YES | NO | NO | NO |
| Adenosine | NO | NO | NO | NO | NO | NO |
| Inosine | NO | YES | NO | NO | NO | NO |
| L-Malic acid | NO | YES | NO | NO | NO | NO |
| 2-Aminoethanol | NO | NO | NO | NO | NO | NO |

| | Strain/Substrate | | | | |
|---|---|---|---|---|---|
| | SYM00978 | SYM00982 | SYM00987 | SYM00991 | SYM00999 |
| D-Serine | YES | NO | NO | YES | NO |
| D-Glucose-6-Phosphate | NO | NO | NO | YES | NO |
| L-Asparagine | NO | NO | NO | NO | NO |
| L-glutamine | NO | NO | NO | NO | NO |

TABLE L-continued

Substrate utilization as determined by BIOLOG PM1 MicroPlates by bacterial endophytes belonging to core OTUs.

| | | | | | |
|---|---|---|---|---|---|
| Glycyl-L-Aspartic acid | NO | NO | NO | NO | NO |
| Glycyl-L-Glutamic acid | NO | NO | NO | NO | NO |
| Glycyl-L-Proline | NO | NO | NO | NO | NO |
| L-Arabinose | NO | NO | YES | NO | YES |
| D-Sorbitol | NO | NO | NO | NO | NO |
| D-Galactonic acid-?-lactone | NO | NO | NO | NO | NO |
| D-Aspartic acid | NO | NO | NO | NO | NO |
| m-Tartaric acid | NO | NO | NO | NO | NO |
| Citric acid | NO | NO | NO | NO | NO |
| Tricarballylic acid | NO | NO | NO | NO | NO |
| p-Hydroxy Phenyl acetic acid | NO | NO | YES | NO | NO |
| N-Acetyl-D-Glucosamine | NO | NO | YES | NO | NO |
| Glycerol | NO | NO | NO | NO | NO |
| D-L-Malic acid | NO | YES | NO | NO | NO |
| D-Glucosaminic acid | NO | NO | NO | NO | NO |
| D-Glucose-1-Phosphate | NO | NO | NO | NO | NO |
| m-Inositol | NO | NO | NO | NO | NO |
| L-Serine | NO | NO | NO | NO | NO |
| m-Hydroxy Phenyl Acetic acid | NO | NO | NO | NO | NO |
| D-Saccharic acid | NO | NO | YES | NO | YES |
| L-Fucose | YES | NO | NO | NO | NO |
| D-Ribose | NO | NO | NO | NO | NO |
| 1,2-Propanediol | NO | NO | NO | NO | NO |
| D-Fructose-6-Phosphate | NO | NO | NO | YES | NO |
| D-Threonine | NO | NO | NO | NO | NO |
| L-Threonine | NO | NO | NO | NO | NO |
| Tyramine | NO | NO | NO | NO | NO |
| Succinic acid | NO | NO | NO | NO | NO |
| D-Glucuronic acid | NO | NO | NO | NO | NO |
| Tween 20 | NO | NO | NO | NO | NO |
| Tween 40 | NO | NO | NO | NO | NO |
| Tween 80 | NO | NO | YES | NO | NO |
| Fumaric acid | NO | NO | NO | NO | NO |
| L-Alanine | NO | NO | NO | NO | NO |
| D-Psicose | NO | NO | NO | NO | NO |
| D-Galactose | NO | NO | NO | NO | NO |
| D-Gluconic acid | NO | NO | NO | NO | NO |
| L-Rhamnose | NO | NO | NO | NO | NO |
| a-Keto-Glutaric acid | NO | YES | NO | NO | NO |
| a-Hydroxy Glutaric acid-?-lactone | NO | NO | NO | NO | NO |
| Bromo succinic acid | NO | NO | NO | NO | NO |
| L-Alanyl-Glycine | NO | NO | NO | NO | NO |
| L-Lyxose | NO | NO | NO | NO | NO |
| L-Aspartic acid | NO | NO | NO | NO | NO |
| D-L-a-Glycerol phosphate | NO | NO | NO | NO | NO |
| D-Fructose | NO | NO | NO | NO | NO |
| a-Keto-Butyric acid | NO | NO | NO | NO | NO |
| a-Hydroxy Butyric acid | NO | NO | NO | NO | NO |
| Propionic acid | NO | NO | NO | NO | NO |
| Acetoacetic acid | NO | NO | NO | NO | NO |
| Glucuronamide | NO | NO | NO | NO | NO |
| L-Proline | NO | NO | NO | NO | NO |
| D-Xylose | NO | NO | NO | NO | NO |
| Acetic acid | NO | YES | NO | NO | NO |
| a-Methyl-D-Galactoside | NO | NO | NO | NO | NO |
| β-Methyl-D-glucoside | NO | NO | NO | NO | NO |
| Mucic acid | NO | NO | YES | NO | YES |
| N-acetyl-β-D-Mannosamine | YES | NO | NO | YES | NO |
| Pyruvic acid | NO | NO | NO | NO | NO |
| D-Alanine | NO | NO | NO | NO | NO |
| L-Lactic acid | NO | NO | YES | NO | NO |
| a-D-Glucose | NO | NO | YES | YES | NO |
| a-D-Lactose | NO | NO | NO | NO | NO |
| Adonitol | NO | NO | NO | NO | NO |
| Glycolic acid | NO | NO | NO | NO | NO |
| Mono Methyl Succinate | NO | NO | NO | NO | YES |
| L-Galactonic-acid-?-lactone | NO | NO | YES | NO | NO |
| D-Trehalose | NO | NO | NO | NO | NO |
| Formic acid | NO | NO | NO | NO | NO |
| Maltose | NO | NO | NO | YES | NO |
| Lactulose | NO | NO | YES | NO | NO |
| Maltotriose | NO | NO | NO | NO | NO |
| Glyoxylic acid | NO | NO | NO | NO | YES |
| Methyl Pyruvate | NO | NO | NO | NO | YES |
| D-Galacturonic acid | NO | NO | NO | NO | NO |
| D-Mannose | NO | NO | NO | NO | NO |

TABLE L-continued

| Substrate utilization as determined by BIOLOG PM1 MicroPlates by bacterial endophytes belonging to core OTUs. | | | | | |
|---|---|---|---|---|---|
| D-Mannitol | NO | NO | NO | NO | NO |
| D-Melibiose | NO | NO | NO | NO | NO |
| Sucrose | NO | NO | YES | YES | NO |
| 2-Deoxy adenosine | NO | NO | NO | NO | NO |
| D-Cellobiose | NO | NO | NO | NO | NO |
| D-Malic acid | NO | NO | NO | NO | NO |
| Phenylethyl-amine | NO | NO | NO | NO | NO |
| Dulcitol | NO | NO | NO | NO | NO |
| L-Glutamic acid | NO | NO | NO | NO | NO |
| Thymidine | NO | NO | NO | NO | NO |
| Uridine | NO | NO | NO | NO | NO |
| Adenosine | NO | NO | NO | NO | NO |
| Inosine | NO | NO | NO | NO | NO |
| L-Malic acid | NO | NO | NO | NO | NO |
| 2-Aminoethanol | NO | NO | NO | NO | NO |

TABLE M

Substrate utilization as determined by BIOLOG PM2A MicroPlates by bacterial endophytes belonging to core OTUs.

| | Strain/Substrate | | | | | | | |
|---|---|---|---|---|---|---|---|---|
| | SYM00103 | SYM01049 | SYM00013 | SYM00017A | SYM00018 | SYM00183 | SYM00184 | SYM00020 |
| N-acetyl-D-Galactosamine | NO | NO | NO | YES | NO | YES | YES | NO |
| Gentiobiose | NO | NO | NO | YES | YES | YES | YES | YES |
| D-Raffinose | NO | NO | NO | YES | NO | NO | NO | NO |
| Capric acid | NO | NO | NO | NO | NO | NO | NO | NO |
| D-lactic acid methyl ester | NO | NO | NO | NO | NO | NO | NO | NO |
| Acetamide | NO | NO | NO | NO | NO | NO | NO | NO |
| L-Ornithine | YES | NO | YES | YES | YES | NO | YES | YES |
| Chondrointin sulfate C | NO | NO | NO | NO | NO | NO | NO | NO |
| N-acetyl-neuraminic acid | NO | NO | NO | NO | NO | NO | NO | NO |
| L-glucose | NO | NO | NO | NO | NO | NO | NO | NO |
| Salicin | NO | NO | NO | YES | NO | YES | YES | NO |
| Caproic acid | NO | NO | NO | NO | NO | NO | NO | NO |
| Malonic acid | NO | NO | NO | NO | NO | NO | NO | NO |
| L-Alaninamide | NO | NO | NO | NO | NO | YES | YES | NO |
| L-Phenylalanine | NO | NO | YES | NO | NO | NO | NO | NO |
| a-Cyclodextrin | NO | NO | NO | NO | NO | NO | NO | NO |
| β-D-allose | NO | NO | NO | YES | NO | NO | NO | NO |
| Lactitol | NO | NO | NO | YES | NO | YES | YES | NO |
| Sedoheptulosan | NO | NO | NO | NO | NO | NO | NO | NO |
| Citraconic acid | NO | NO | YES | NO | NO | NO | NO | NO |
| Melibionic acid | NO | NO | NO | YES | NO | NO | NO | NO |
| N-Acetyl-L-Glutamic acid | YES | NO | NO | YES | NO | NO | YES | NO |
| L-Pyroglutamic acid | YES | NO | YES | YES | YES | YES | YES | YES |
| β-Cyclodextrin | NO | NO | NO | NO | NO | NO | NO | NO |
| Amygdalin | NO | NO | NO | NO | NO | YES | YES | NO |
| D-Melezitose | NO | NO | NO | NO | NO | NO | NO | NO |
| L-Sorbose | NO | NO | NO | NO | NO | NO | NO | NO |
| Citramalic acid | NO | NO | NO | NO | NO | NO | NO | NO |
| Oxalic acid | NO | NO | NO | NO | NO | NO | NO | NO |
| L-Arginine | NO | NO | NO | YES | NO | NO | NO | NO |
| L-Valine | YES | NO | YES | YES | YES | NO | YES | YES |
| γ-Cyclodextrin | NO | NO | NO | NO | NO | NO | NO | NO |
| D-arabinose | NO | NO | NO | NO | NO | NO | NO | NO |
| Maltitol | NO | NO | NO | YES | NO | YES | YES | NO |
| Stachyose | NO | NO | NO | NO | NO | NO | NO | NO |
| D-Glucosamine | YES | YES | YES | YES | YES | YES | YES | YES |
| Oxalomalic acid | YES | NO | YES | YES | YES | YES | YES | YES |
| Glycine | NO | NO | NO | NO | NO | NO | NO | NO |
| D,L-Carnitine | YES | YES | YES | YES | YES | NO | NO | NO |
| Dextrin | NO | NO | NO | NO | NO | NO | YES | NO |
| D-arabitol | NO | NO | NO | NO | NO | NO | NO | NO |
| a-Methyl-D-Glucoside | NO | NO | NO | NO | NO | NO | NO | NO |
| D-Tagatose | NO | NO | NO | NO | NO | NO | NO | NO |
| 2-Hydroxy benzoic acid | NO | NO | NO | NO | NO | NO | NO | NO |
| Quinic acid | NO | NO | NO | NO | NO | NO | NO | NO |
| L-Histidine | NO | YES | NO | NO | NO | NO | NO | NO |
| Sec-Butylamine | NO | NO | NO | NO | NO | NO | NO | NO |
| Gelatin | NO | NO | NO | NO | NO | YES | YES | NO |
| L-arabitol | NO | NO | NO | NO | NO | NO | NO | NO |

TABLE M-continued

Substrate utilization as determined by BIOLOG PM2A MicroPlates by bacterial endophytes belonging to core OTUs.

| | | | | | | | | |
|---|---|---|---|---|---|---|---|---|
| β-Methyl-D-Galactoside | NO | NO | NO | YES | NO | NO | YES | NO |
| Turanose | NO | YES | NO | YES | NO | YES | YES | NO |
| 4-Hydroxy benzoic acid | NO | NO | NO | NO | NO | NO | NO | NO |
| D-Ribono-1,4-Lactone | NO | NO | NO | YES | NO | NO | NO | NO |
| L-Homoserine | NO | NO | NO | NO | NO | NO | NO | NO |
| D,L-Octopamine | YES | NO | YES | YES | YES | YES | YES | YES |
| Glycogen | NO | NO | NO | NO | NO | NO | NO | NO |
| Arbutin | NO | NO | NO | YES | NO | YES | YES | NO |
| 3-Methyl Glucose | NO | NO | NO | NO | NO | NO | NO | NO |
| Xylitol | NO | NO | NO | NO | NO | NO | YES | NO |
| β-Hydroxy butyric acid | NO | NO | NO | NO | NO | NO | NO | NO |
| Sebacic acid | YES | NO | NO | NO | NO | NO | NO | NO |
| Hydroxy-L-Proline | NO | NO | NO | NO | NO | NO | NO | NO |
| Putrescine | YES | NO | NO | YES | YES | NO | NO | NO |
| Inulin | NO | NO | NO | YES | NO | YES | YES | NO |
| 2-Deoxy-D-Ribose | NO | NO | NO | NO | NO | NO | NO | NO |
| β-Methyl-D-Glucuronic acid | NO | NO | NO | NO | NO | NO | NO | NO |
| N-Acetyl-D-glucosaminitol | NO | NO | NO | NO | NO | NO | NO | NO |
| γ-Hydroxy butyric acid | NO | NO | NO | NO | NO | NO | NO | NO |
| Sorbic acid | NO | NO | NO | NO | NO | NO | NO | NO |
| L-Isoleucine | YES | NO | YES | YES | NO | NO | NO | NO |
| Dihydroxy acetone | NO | YES | NO | NO | NO | NO | YES | NO |
| Laminarin | NO | NO | NO | NO | NO | NO | NO | NO |
| i-Erythritol | NO | NO | NO | NO | NO | NO | NO | NO |
| a-Methyl-D-Mannoside | NO | NO | NO | NO | NO | NO | NO | NO |
| γ-amino butyric acid | YES | YES | YES | YES | YES | NO | NO | NO |
| a-Keto-valeric acid | NO | NO | NO | NO | NO | NO | NO | NO |
| Succinamic acid | NO | YES | NO | NO | NO | NO | NO | NO |
| L-Leucine | YES | NO | YES | YES | NO | NO | NO | NO |
| 2,3-Butanediol | NO | NO | YES | NO | NO | NO | NO | NO |
| Mannan | NO | NO | NO | NO | NO | NO | NO | NO |
| D-Fucose | NO | NO | NO | NO | NO | NO | NO | NO |
| β-Methyl-D-Xyloside | NO | NO | NO | YES | NO | NO | NO | NO |
| d-amino valeric acid | NO | NO | NO | NO | NO | NO | NO | NO |
| Itaconic acid | NO | NO | NO | NO | NO | NO | NO | NO |
| D-Tartaric acid | NO | NO | NO | NO | NO | NO | NO | NO |
| L-Lysine | NO | NO | NO | NO | NO | NO | NO | NO |
| 2,3-Butanone | NO | NO | NO | NO | NO | NO | NO | NO |
| Pectin | NO | NO | NO | NO | NO | NO | NO | NO |
| 3-0-β-D-Galactopyranosyl-D-arabinose | NO | NO | NO | NO | NO | NO | NO | NO |
| Palatinose | NO | NO | NO | YES | NO | YES | YES | NO |
| Butyric acid | NO | NO | NO | NO | NO | NO | NO | NO |
| 5-Keto-D-Gluconic acid | NO | NO | NO | NO | YES | NO | NO | YES |
| L-Tartaric acid | YES | NO | YES | NO | YES | NO | NO | YES |
| L-Methionine | NO | NO | NO | NO | NO | NO | NO | NO |
| 3-Hydroxy 2-Butanone | NO | NO | NO | NO | NO | NO | NO | NO |

| | Strain/Substrate | | | | | | |
|---|---|---|---|---|---|---|---|
| | SYM00207 | SYM00212 | SYM00219 | SYM00234 | SYM00236 | SYM00248 | SYM00249 |
| N-acetyl-D-Galactosamine | NO | NO | NO | NO | NO | NO | NO |
| Gentiobiose | NO | YES | YES | YES | NO | YES | YES |
| D-Raffinose | NO | YES | YES | YES | NO | YES | YES |
| Capric acid | YES | NO | NO | NO | NO | NO | NO |
| D-lactic acid methyl ester | NO | NO | NO | NO | NO | NO | NO |
| Acetamide | NO | NO | NO | NO | NO | NO | NO |
| L-Ornithine | YES | YES | YES | YES | YES | NO | NO |
| Chondrointin sulfate C | NO | NO | NO | NO | NO | NO | NO |
| N-acetyl-neuraminic acid | NO | NO | NO | NO | NO | NO | NO |
| L-glucose | NO | NO | NO | NO | NO | YES | NO |
| Salicin | NO | YES | YES | YES | NO | NO | YES |
| Caproic acid | YES | NO | NO | NO | NO | NO | NO |
| Malonic acid | NO | NO | NO | NO | NO | NO | NO |
| L-Alaninamide | NO | NO | NO | NO | YES | NO | YES |
| L-Phenylalanine | NO | NO | NO | NO | NO | NO | NO |
| a-Cyclodextrin | NO | YES | NO | YES | NO | NO | NO |
| β-D-allose | NO | NO | NO | NO | NO | NO | NO |
| Lactitol | NO | NO | NO | YES | NO | YES | NO |
| Sedoheptulosan | NO | NO | NO | NO | NO | NO | NO |
| Citraconic acid | NO | NO | NO | NO | NO | NO | NO |
| Melibionic acid | NO | YES | YES | NO | NO | YES | NO |
| N-Acetyl-L-Glutamic acid | NO | NO | NO | YES | NO | NO | NO |
| L-Pyroglutamic acid | YES | YES | YES | YES | YES | YES | NO |
| β-Cyclodextrin | NO | NO | YES | YES | NO | NO | YES |
| Amygdalin | NO | YES | NO | YES | NO | YES | YES |

TABLE M-continued

Substrate utilization as determined by BIOLOG PM2A MicroPlates by bacterial endophytes belonging to core OTUs.

| | | | | | | | |
|---|---|---|---|---|---|---|---|
| D-Melezitose | NO | YES | NO | YES | NO | YES | YES |
| L-Sorbose | NO | NO | NO | NO | NO | NO | NO |
| Citramalic acid | NO | NO | NO | NO | NO | NO | NO |
| Oxalic acid | NO | NO | NO | NO | NO | NO | NO |
| L-Arginine | NO | NO | NO | NO | NO | NO | NO |
| L-Valine | NO | YES | YES | YES | NO | NO | NO |
| γ-Cyclodextrin | NO | NO | YES | YES | NO | NO | NO |
| D-arabinose | NO | NO | NO | NO | NO | NO | NO |
| Maltitol | NO | YES | NO | YES | NO | YES | YES |
| Stachyose | NO | YES | NO | YES | NO | NO | NO |
| D-Glucosamine | NO | YES | YES | YES | YES | YES | YES |
| Oxalomalic acid | NO | NO | NO | YES | YES | YES | YES |
| Glycine | NO | NO | NO | NO | NO | NO | YES |
| D,L-Carnitine | NO | NO | NO | YES | NO | NO | YES |
| Dextrin | NO | NO | YES | YES | NO | NO | NO |
| D-arabitol | YES | NO | NO | NO | NO | NO | NO |
| a-Methyl-D-Glucoside | NO | NO | NO | YES | YES | NO | YES |
| D-Tagatose | NO | NO | NO | NO | NO | NO | YES |
| 2-Hydroxy benzoic acid | NO | NO | NO | NO | NO | NO | NO |
| Quinic acid | NO | NO | NO | NO | NO | NO | NO |
| L-Histidine | YES | YES | NO | NO | NO | NO | NO |
| Sec-Butylamine | NO | NO | NO | NO | NO | NO | YES |
| Gelatin | YES | NO | NO | YES | NO | NO | YES |
| L-arabitol | NO | NO | NO | NO | NO | NO | NO |
| β-Methyl-D-Galactoside | NO | NO | NO | YES | NO | NO | NO |
| Turanose | NO | YES | NO | YES | NO | NO | YES |
| 4-Hydroxy benzoic acid | NO | NO | NO | NO | NO | NO | NO |
| D-Ribono-1,4-Lactone | NO | NO | NO | NO | NO | NO | NO |
| L-Homoserine | YES | NO | NO | NO | NO | NO | NO |
| D,L-Octopamine | NO | NO | YES | YES | YES | NO | NO |
| Glycogen | NO | NO | NO | YES | NO | NO | NO |
| Arbutin | NO | YES | YES | YES | NO | YES | YES |
| 3-Methyl Glucose | NO | NO | NO | NO | NO | NO | NO |
| Xylitol | NO | NO | NO | YES | NO | NO | NO |
| β-Hydroxy butyric acid | NO | NO | NO | NO | NO | NO | NO |
| Sebacic acid | NO | NO | NO | NO | YES | NO | NO |
| Hydroxy-L-Proline | NO | NO | NO | NO | YES | NO | YES |
| Putrescine | NO | YES | NO | NO | NO | NO | NO |
| Inulin | NO | NO | YES | NO | NO | YES | YES |
| 2-Deoxy-D-Ribose | NO | NO | NO | NO | NO | NO | NO |
| β-Methyl-D-Glucuronic acid | NO | NO | NO | NO | NO | NO | NO |
| N-Acetyl-D-glucosaminitol | NO | NO | NO | NO | NO | NO | NO |
| γ-Hydroxy butyric acid | NO | NO | NO | NO | NO | NO | NO |
| Sorbic acid | NO | NO | NO | NO | NO | NO | NO |
| L-Isoleucine | YES | YES | NO | YES | NO | NO | NO |
| Dihydroxy acetone | NO | NO | NO | NO | NO | NO | NO |
| Laminarin | NO | NO | NO | YES | NO | NO | NO |
| i-Erythritol | YES | NO | NO | NO | NO | NO | NO |
| a-Methyl-D-Mannoside | NO | NO | NO | NO | NO | NO | NO |
| γ-amino butyric acid | NO | NO | NO | YES | NO | NO | YES |
| a-Keto-valeric acid | NO | NO | NO | NO | NO | NO | NO |
| Succinamic acid | NO | YES | NO | NO | NO | NO | NO |
| L-Leucine | YES | NO | NO | YES | NO | NO | NO |
| 2,3-Butanediol | NO | NO | NO | YES | NO | NO | NO |
| Mannan | NO | NO | NO | NO | NO | NO | NO |
| D-Fucose | NO | NO | NO | NO | NO | NO | NO |
| β-Methyl-D-Xyloside | NO | NO | NO | YES | NO | NO | NO |
| d-amino valeric acid | NO | NO | NO | NO | YES | NO | NO |
| Itaconic acid | YES | YES | NO | NO | NO | NO | NO |
| D-Tartaric acid | NO | NO | NO | NO | NO | NO | NO |
| L-Lysine | NO | NO | NO | NO | NO | NO | NO |
| 2,3-Butanone | NO | NO | NO | NO | NO | NO | NO |
| Pectin | NO | NO | NO | YES | NO | NO | NO |
| 3-0-β-D-Galactopyranosyl-D-arabinose | NO | NO | NO | YES | NO | NO | NO |
| Palatinose | NO | YES | YES | YES | NO | NO | NO |
| Butyric acid | YES | NO | NO | NO | NO | NO | NO |
| 5-Keto-D-Gluconic acid | NO | NO | NO | NO | NO | NO | NO |
| L-Tartaric acid | NO | NO | NO | NO | NO | NO | NO |
| L-Methionine | NO | NO | NO | NO | NO | NO | NO |
| 3-Hydroxy 2-Butanone | NO | NO | NO | NO | NO | NO | NO |

TABLE N

Substrate utilization as determined by BIOLOG PM2A MicroPlates by bacterial endophytes belonging to core OTUs.

| | Strain/Substrate | | | | | | | |
|---|---|---|---|---|---|---|---|---|
| | SYM00260 | SYM00290 | SYM00292 | SYM00003 | SYM00043 | SYM00050 | SYM05066 | SYM00508 |
| N-acetyl-D-Galactosamine | NO | NO | NO | NO | NO | YES | NO | NO |
| Gentiobiose | YES | YES | YES | NO | YES | YES | NO | YES |
| D-Raffinose | YES | YES | YES | NO | NO | YES | NO | NO |
| Capric acid | NO | NO | NO | NO | NO | NO | NO | NO |
| D-laclic acid methyl ester | NO | NO | NO | NO | NO | YES | NO | NO |
| Acetamide | NO | NO | NO | NO | NO | NO | NO | NO |
| L-Ornithine | YES | NO | NO | YES | NO | YES | NO | NO |
| Chondrointin sulfate C | YES | NO | NO | NO | NO | NO | NO | NO |
| N-acetyl-neuraminic acid | NO | NO | NO | NO | NO | NO | NO | NO |
| L-glucose | NO | NO | NO | NO | NO | NO | NO | NO |
| Salicin | YES | YES | YES | NO | NO | YES | NO | YES |
| Caproic acid | YES | NO | YES | NO | NO | NO | NO | YES |
| Malonic acid | YES | NO | NO | NO | NO | NO | NO | NO |
| L-Alaninamide | NO | YES | NO | NO | NO | NO | NO | NO |
| L-Phenylalanine | YES | NO | NO | YES | NO | NO | NO | NO |
| a-Cyclodextrin | NO | YES | YES | NO | NO | NO | NO | NO |
| β-D-allose | NO | NO | YES | NO | NO | NO | NO | NO |
| Lactitol | NO | YES | YES | NO | NO | NO | NO | NO |
| Sedoheptulosan | NO | NO | NO | NO | NO | NO | NO | NO |
| Citraconic acid | NO | NO | NO | YES | NO | NO | NO | NO |
| Melibionic acid | YES | NO | NO | NO | NO | YES | NO | NO |
| N-Acetyl-L-Glutamic acid | YES | NO | YES | NO | NO | YES | NO | NO |
| L-Pyroglutamic acid | YES | NO | YES | YES | NO | NO | NO | YES |
| β-Cyclodextrin | NO | YES | YES | NO | NO | NO | NO | NO |
| Amygdalin | NO | YES | YES | NO | NO | NO | NO | NO |
| D-Melezitose | NO | YES | YES | NO | NO | NO | NO | NO |
| L-Sorbose | NO | NO | NO | NO | NO | NO | NO | NO |
| Citramalic acid | YES | NO | YES | NO | NO | NO | NO | NO |
| Oxalic acid | NO | NO | NO | NO | NO | NO | NO | NO |
| L-Arginine | YES | NO | NO | NO | NO | NO | NO | NO |
| L-Valine | YES | NO | YES | YES | NO | NO | NO | NO |
| γ-Cyclodextrin | NO | YES | YES | NO | NO | NO | NO | NO |
| D-arabinose | NO | YES | YES | NO | NO | NO | NO | YES |
| Maltitol | NO | YES | YES | NO | NO | NO | NO | NO |
| Stachyose | YES | YES | YES | NO | NO | NO | NO | NO |
| D-Glucosamine | YES | YES | YES | YES | YES | YES | NO | YES |
| Oxalomalic acid | YES | YES | YES | YES | YES | NO | YES | NO |
| Glycine | NO | NO | NO | NO | NO | NO | NO | NO |
| D,L-Carnitine | NO | NO | NO | YES | NO | NO | NO | NO |
| Dextrin | YES | YES | YES | NO | NO | NO | NO | YES |
| D-arabitol | NO | NO | YES | NO | NO | NO | NO | YES |
| a-Methyl-D-Glucoside | NO | YES | YES | NO | NO | NO | NO | NO |
| D-Tagatose | NO | YES | NO | NO | NO | NO | NO | YES |
| 2-Hydroxy benzoic acid | NO | NO | NO | NO | NO | NO | NO | NO |
| Quinic acid | NO | NO | NO | NO | NO | NO | NO | NO |
| L-Histidine | YES | YES | NO | NO | YES | NO | NO | NO |
| Sec-Butylamine | NO | NO | NO | NO | NO | NO | NO | NO |
| Gelatin | YES | YES | YES | NO | NO | NO | NO | NO |
| L-arabitol | NO | NO | NO | NO | NO | NO | NO | NO |
| β-Methyl-D-Galactoside | NO | YES | YES | NO | NO | NO | NO | YES |
| Turanose | NO | YES | YES | NO | NO | NO | NO | NO |
| 4-Hydroxy benzoic acid | NO | NO | NO | NO | NO | NO | NO | NO |
| D-Ribono-1,4-Lactone | NO | NO | NO | NO | NO | NO | NO | NO |
| L-Homoserine | NO | NO | NO | NO | NO | NO | NO | NO |
| D,L-Octopamine | NO | NO | NO | YES | NO | NO | YES | NO |
| Glycogen | YES | YES | YES | NO | NO | NO | NO | YES |
| Arbutin | NO | YES | YES | NO | NO | YES | NO | YES |
| 3-Methyl Glucose | NO | NO | YES | NO | NO | NO | NO | YES |
| Xylitol | NO | NO | YES | NO | NO | NO | NO | NO |
| β-Hydroxy butyric acid | YES | NO | NO | NO | NO | YES | NO | YES |
| Sebacic acid | YES | NO | NO | NO | NO | NO | NO | NO |
| Hydroxy-L-Proline | YES | NO | YES | NO | NO | YES | NO | NO |
| Putrescine | YES | NO | NO | NO | NO | YES | NO | NO |
| Inulin | YES | YES | YES | YES | YES | NO | NO | NO |
| 2-Deoxy-D-Ribose | NO | NO | YES | NO | NO | NO | NO | YES |
| β-Methyl-D-Glucuronic acid | NO | NO | YES | NO | NO | NO | NO | NO |
| N-Acetyl-D-glucosaminitol | NO | NO | NO | NO | NO | NO | NO | NO |
| γ-Hydroxy butyric acid | YES | NO | NO | NO | NO | NO | NO | NO |
| Sorbic acid | NO | NO | NO | NO | NO | NO | NO | NO |
| L-Isoleucine | YES | NO | YES | YES | NO | NO | NO | YES |
| Dihydroxy acetone | NO | NO | YES | NO | NO | YES | NO | YES |
| Laminarin | NO | YES | YES | NO | NO | NO | NO | NO |
| i-Erythritol | NO | NO | NO | NO | NO | NO | NO | NO |

TABLE N-continued

Substrate utilization as determined by BIOLOG PM2A MicroPlates by bacterial endophytes belonging to core OTUs.

| | | | | | | | | |
|---|---|---|---|---|---|---|---|---|
| a-Methyl-D-Mannoside | NO | NO | NO | NO | NO | NO | NO | NO |
| γ-amino butyric acid | YES | NO | NO | YES | YES | NO | NO | NO |
| a-Keto-valeric acid | YES | NO | NO | NO | NO | NO | NO | NO |
| Succinamic acid | NO | NO | NO | NO | NO | NO | NO | NO |
| L-Leucine | NO | NO | YES | YES | NO | NO | NO | NO |
| 2,3-Butanediol | YES | NO | NO | NO | NO | NO | NO | NO |
| Mannan | NO | NO | NO | NO | NO | NO | NO | NO |
| D-Fucose | NO | NO | NO | NO | NO | NO | NO | NO |
| β-Methyl-D-Xyloside | NO | YES | YES | NO | NO | NO | NO | NO |
| d-amino valeric acid | YES | NO | NO | NO | NO | NO | NO | NO |
| Itaconic acid | YES | NO | YES | NO | NO | YES | NO | YES |
| D-Tartaric acid | NO | NO | NO | NO | NO | NO | NO | NO |
| L-Lysine | YES | NO | NO | NO | NO | NO | NO | NO |
| 2,3-Butanone | NO | NO | NO | NO | NO | NO | NO | NO |
| Pectin | NO | YES | YES | NO | NO | NO | NO | YES |
| 3-0-β-D-Galactopyranosyl-D-arabinose | NO | NO | YES | NO | NO | NO | NO | NO |
| Palatinose | NO | YES | YES | NO | NO | NO | NO | NO |
| Butyric acid | YES | NO | NO | YES | NO | NO | NO | NO |
| 5-Keto-D-Gluconic acid | NO | NO | NO | NO | YES | NO | NO | YES |
| L-Tartaric acid | NO | NO | NO | NO | YES | NO | NO | YES |
| L-Methionine | NO | NO | NO | NO | NO | NO | NO | NO |
| 3-Hydroxy 2-Butanone | NO | NO | NO | NO | NO | NO | NO | NO |

| | Strain/Substrate | | | | | | | |
|---|---|---|---|---|---|---|---|---|
| | SYM00525 | SYM00053 | SYM00538A | SYM00538B | SYM00538i | SYM00543 | SYM00563 | SYM00574 |
| N-acetyl-D-Galactosamine | NO | YES | NO | NO | NO | NO | NO | NO |
| Gentiobiose | YES | YES | NO | YES | YES | NO | YES | NO |
| D-Raffinose | NO | YES | NO | YES | NO | NO | NO | NO |
| Capric acid | NO | NO | NO | NO | NO | NO | NO | NO |
| D-laclic acid methyl ester | NO | YES | NO | NO | NO | NO | NO | NO |
| Acetamide | NO | NO | NO | NO | NO | NO | NO | YES |
| L-Ornithine | NO | NO | NO | NO | NO | NO | NO | NO |
| Chondrointin sulfate C | NO | NO | NO | NO | NO | NO | NO | NO |
| N-acetyl-neuraminic acid | NO | NO | NO | NO | NO | NO | NO | NO |
| L-glucose | NO | NO | NO | NO | NO | NO | NO | NO |
| Salicin | YES | YES | NO | YES | YES | NO | YES | NO |
| Caproic acid | NO | NO | NO | NO | NO | NO | NO | NO |
| Malonic acid | YES | NO | NO | NO | NO | NO | NO | NO |
| L-Alaninamide | YES | NO | YES | NO | YES | NO | NO | YES |
| L-Phenylalanine | NO | NO | NO | NO | NO | NO | NO | YES |
| a-Cyclodextrin | NO | NO | YES | NO | NO | YES | NO | NO |
| β-D-allose | NO | NO | NO | NO | NO | NO | NO | NO |
| Lactitol | YES | NO | NO | YES | NO | NO | NO | NO |
| Sedoheptulosan | NO | NO | NO | NO | NO | NO | NO | NO |
| Citraconic acid | NO | NO | NO | NO | NO | NO | NO | YES |
| Melibionic acid | NO | YES | NO | NO | NO | NO | NO | NO |
| N-Acetyl-L-Glutamic acid | NO | YES | NO | NO | YES | NO | NO | NO |
| L-Pyroglutamic acid | YES | NO | YES | NO | YES | YES | NO | YES |
| β-Cyclodextrin | NO | NO | YES | YES | NO | NO | NO | NO |
| Amygdalin | YES | NO | NO | YES | YES | NO | YES | NO |
| D-Melezitose | YES | NO | NO | YES | NO | NO | NO | NO |
| L-Sorbose | NO | NO | NO | NO | NO | NO | NO | NO |
| Citramalic acid | NO | NO | NO | NO | NO | NO | NO | NO |
| Oxalic acid | NO | NO | NO | NO | NO | NO | NO | NO |
| L-Arginine | NO | NO | NO | NO | NO | YES | NO | YES |
| L-Valine | NO | NO | NO | NO | NO | NO | NO | NO |
| γ-Cyclodextrin | NO | NO | YES | YES | NO | NO | NO | NO |
| D-arabinose | NO | NO | NO | NO | NO | NO | NO | YES |
| Maltitol | YES | NO | NO | YES | NO | NO | NO | NO |
| Stachyose | YES | NO | NO | YES | NO | NO | NO | NO |
| D-Glucosamine | YES | YES | YES | YES | YES | YES | YES | YES |
| Oxalomalic acid | YES | NO | YES | YES | YES | YES | YES | YES |
| Glycine | NO | NO | NO | NO | NO | NO | NO | NO |
| D,L-Carnitine | NO | NO | NO | NO | NO | NO | NO | YES |
| Dextrin | YES | NO | YES | YES | NO | YES | NO | NO |
| D-arabitol | NO | NO | NO | NO | NO | NO | NO | NO |
| a-Methyl-D-Glucoside | NO | NO | NO | YES | NO | NO | NO | NO |
| D-Tagatose | NO | NO | NO | NO | NO | NO | NO | NO |
| 2-Hydroxy benzoic acid | NO | NO | NO | NO | NO | NO | NO | NO |
| Quinic acid | NO | NO | NO | NO | NO | NO | NO | NO |
| L-Histidine | NO | NO | NO | NO | NO | YES | NO | YES |
| Sec-Butylamine | NO | NO | NO | NO | NO | NO | NO | NO |
| Gelatin | NO | NO | YES | NO | YES | YES | NO | NO |
| L-arabitol | NO | NO | NO | NO | NO | NO | NO | NO |

TABLE N-continued

| Substrate utilization as determined by BIOLOG PM2A MicroPlates by bacterial endophytes belonging to core OTUs. | | | | | | | | |
|---|---|---|---|---|---|---|---|---|
| β-Methyl-D-Galactoside | YES | NO | NO | YES | NO | NO | NO | YES |
| Turanose | YES | NO | NO | YES | NO | NO | NO | NO |
| 4-Hydroxy benzoic acid | NO | NO | NO | NO | NO | NO | NO | YES |
| D-Ribono-1,4-Lactone | NO | NO | NO | NO | NO | NO | NO | YES |
| L-Homoserine | NO | NO | NO | NO | NO | NO | NO | YES |
| D,L-Octopamine | NO | NO | NO | NO | NO | NO | NO | NO |
| Glycogen | NO | NO | NO | YES | NO | YES | NO | NO |
| Arbutin | YES | YES | YES | NO | YES | NO | YES | NO |
| 3-Methyl Glucose | NO | NO | NO | NO | NO | NO | NO | NO |
| Xylitol | YES | NO | NO | NO | NO | NO | NO | YES |
| β-Hydroxy butyric acid | NO | YES | NO | NO | NO | NO | NO | YES |
| Sebacic acid | NO | NO | NO | NO | NO | NO | NO | YES |
| Hydroxy-L-Proline | YES | YES | NO | NO | NO | YES | NO | YES |
| Putrescine | NO | YES | NO | NO | NO | NO | NO | NO |
| Inulin | NO | NO | YES | YES | YES | NO | NO | YES |
| 2-Deoxy-D-Ribose | NO | NO | NO | NO | NO | NO | NO | NO |
| β-Methyl-D-Glucuronic acid | YES | NO | NO | NO | NO | NO | NO | NO |
| N-Acetyl-D-glucosaminitol | NO | NO | NO | NO | NO | NO | NO | NO |
| γ-Hydroxy butyric acid | NO | NO | NO | NO | NO | NO | NO | NO |
| Sorbic acid | NO | NO | NO | NO | NO | NO | NO | NO |
| L-Isoleucine | NO | NO | NO | NO | NO | NO | NO | NO |
| Dihydroxy acetone | NO | YES | NO | NO | NO | NO | NO | YES |
| Laminarin | NO | NO | NO | YES | NO | NO | NO | YES |
| i-Erythritol | NO | NO | NO | NO | NO | NO | NO | NO |
| a-Methyl-D-Mannoside | YES | NO | NO | NO | NO | NO | NO | NO |
| γ-amino butyric acid | NO | NO | NO | NO | NO | NO | NO | YES |
| a-Keto-valeric acid | NO | NO | NO | NO | NO | NO | NO | NO |
| Succinamic acid | NO | NO | NO | NO | NO | NO | NO | NO |
| L-Leucine | NO | NO | NO | NO | NO | NO | NO | NO |
| 2,3-Butanediol | NO | NO | NO | YES | NO | NO | NO | NO |
| Mannan | NO | NO | NO | NO | NO | NO | NO | NO |
| D-Fucose | NO | NO | NO | NO | NO | NO | NO | NO |
| β-Methyl-D-Xyloside | NO | NO | NO | YES | NO | NO | NO | NO |
| d-amino valeric acid | NO | NO | NO | NO | NO | NO | NO | NO |
| Itaconic acid | NO | YES | NO | NO | NO | NO | NO | NO |
| D-Tartaric acid | NO | NO | NO | NO | NO | NO | NO | YES |
| L-Lysine | NO | NO | NO | NO | NO | NO | NO | NO |
| 2,3-Butanone | NO | NO | NO | NO | NO | NO | NO | NO |
| Pectin | NO | NO | NO | YES | NO | NO | NO | NO |
| 3-0-β-D-Galactopyranosyl-D-arabinose | NO | NO | NO | YES | NO | NO | NO | NO |
| Palatinose | YES | NO | NO | YES | NO | NO | NO | NO |
| Butyric acid | NO | NO | NO | NO | NO | NO | NO | NO |
| 5-Keto-D-Gluconic acid | NO | NO | NO | NO | NO | NO | NO | YES |
| L-Tartaric acid | NO | NO | NO | NO | NO | NO | NO | YES |
| L-Methionine | NO | NO | NO | NO | NO | NO | NO | NO |
| 3-Hydroxy 2-Butanone | NO | NO | NO | NO | NO | NO | NO | NO |

TABLE O

Substrate utilization as determined by BIOLOG PM2A MicroPlates by bacterial endophytes belonging to core OTUs.

| | Strain/Substrate | | | | | | |
|---|---|---|---|---|---|---|---|
| | SYM00057B | SYM00617 | SYM00620 | SYM00627 | SYM00628 | SYM00062C | SYM00650 |
| N-acetyl-D-Galactosamine | NO | NO | NO | NO | YES | NO | NO |
| Gentiobiose | NO | YES | YES | YES | YES | YES | NO |
| D-Raffinose | NO | NO | YES | YES | YES | YES | NO |
| Capric acid | NO | NO | NO | NO | NO | NO | NO |
| D-lactic acid methyl ester | NO | NO | NO | NO | NO | NO | NO |
| Acetamide | NO | NO | NO | NO | NO | NO | NO |
| L-Ornithine | NO | NO | NO | NO | NO | NO | NO |
| Chondrointin sulfate C | NO | NO | NO | NO | NO | NO | NO |
| N-acetyl-neuraminic acid | NO | NO | YES | NO | NO | NO | NO |
| L-glucose | NO | NO | NO | NO | NO | NO | NO |
| Salicin | NO | YES | NO | YES | YES | YES | NO |
| Caproic acid | NO | NO | NO | NO | NO | NO | NO |
| Malonic acid | NO | NO | NO | NO | NO | NO | NO |
| L-Alaninamide | NO | NO | NO | NO | NO | NO | NO |
| L-Phenylalanine | NO | NO | NO | NO | NO | NO | NO |
| a-Cyclodextrin | NO | NO | NO | NO | NO | NO | NO |
| β-D-allose | NO | NO | NO | NO | NO | NO | NO |

TABLE O-continued

Substrate utilization as determined by BIOLOG PM2A MicroPlates by bacterial endophytes belonging to core OTUs.

| | | | | | | | |
|---|---|---|---|---|---|---|---|
| Lactitol | NO | NO | NO | NO | NO | YES | NO |
| Sedoheptulosan | NO | NO | NO | NO | NO | NO | NO |
| Citraconic acid | NO | NO | NO | NO | NO | NO | NO |
| Melibionic acid | NO | NO | YES | YES | YES | NO | NO |
| N-Acetyl-L-Glutamic acid | NO | NO | NO | NO | NO | YES | NO |
| L-Pyroglutamic acid | NO | NO | NO | NO | NO | YES | NO |
| β-Cyclodextrin | NO | NO | NO | NO | NO | NO | NO |
| Amygdalin | NO | YES | NO | NO | NO | YES | NO |
| D-Melezitose | NO | YES | NO | NO | NO | YES | NO |
| L-Sorbose | NO | NO | NO | NO | NO | NO | NO |
| Citramalic acid | NO | NO | NO | NO | NO | NO | NO |
| Oxalic acid | NO | NO | NO | NO | NO | NO | NO |
| L-Arginine | NO | NO | NO | NO | NO | NO | NO |
| L-Valine | NO | NO | NO | NO | NO | NO | NO |
| γ-Cyclodextrin | NO | NO | NO | NO | NO | NO | NO |
| D-arabinose | NO | NO | NO | NO | YES | NO | YES |
| Maltitol | NO | NO | NO | YES | YES | NO | NO |
| Stachyose | NO | NO | NO | NO | NO | YES | NO |
| D-Glucosamine | YES | YES | NO | YES | YES | YES | NO |
| Oxalomalic acid | YES | YES | NO | NO | NO | YES | NO |
| Glycine | NO | NO | NO | NO | NO | NO | NO |
| D,L-Carnitine | NO | NO | NO | NO | NO | NO | NO |
| Dextrin | NO | YES | YES | NO | NO | YES | NO |
| D-arabitol | NO | NO | NO | NO | NO | NO | NO |
| a-Methyl-D-Glucoside | NO | NO | NO | YES | YES | NO | NO |
| D-Tagatose | NO | NO | NO | NO | NO | NO | NO |
| 2-Hydroxy benzoic acid | NO | NO | NO | NO | NO | NO | NO |
| Quinic acid | NO | NO | NO | NO | NO | NO | NO |
| L-Histidine | YES | NO | YES | NO | NO | NO | YES |
| Sec-Butylamine | NO | NO | NO | NO | NO | NO | NO |
| Gelatin | NO | NO | NO | NO | NO | NO | NO |
| L-arabitol | NO | NO | NO | NO | NO | NO | NO |
| β-Methyl-D-Galactoside | NO | NO | YES | YES | YES | YES | NO |
| Turanose | NO | NO | NO | YES | NO | YES | NO |
| 4-Hydroxy benzoic acid | NO | NO | NO | NO | NO | NO | NO |
| D-Ribono-1,4-Lactone | NO | NO | NO | NO | NO | NO | NO |
| L-Homoserine | YES | NO | NO | NO | NO | NO | NO |
| D,L-Octopamine | NO | YES | NO | NO | NO | YES | NO |
| Glycogen | NO | NO | NO | NO | NO | NO | NO |
| Arbutin | NO | YES | NO | YES | YES | YES | NO |
| 3-Methyl Glucose | NO | NO | NO | NO | YES | NO | NO |
| Xylitol | YES | NO | NO | NO | NO | NO | NO |
| β-Hydroxy butyric acid | NO | NO | NO | NO | NO | NO | NO |
| Sebacic acid | YES | NO | NO | NO | NO | NO | NO |
| Hydroxy-L-Proline | NO | NO | NO | NO | NO | NO | YES |
| Putrescine | NO | NO | NO | NO | YES | NO | NO |
| Inulin | YES | NO | NO | NO | NO | YES | NO |
| 2-Deoxy-D-Ribose | NO | NO | YES | NO | NO | NO | YES |
| β-Methyl-D-Glucuronic acid | NO | NO | NO | NO | NO | NO | NO |
| N-Acetyl-D-glucosaminitol | NO | NO | NO | NO | NO | NO | NO |
| γ-Hydroxy butyric acid | NO | NO | NO | NO | NO | NO | NO |
| Sorbic acid | NO | NO | NO | NO | NO | NO | NO |
| L-Isoleucine | NO | NO | NO | NO | NO | YES | NO |
| Dihydroxy acetone | YES | NO | NO | YES | YES | NO | YES |
| Laminarin | NO | NO | NO | NO | NO | NO | NO |
| i-Erythritol | NO | NO | NO | NO | NO | NO | NO |
| a-Methyl-D-Mannoside | NO | NO | NO | NO | NO | NO | NO |
| γ-amino butyric acid | YES | NO | NO | NO | NO | NO | YES |
| a-Keto-valeric acid | NO | NO | NO | NO | NO | NO | NO |
| Succinamic acid | NO | NO | NO | NO | NO | NO | NO |
| L-Leucine | YES | NO | NO | NO | NO | NO | NO |
| 2,3-Butanediol | NO | NO | NO | NO | NO | YES | NO |
| Mannan | NO | NO | NO | NO | NO | NO | NO |
| D-Fucose | NO | NO | NO | NO | NO | NO | NO |
| β-Methyl-D-Xyloside | NO | NO | NO | NO | NO | YES | NO |
| d-amino valeric acid | NO | NO | NO | NO | NO | NO | NO |
| Itaconic acid | NO | NO | NO | NO | NO | NO | NO |
| D-Tartaric acid | YES | NO | NO | NO | NO | NO | NO |
| L-Lysine | NO | NO | NO | NO | NO | NO | NO |
| 2,3-Butanone | NO | NO | NO | NO | NO | NO | NO |
| Pectin | NO | NO | NO | NO | NO | NO | NO |
| 3-0-β-D-Galactopyranosyl-D-arabinose | NO | NO | NO | NO | YES | NO | NO |
| Palatinose | NO | NO | NO | YES | YES | YES | NO |
| Butyric acid | NO | NO | NO | NO | NO | NO | NO |
| 5-Keto-D-Gluconic acid | NO | NO | NO | NO | NO | NO | NO |
| L-Tartaric acid | NO | NO | NO | NO | NO | NO | NO |

TABLE O-continued

Substrate utilization as determined by BIOLOG PM2A MicroPlates by bacterial endophytes belonging to core OTUs.

| | | | | | | | |
|---|---|---|---|---|---|---|---|
| L-Methionine | NO | NO | NO | NO | NO | NO | NO |
| 3-Hydroxy 2-Butanone | NO | NO | NO | NO | NO | NO | NO |
| | Strain/Substrate | | | | | | |
| | SYM00068 | SYM00070 | SYM00714 | SYM00009 | SYM00905 | SYM00924 | SYM00963 |
| N-acetyl-D-Galactosamine | NO | NO | YES | NO | YES | NO | NO |
| Gentiobiose | NO | NO | YES | NO | YES | NO | NO |
| D-Raffinose | NO | NO | YES | NO | NO | NO | NO |
| Capric acid | NO | NO | NO | NO | NO | NO | NO |
| D-lactic acid methyl ester | NO | NO | NO | NO | NO | NO | NO |
| Acetamide | YES | NO | NO | NO | NO | NO | NO |
| L-Ornithine | YES | YES | NO | YES | NO | NO | NO |
| Chondrointin sulfate C | NO | NO | NO | NO | NO | NO | NO |
| N-acetyl-neuraminic acid | NO | NO | NO | NO | NO | NO | NO |
| L-glucose | NO | NO | NO | NO | NO | NO | NO |
| Salicin | NO | NO | YES | NO | YES | NO | NO |
| Caproic acid | NO | NO | NO | NO | NO | NO | NO |
| Malonic acid | NO | NO | NO | NO | NO | NO | NO |
| L-Alaninamide | NO | NO | YES | NO | YES | YES | NO |
| L-Phenylalanine | YES | NO | NO | YES | NO | NO | NO |
| a-Cyclodextrin | NO | NO | NO | NO | NO | NO | NO |
| β-D-allose | NO | NO | YES | NO | NO | NO | NO |
| Lactitol | NO | NO | YES | NO | YES | NO | NO |
| Sedoheptulosan | NO | NO | NO | NO | NO | NO | NO |
| Citraconic acid | YES | NO | NO | YES | NO | YES | NO |
| Melibionic acid | YES | NO | YES | NO | NO | NO | NO |
| N-Acetyl-L-Glutamic acid | NO | NO | NO | NO | NO | NO | NO |
| L-Pyroglutamic acid | YES | YES | YES | YES | NO | NO | NO |
| β-Cyclodextrin | NO | NO | NO | NO | NO | NO | NO |
| Amygdalin | NO | NO | NO | NO | NO | NO | NO |
| D-Melezitose | NO | NO | YES | NO | NO | NO | YES |
| L-Sorbose | NO | NO | NO | NO | NO | NO | YES |
| Citramalic acid | NO | NO | NO | NO | NO | NO | NO |
| Oxalic acid | NO | NO | NO | NO | NO | NO | NO |
| L-Arginine | NO | NO | YES | NO | NO | NO | NO |
| L-Valine | YES | YES | YES | YES | NO | NO | NO |
| γ-Cyclodextrin | NO | NO | NO | NO | NO | NO | NO |
| D-arabinose | NO | NO | YES | NO | NO | YES | YES |
| Maltitol | NO | NO | YES | NO | YES | NO | YES |
| Stachyose | NO | NO | NO | NO | NO | NO | YES |
| D-Glucosamine | YES | YES | YES | YES | YES | NO | NO |
| Oxalomalic acid | YES | YES | YES | YES | YES | NO | NO |
| Glycine | NO | NO | NO | NO | NO | NO | NO |
| D,L-Carnitine | NO | YES | NO | YES | NO | NO | NO |
| Dextrin | NO | NO | NO | NO | NO | NO | NO |
| D-arabitol | NO | NO | NO | NO | NO | NO | NO |
| a-Methyl-D-Glucoside | NO | NO | YES | NO | NO | NO | YES |
| D-Tagatose | NO | NO | NO | NO | NO | NO | NO |
| 2-Hydroxy benzoic acid | NO | NO | NO | NO | NO | NO | NO |
| Quinic acid | NO | NO | NO | NO | NO | NO | NO |
| L-Histidine | NO | YES | YES | NO | NO | NO | NO |
| Sec-Butylamine | NO | NO | NO | NO | NO | NO | NO |
| Gelatin | NO | NO | NO | NO | YES | NO | NO |
| L-arabitol | NO | NO | NO | NO | NO | NO | NO |
| β-Methyl-D-Galactoside | NO | NO | YES | NO | NO | NO | YES |
| Turanose | NO | NO | YES | NO | NO | NO | YES |
| 4-Hydroxy benzoic acid | NO | NO | NO | NO | NO | NO | NO |
| D-Ribono-1,4-Lactone | NO | NO | YES | NO | NO | NO | NO |
| L-Homoserine | NO | NO | NO | NO | NO | NO | NO |
| D,L-Octopamine | YES | YES | NO | YES | YES | NO | YES |
| Glycogen | NO | NO | NO | NO | NO | NO | NO |
| Arbutin | NO | YES | YES | NO | YES | NO | NO |
| 3-Methyl Glucose | NO | NO | NO | NO | NO | NO | NO |
| Xylitol | NO | YES | YES | YES | NO | NO | NO |
| β-Hydroxy butyric acid | NO | NO | NO | NO | NO | NO | NO |
| Sebacic acid | NO | NO | NO | NO | NO | NO | NO |
| Hydroxy-L-Proline | NO | NO | NO | NO | NO | NO | NO |
| Putrescine | NO | YES | NO | NO | NO | NO | NO |
| Inulin | NO | NO | NO | NO | NO | NO | NO |
| 2-Deoxy-D-Ribose | NO | NO | NO | NO | NO | YES | NO |
| β-Methyl-D-Glucuronic acid | NO | NO | NO | NO | NO | NO | NO |
| N-Acetyl-D-glucosaminitol | NO | NO | NO | NO | NO | NO | NO |
| γ-Hydroxy butyric acid | NO | NO | NO | NO | NO | YES | NO |
| Sorbic acid | NO | NO | NO | NO | NO | NO | NO |
| L-Isoleucine | YES | YES | YES | YES | NO | NO | NO |

TABLE O-continued

Substrate utilization as determined by BIOLOG PM2A MicroPlates by bacterial endophytes belonging to core OTUs.

| | | | | | | | |
|---|---|---|---|---|---|---|---|
| Dihydroxy acetone | NO | NO | NO | NO | NO | YES | YES |
| Laminarin | NO | NO | NO | NO | NO | NO | NO |
| i-Erythritol | NO | NO | NO | NO | NO | NO | NO |
| a-Methyl-D-Mannoside | NO | NO | NO | NO | NO | NO | NO |
| γ-amino butyric acid | NO | YES | YES | NO | NO | NO | NO |
| a-Keto-valeric acid | NO | NO | NO | NO | NO | NO | NO |
| Succinamic acid | NO | NO | NO | NO | NO | YES | NO |
| L-Leucine | NO | NO | YES | YES | NO | NO | NO |
| 2,3-Butanediol | NO | NO | NO | NO | NO | NO | NO |
| Mannan | NO | NO | NO | NO | NO | NO | NO |
| D-Fucose | NO | NO | YES | NO | NO | NO | NO |
| β-Methyl-D-Xyloside | NO | NO | YES | NO | NO | NO | NO |
| d-amino valeric acid | NO | NO | NO | NO | NO | NO | NO |
| Itaconic acid | NO | NO | NO | NO | NO | NO | NO |
| D-Tartaric acid | NO | NO | NO | NO | NO | NO | NO |
| L-Lysine | NO | NO | NO | NO | NO | NO | NO |
| 2,3-Butanone | NO | NO | NO | NO | NO | NO | NO |
| Pectin | NO | NO | NO | NO | NO | NO | NO |
| 3-0-β-D-Galactopyranosyl-D-arabinose | NO | NO | NO | NO | NO | NO | NO |
| Palatinose | NO | NO | YES | NO | YES | NO | YES |
| Butyric acid | NO | NO | NO | NO | NO | NO | NO |
| 5-Keto-D-Gluconic acid | NO | NO | NO | NO | NO | NO | NO |
| L-Tartaric acid | NO | YES | NO | YES | NO | NO | NO |
| L-Methionine | NO | NO | NO | NO | NO | NO | NO |
| 3-Hydroxy 2-Butanone | NO | NO | NO | NO | NO | NO | NO |

| | Strain/Substrate | | | | |
|---|---|---|---|---|---|
| | SYM00978 | SYM00982 | SYM00987 | SYM00991 | SYM00999 |
| N-acetyl-D-Galactosamine | NO | NO | NO | YES | NO |
| Gentiobiose | NO | NO | NO | NO | NO |
| D-Raffinose | NO | NO | NO | YES | NO |
| Capric acid | NO | NO | NO | NO | NO |
| D-lactic acid methyl ester | NO | NO | NO | NO | NO |
| Acetamide | NO | NO | NO | NO | NO |
| L-Ornithine | NO | NO | NO | NO | NO |
| Chondrointin sulfate C | NO | NO | NO | NO | NO |
| N-acetyl-neuraminic acid | NO | NO | NO | NO | NO |
| L-glucose | NO | NO | NO | NO | NO |
| Salicin | NO | NO | NO | YES | NO |
| Caproic acid | NO | NO | NO | NO | NO |
| Malonic acid | NO | NO | NO | NO | NO |
| L-Alaninamide | NO | NO | NO | NO | NO |
| L-Phenylalanine | NO | NO | NO | NO | NO |
| a-Cyclodextrin | NO | YES | NO | NO | NO |
| β-D-allose | NO | NO | NO | NO | NO |
| Lactitol | NO | NO | NO | NO | NO |
| Sedoheptulosan | NO | NO | NO | NO | NO |
| Citraconic acid | NO | NO | NO | NO | NO |
| Melibionic acid | YES | NO | NO | NO | NO |
| N-Acetyl-L-Glutamic acid | NO | NO | YES | NO | NO |
| L-Pyroglutamic acid | NO | YES | YES | NO | NO |
| β-Cyclodextrin | NO | YES | NO | NO | NO |
| Amygdalin | NO | NO | NO | YES | NO |
| D-Melezitose | NO | NO | YES | NO | NO |
| L-Sorbose | NO | NO | YES | NO | NO |
| Citramalic acid | NO | NO | NO | NO | NO |
| Oxalic acid | NO | NO | NO | NO | NO |
| L-Arginine | NO | NO | NO | NO | NO |
| L-Valine | NO | NO | NO | NO | NO |
| γ-Cyclodextrin | NO | NO | NO | NO | NO |
| D-arabinose | NO | NO | NO | NO | NO |
| Maltitol | NO | NO | NO | NO | NO |
| Stachyose | NO | NO | NO | NO | NO |
| D-Glucosamine | YES | NO | YES | YES | YES |
| Oxalomalic acid | YES | NO | YES | NO | YES |
| Glycine | NO | NO | NO | NO | NO |
| D,L-Carnitine | NO | NO | NO | NO | NO |
| Dextrin | NO | NO | NO | YES | NO |
| D-arabitol | NO | NO | NO | NO | NO |
| a-Methyl-D-Glucoside | NO | NO | NO | NO | NO |
| D-Tagatose | NO | NO | NO | NO | NO |
| 2-Hydroxy benzoic acid | NO | NO | NO | NO | NO |
| Quinic acid | NO | NO | NO | NO | NO |
| L-Histidine | NO | NO | NO | NO | NO |

TABLE O-continued

Substrate utilization as determined by BIOLOG PM2A MicroPlates by bacterial endophytes belonging to core OTUs.

| | | | | | |
|---|---|---|---|---|---|
| Sec-Butylamine | NO | NO | NO | NO | NO |
| Gelatin | NO | YES | NO | NO | NO |
| L-arabitol | NO | NO | NO | NO | NO |
| β-Methyl-D-Galactoside | YES | NO | YES | NO | NO |
| Turanose | NO | NO | YES | NO | NO |
| 4-Hydroxy benzoic acid | NO | NO | NO | NO | NO |
| D-Ribono-1,4-Lactone | NO | NO | NO | NO | NO |
| L-Homoserine | NO | NO | NO | NO | NO |
| D,L-Octopamine | NO | NO | YES | YES | NO |
| Glycogen | NO | NO | NO | NO | NO |
| Arbutin | YES | NO | NO | YES | NO |
| 3-Methyl Glucose | NO | NO | NO | NO | NO |
| Xylitol | NO | NO | NO | NO | NO |
| β-Hydroxy butyric acid | NO | NO | NO | NO | NO |
| Sebacic acid | YES | NO | NO | NO | NO |
| Hydroxy-L-Proline | NO | NO | YES | YES | YES |
| Putrescine | NO | NO | NO | NO | NO |
| Inulin | NO | NO | YES | NO | YES |
| 2-Deoxy-D-Ribose | NO | NO | NO | NO | NO |
| β-Methyl-D-Glucuronic acid | NO | NO | NO | NO | NO |
| N-Acetyl-D-glucosaminitol | NO | NO | NO | NO | NO |
| γ-Hydroxy butyric acid | NO | NO | NO | NO | NO |
| Sorbic acid | NO | NO | NO | NO | NO |
| L-Isoleucine | NO | NO | NO | NO | NO |
| Dihydroxy acetone | NO | NO | YES | NO | NO |
| Laminarin | NO | YES | NO | NO | NO |
| i-Erythritol | NO | NO | NO | NO | NO |
| a-Methyl-D-Mannoside | NO | NO | NO | NO | NO |
| γ-amino butyric acid | NO | NO | NO | NO | NO |
| a-Keto-valeric acid | NO | NO | NO | NO | NO |
| Succinamic acid | NO | NO | NO | NO | NO |
| L-Leucine | NO | NO | NO | NO | NO |
| 2,3-Butanediol | NO | NO | NO | NO | NO |
| Mannan | NO | NO | NO | NO | NO |
| D-Fucose | NO | NO | NO | NO | NO |
| β-Methyl-D-Xyloside | NO | NO | NO | NO | NO |
| d-amino valeric acid | NO | NO | NO | NO | NO |
| Itaconic acid | NO | NO | NO | YES | NO |
| D-Tartaric acid | NO | NO | NO | NO | NO |
| L-Lysine | NO | NO | NO | NO | NO |
| 2,3-Butanone | NO | NO | NO | NO | NO |
| Pectin | NO | NO | NO | YES | NO |
| 3-0-β-D-Galactopyranosyl-D-arabinose | NO | NO | YES | NO | NO |
| Palatinose | YES | NO | YES | NO | NO |
| Butyric acid | NO | NO | NO | NO | NO |
| 5-Keto-D-Gluconic acid | NO | NO | NO | NO | NO |
| L-Tartaric acid | NO | NO | NO | NO | NO |
| L-Methionine | NO | NO | NO | NO | NO |
| 3-Hydroxy 2-Butanone | NO | NO | NO | NO | NO |

TABLE P

Substrate utilization as determined by BIOLOG PM1 MicroPlates by fungal endophytes belonging to core OTUs.

| Strain/Substrate | SYM00120 | SYM00122 | SYM00123 | SYM00124 | SYM00129 | SYM01300 |
|---|---|---|---|---|---|---|
| D-Serine | NO | NO | YES | YES | NO | NO |
| D-Glucose-6-Phosphate | NO | NO | NO | YES | YES | NO |
| L-Asparagine | NO | NO | NO | YES | NO | YES |
| L-glutamine | NO | NO | NO | YES | YES | YES |
| Glycyl-L-Aspartic acid | NO | NO | NO | NO | NO | YES |
| Glycyl-L-Glutamic acid | NO | NO | NO | YES | NO | YES |
| Glycyl-L-Proline | NO | NO | NO | YES | NO | YES |
| L-Arabinose | YES | NO | NO | NO | YES | NO |
| D-Sorbitol | NO | NO | YES | YES | YES | YES |
| D-Galactonic acid-?-lactone | NO | NO | NO | NO | NO | YES |
| D-Aspartic acid | NO | NO | YES | YES | NO | NO |
| m-Tartaric acid | NO | NO | NO | YES | NO | YES |
| Citric acid | NO | NO | NO | YES | NO | YES |
| Tricarballylic acid | NO | NO | NO | YES | NO | YES |
| p-Hydroxy Phenyl acetic acid | NO | NO | NO | YES | NO | NO |
| N-Acetyl-D-Glucosamine | NO | NO | YES | YES | YES | YES |

TABLE P-continued

Substrate utilization as determined by BIOLOG PM1 MicroPlates by fungal endophytes belonging to core OTUs.

| | | | | | | |
|---|---|---|---|---|---|---|
| Glycerol | YES | NO | NO | YES | YES | YES |
| D-L-Malic acid | NO | NO | NO | YES | NO | YES |
| D-Glucosaminic acid | NO | NO | NO | YES | NO | YES |
| D-Glucose-1-Phosphate | NO | NO | YES | YES | NO | YES |
| m-Inositol | NO | NO | NO | YES | NO | YES |
| L-Serine | NO | NO | NO | YES | NO | YES |
| m-Hydroxy Phenyl Acetic acid | NO | NO | NO | YES | NO | YES |
| D-Saccharic acid | NO | NO | NO | YES | NO | YES |
| L-Fucose | NO | NO | NO | YES | NO | YES |
| D-Ribose | NO | NO | YES | YES | YES | YES |
| 1,2-Propanediol | NO | NO | NO | YES | NO | NO |
| D-Fructose-6-Phosphate | NO | NO | NO | NO | NO | NO |
| D-Threonine | NO | NO | YES | YES | NO | NO |
| L-Threonine | NO | YES | NO | YES | NO | YES |
| Tyramine | YES | NO | NO | YES | NO | YES |
| Succinic acid | NO | NO | NO | YES | NO | YES |
| D-Glucuronic acid | NO | NO | YES | YES | YES | YES |
| Tween 20 | NO | NO | NO | YES | YES | YES |
| Tween 40 | NO | NO | YES | YES | YES | YES |
| Tween 80 | NO | NO | YES | NO | YES | YES |
| Fumaric acid | NO | NO | YES | NO | NO | YES |
| L-Alanine | NO | NO | NO | YES | NO | YES |
| D-Psicose | NO | NO | NO | YES | NO | NO |
| D-Galactose | YES | NO | YES | YES | NO | YES |
| D-Gluconic acid | NO | NO | NO | YES | YES | YES |
| L-Rhamnose | NO | NO | NO | YES | YES | YES |
| a-Keto-Glutaric acid | NO | NO | NO | YES | NO | YES |
| a-Hydroxy Glutaric acid-?-lactone | NO | NO | YES | YES | NO | YES |
| Bromo succinic acid | NO | NO | YES | YES | NO | YES |
| L-Alanyl-Glycine | NO | NO | YES | YES | NO | YES |
| L-Lyxose | NO | NO | NO | YES | NO | NO |
| L-Aspartic acid | NO | NO | YES | YES | NO | YES |
| D-L-a-Glycerol phosphate | NO | NO | NO | YES | NO | NO |
| D-Fructose | NO | NO | NO | YES | YES | YES |
| a-Keto-Butyric acid | NO | NO | NO | YES | NO | NO |
| a-Hydroxy Butyric acid | NO | NO | NO | YES | NO | NO |
| Propionic acid | NO | NO | YES | YES | NO | YES |
| Acetoacetic acid | NO | NO | NO | YES | NO | NO |
| Glucuronamide | NO | NO | NO | NO | NO | NO |
| L-Proline | NO | NO | NO | YES | NO | YES |
| D-Xylose | YES | NO | NO | YES | YES | YES |
| Acetic acid | NO | NO | YES | YES | NO | NO |
| a-Methyl-D-Galactoside | NO | NO | NO | YES | YES | NO |
| β-Methyl-D-glucoside | NO | NO | YES | YES | YES | YES |
| Mucic acid | NO | NO | NO | YES | YES | YES |
| N-acetyl-β-D-Mannosamine | NO | NO | YES | YES | NO | NO |
| Pyruvic acid | NO | NO | YES | YES | YES | YES |
| D-Alanine | NO | NO | YES | YES | NO | YES |
| L-Lactic acid | NO | NO | YES | NO | NO | YES |
| a-D-Glucose | NO | NO | NO | YES | YES | YES |
| a-D-Lactose | NO | NO | YES | YES | YES | YES |
| Adonitol | NO | NO | NO | YES | NO | YES |
| Glycolic acid | NO | NO | YES | YES | NO | NO |
| Mono Methyl Succinate | NO | NO | NO | YES | NO | YES |
| L-Galactonic-acid-?-lactone | NO | NO | NO | NO | NO | YES |
| D-Trehalose | NO | NO | NO | YES | YES | YES |
| Formic acid | NO | NO | NO | YES | NO | NO |
| Maltose | YES | NO | YES | YES | YES | YES |
| Lactulose | YES | NO | NO | YES | NO | YES |
| Maltotriose | NO | NO | YES | YES | YES | YES |
| Glyoxylic acid | NO | NO | YES | YES | NO | NO |
| Methyl Pyruvate | NO | NO | YES | YES | NO | YES |
| D-Galacturonic acid | NO | NO | YES | YES | YES | YES |
| D-Mannose | NO | NO | YES | YES | YES | YES |
| D-Mannitol | NO | NO | YES | YES | YES | YES |
| D-Melibiose | NO | NO | YES | YES | YES | YES |
| Sucrose | NO | NO | YES | YES | YES | YES |
| 2-Deoxy adenosine | NO | NO | NO | NO | NO | NO |
| D-Cellobiose | NO | NO | YES | YES | NO | YES |
| D-Malic acid | NO | NO | NO | YES | NO | YES |
| Phenylethyl-amine | NO | NO | NO | NO | NO | NO |
| Dulcitol | NO | NO | YES | YES | YES | YES |
| L-Glutamic acid | NO | NO | YES | YES | NO | YES |
| Thymidine | NO | NO | NO | YES | NO | NO |
| Uridine | NO | NO | YES | YES | NO | YES |
| Adenosine | NO | NO | YES | YES | NO | YES |

TABLE P-continued

| Substrate utilization as determined by BIOLOG PM1 MicroPlates by fungal endophytes belonging to core OTUs. | | | | | | |
|---|---|---|---|---|---|---|
| Inosine | NO | NO | NO | YES | YES | YES |
| L-Malic acid | YES | NO | NO | YES | NO | YES |
| 2-Aminoethanol | NO | NO | YES | YES | NO | YES |
| Strain/Substrate | SYM01310 | SYM01311 | SYM01314 | SYM01315 | SYM01325 | SYM01326 |
| D-Serine | NO | YES | NO | YES | NO | NO |
| D-Glucose-6-Phosphate | NO | NO | YES | NO | NO | NO |
| L-Asparagine | YES | YES | YES | NO | YES | YES |
| L-glutamine | YES | YES | YES | NO | YES | YES |
| Glycyl-L-Aspartic acid | NO | YES | NO | YES | NO | YES |
| Glycyl-L-Glutamic acid | YES | YES | YES | YES | NO | NO |
| Glycyl-L-Proline | NO | YES | YES | NO | NO | YES |
| L-Arabinose | YES | YES | YES | YES | YES | YES |
| D-Sorbitol | YES | YES | YES | YES | YES | YES |
| D-Galactonic acid-?-lactone | NO | NO | YES | NO | NO | NO |
| D-Aspartic acid | NO | YES | NO | NO | NO | NO |
| m-Tartaric acid | NO | YES | YES | YES | NO | NO |
| Citric acid | YES | YES | YES | YES | NO | YES |
| Tricarballylic acid | NO | YES | YES | NO | YES | NO |
| p-Hydroxy Phenyl acetic acid | NO | NO | YES | NO | NO | YES |
| N-Acetyl-D-Glucosamine | YES | YES | YES | YES | YES | YES |
| Glycerol | YES | YES | NO | YES | YES | NO |
| D-L-Malic acid | YES | YES | YES | YES | NO | NO |
| D-Glucosaminic acid | NO | NO | YES | NO | NO | YES |
| D-Glucose-1-Phosphate | NO | NO | YES | NO | NO | NO |
| m-Inositol | YES | YES | YES | YES | YES | YES |
| L-Serine | YES | YES | YES | NO | NO | YES |
| m-Hydroxy Phenyl Acetic acid | NO | NO | NO | YES | NO | NO |
| D-Saccharic acid | YES | YES | YES | YES | YES | YES |
| L-Fucose | NO | YES | YES | YES | NO | NO |
| D-Ribose | YES | YES | NO | YES | YES | YES |
| 1,2-Propanediol | NO | NO | NO | NO | NO | NO |
| D-Fructose-6-Phosphate | NO | NO | NO | NO | NO | NO |
| D-Threonine | NO | YES | NO | NO | NO | NO |
| L-Threonine | NO | YES | NO | NO | NO | YES |
| Tyramine | YES | YES | YES | YES | NO | YES |
| Succinic acid | YES | YES | NO | NO | NO | YES |
| D-Glucuronic acid | YES | YES | YES | YES | NO | YES |
| Tween 20 | YES | YES | YES | YES | NO | YES |
| Tween 40 | NO | YES | YES | YES | YES | YES |
| Tween 80 | YES | YES | YES | YES | YES | YES |
| Fumaric acid | YES | YES | YES | YES | YES | YES |
| L-Alanine | YES | YES | YES | YES | YES | YES |
| D-Psicose | NO | NO | NO | NO | NO | NO |
| D-Galactose | YES | YES | YES | YES | YES | YES |
| D-Gluconic acid | YES | YES | YES | NO | YES | YES |
| L-Rhamnose | NO | YES | YES | YES | YES | NO |
| a-Keto-Glutaric acid | YES | YES | YES | NO | NO | YES |
| a-Hydroxy Glutaric acid-?-lactone | YES | YES | YES | NO | NO | NO |
| Bromo succinic acid | YES | YES | YES | NO | YES | YES |
| L-Alanyl-Glycine | YES | YES | YES | NO | NO | YES |
| L-Lyxose | NO | NO | NO | NO | NO | NO |
| L-Aspartic acid | YES | YES | YES | YES | NO | YES |
| D-L-a-Glycerol phosphate | YES | NO | YES | YES | NO | NO |
| D-Fructose | YES | YES | YES | YES | YES | YES |
| a-Keto-Butyric acid | NO | YES | NO | YES | NO | NO |
| a-Hydroxy Butyric acid | NO | YES | NO | NO | NO | NO |
| Propionic acid | YES | YES | YES | NO | NO | NO |
| Acetoacetic acid | NO | NO | NO | YES | NO | NO |
| Glucuronamide | NO | NO | NO | NO | NO | NO |
| L-Proline | YES | YES | YES | YES | YES | NO |
| D-Xylose | YES | YES | YES | NO | YES | NO |
| Acetic acid | NO | YES | NO | NO | NO | NO |
| a-Methyl-D-Galactoside | YES | YES | NO | NO | YES | YES |
| β-Methyl-D-glucoside | YES | YES | YES | NO | YES | YES |
| Mucic acid | YES | YES | YES | YES | NO | YES |
| N-acetyl-β-D-Mannosamine | NO | NO | NO | YES | NO | NO |
| Pyruvic acid | YES | YES | YES | NO | NO | YES |
| D-Alanine | YES | YES | YES | NO | NO | YES |
| L-Lactic acid | YES | YES | YES | YES | NO | YES |
| a-D-Glucose | YES | YES | YES | YES | YES | YES |
| a-D-Lactose | NO | YES | YES | NO | NO | YES |
| Adonitol | YES | YES | YES | YES | YES | NO |
| Glycolic acid | NO | NO | NO | NO | NO | NO |
| Mono Methyl Succinate | NO | YES | YES | NO | NO | NO |

TABLE P-continued

Substrate utilization as determined by BIOLOG PM1 MicroPlates by fungal endophytes belonging to core OTUs.

| | | | | | | |
|---|---|---|---|---|---|---|
| L-Galactonic-acid-?-lactone | YES | YES | YES | NO | YES | YES |
| D-Trehalose | YES | YES | YES | YES | YES | YES |
| Formic acid | NO | NO | NO | YES | NO | NO |
| Maltose | YES | YES | YES | NO | YES | YES |
| Lactulose | NO | YES | NO | YES | NO | NO |
| Maltotriose | NO | YES | YES | YES | YES | YES |
| Glyoxylic acid | NO | NO | NO | NO | NO | NO |
| Methyl Pyruvate | YES | YES | NO | NO | NO | YES |
| D-Galacturonic acid | YES | YES | YES | NO | NO | YES |
| D-Mannose | YES | YES | YES | NO | YES | YES |
| D-Mannitol | YES | YES | YES | YES | YES | YES |
| D-Melibiose | YES | YES | NO | NO | YES | NO |
| Sucrose | YES | YES | YES | NO | YES | YES |
| 2-Deoxy adenosine | NO | YES | NO | NO | NO | NO |
| D-Cellobiose | YES | YES | YES | NO | YES | YES |
| D-Malic acid | YES | YES | YES | NO | NO | NO |
| Phenylethyl-amine | NO | NO | NO | NO | NO | NO |
| Dulcitol | NO | YES | NO | NO | NO | NO |
| L-Glutamic acid | YES | YES | YES | YES | YES | YES |
| Thymidine | NO | NO | NO | NO | NO | NO |
| Uridine | YES | YES | YES | NO | NO | YES |
| Adenosine | NO | NO | YES | YES | NO | NO |
| Inosine | YES | YES | YES | YES | NO | YES |
| L-Malic acid | YES | YES | YES | YES | YES | YES |
| 2-Aminoethanol | YES | YES | YES | NO | YES | NO |

| Strain/Substrate | SYM01327 | SYM01328 | SYM01333 | SYM0135 | SYM0136 |
|---|---|---|---|---|---|
| D-Serine | NO | NO | NO | NO | NO |
| D-Glucose-6-Phosphate | YES | YES | NO | NO | NO |
| L-Asparagine | YES | YES | YES | NO | NO |
| L-glutamine | YES | NO | YES | YES | NO |
| Glycyl-L-Aspartic acid | n/a | NO | NO | NO | NO |
| Glycyl-L-Glutamic acid | YES | YES | NO | NO | NO |
| Glycyl-L-Proline | YES | YES | NO | NO | NO |
| L-Arabinose | YES | YES | YES | YES | YES |
| D-Sorbitol | YES | YES | YES | YES | YES |
| D-Galactonic acid-?-lactone | YES | NO | YES | NO | NO |
| D-Aspartic acid | NO | NO | NO | NO | NO |
| m-Tartaric acid | NO | NO | NO | NO | NO |
| Citric acid | n/a | NO | YES | NO | NO |
| Tricarballylic acid | YES | YES | NO | YES | NO |
| p-Hydroxy Phenyl acetic acid | YES | NO | NO | NO | NO |
| N-Acetyl-D-Glucosamine | YES | NO | YES | YES | YES |
| Glycerol | YES | YES | YES | NO | NO |
| D-L-Malic acid | YES | YES | YES | NO | NO |
| D-Glucosaminic acid | YES | NO | NO | NO | NO |
| D-Glucose-1-Phosphate | YES | NO | NO | NO | NO |
| m-Inositol | n/a | NO | YES | NO | NO |
| L-Serine | YES | NO | YES | NO | NO |
| m-Hydroxy Phenyl Acetic acid | NO | YES | NO | NO | NO |
| D-Saccharic acid | YES | NO | YES | NO | NO |
| L-Fucose | YES | NO | NO | NO | NO |
| D-Ribose | YES | YES | NO | YES | NO |
| 1,2-Propanediol | NO | NO | NO | NO | NO |
| D-Fructose-6-Phosphate | NO | NO | NO | NO | NO |
| D-Threonine | n/a | YES | NO | NO | NO |
| L-Threonine | NO | YES | NO | NO | NO |
| Tyramine | YES | NO | YES | NO | NO |
| Succinic acid | YES | NO | YES | NO | NO |
| D-Glucuronic acid | YES | YES | YES | YES | NO |
| Tween 20 | YES | NO | YES | YES | YES |
| Tween 40 | YES | YES | YES | YES | YES |
| Tween 80 | YES | YES | YES | YES | YES |
| Fumaric acid | n/a | YES | YES | NO | NO |
| L-Alanine | YES | YES | YES | NO | NO |
| D-Psicose | NO | YES | NO | NO | NO |
| D-Galactose | YES | YES | YES | YES | YES |
| D-Gluconic acid | YES | YES | YES | YES | YES |
| L-Rhamnose | YES | NO | NO | NO | NO |
| a-Keto-Glutaric acid | YES | YES | YES | NO | NO |
| a-Hydroxy Glutaric acid-?-lactone | YES | YES | YES | NO | NO |
| Bromo succinic acid | n/a | NO | NO | NO | NO |
| L-Alanyl-Glycine | YES | YES | YES | NO | NO |
| L-Lyxose | NO | NO | NO | NO | NO |
| L-Aspartic acid | YES | YES | YES | NO | NO |

TABLE P-continued

| Substrate utilization as determined by BIOLOG PM1 MicroPlates by fungal endophytes belonging to core OTUs. | | | | | |
|---|---|---|---|---|---|
| D-L-a-Glycerol phosphate | YES | NO | NO | NO | NO |
| D-Fructose | YES | YES | YES | YES | NO |
| a-Keto-Butyric acid | YES | NO | NO | NO | NO |
| a-Hydroxy Butyric acid | NO | NO | NO | NO | NO |
| Propionic acid | n/a | NO | NO | NO | NO |
| Acetoacetic acid | NO | NO | NO | NO | NO |
| Glucuronamide | NO | NO | NO | NO | NO |
| L-Proline | YES | YES | YES | YES | NO |
| D-Xylose | YES | NO | YES | YES | NO |
| Acetic acid | YES | NO | NO | NO | NO |
| a-Methyl-D-Galactoside | YES | YES | NO | YES | YES |
| β-Methyl-D-glucoside | NO | YES | NO | YES | YES |
| Mucic acid | n/a | YES | YES | NO | NO |
| N-acetyl-β-D-Mannosamine | NO | YES | NO | NO | NO |
| Pyruvic acid | YES | NO | YES | NO | NO |
| D-Alanine | YES | NO | YES | NO | NO |
| L-Lactic acid | YES | NO | YES | NO | NO |
| a-D-Glucose | YES | YES | YES | YES | YES |
| a-D-Lactose | YES | YES | YES | NO | NO |
| Adonitol | YES | NO | YES | NO | NO |
| Glycolic acid | n/a | NO | NO | NO | NO |
| Mono Methyl Succinate | YES | NO | NO | NO | NO |
| L-Galactonic-acid-?-lactone | YES | NO | YES | YES | NO |
| D-Trehalose | YES | NO | YES | YES | NO |
| Formic acid | NO | YES | NO | NO | NO |
| Maltose | YES | YES | YES | YES | YES |
| Lactulose | YES | YES | NO | NO | NO |
| Maltotriose | YES | YES | NO | YES | YES |
| Glyoxylic acid | n/a | NO | NO | NO | NO |
| Methyl Pyruvate | YES | NO | NO | NO | NO |
| D-Galacturonic acid | YES | NO | YES | NO | NO |
| D-Mannose | YES | YES | YES | YES | YES |
| D-Mannitol | YES | NO | YES | YES | YES |
| D-Melibiose | YES | YES | NO | YES | YES |
| Sucrose | YES | YES | YES | YES | YES |
| 2-Deoxy adenosine | NO | NO | NO | NO | NO |
| D-Cellobiose | n/a | YES | NO | YES | NO |
| D-Malic acid | YES | NO | NO | NO | NO |
| Phenylethyl-amine | NO | NO | NO | NO | NO |
| Dulcitol | NO | YES | NO | NO | NO |
| L-Glutamic acid | YES | NO | YES | YES | YES |
| Thymidine | YES | YES | NO | NO | NO |
| Uridine | YES | NO | YES | NO | YES |
| Adenosine | YES | NO | YES | NO | NO |
| Inosine | n/a | NO | YES | NO | NO |
| L-Malic acid | YES | NO | YES | NO | NO |
| 2-Aminoethanol | YES | NO | YES | NO | NO |

TABLE Q

Substrate utilization as determined by BIOLOG PM1 MicroPlates by fungal endophytes belonging to core OTUs.

| Strain/Substrate | SYM00151 | SYM00154 | SYM015811 | SYM15820 | SYM15825 | SYM15828 | SYM15831 | SYM15837 |
|---|---|---|---|---|---|---|---|---|
| D-Serine | NO | NO | NO | NO | YES | NO | NO | NO |
| D-Glucose-6-Phosphate | YES | YES | NO | NO | NO | NO | NO | NO |
| L-Asparagine | YES | NO | YES | YES | YES | YES | YES | YES |
| L-glutamine | YES | NO | NO | YES | YES | YES | YES | YES |
| Glycyl-L-Aspartic acid | NO | YES | YES | YES | YES | YES | NO | NO |
| Glycyl-L-Glutamic acid | NO | YES | NO | YES | YES | YES | NO | YES |
| Glycyl-L-Proline | YES | YES | NO | YES | YES | YES | YES | NO |
| L-Arabinose | YES | YES | NO | YES | YES | YES | YES | YES |
| D-Sorbitol | YES | YES | YES | YES | YES | YES | YES | YES |
| D-Galactonic acid-?-lactone | NO | YES | YES | YES | NO | NO | NO | YES |
| D-Aspartic acid | NO | YES | NO | NO | NO | NO | NO | YES |
| m-Tartaric acid | YES | NO | NO | NO | YES | NO | YES | NO |
| Citric acid | YES | YES | YES | YES | YES | YES | YES | YES |
| Tricarballylic acid | YES | NO | NO | NO | YES | NO | NO | YES |
| p-Hydroxy Phenyl acetic acid | YES | YES | YES | YES | NO | YES | NO | YES |
| N-Acetyl-D-Glucosamine | YES | YES | NO | YES | YES | YES | YES | NO |
| Glycerol | YES | YES | YES | YES | YES | YES | YES | NO |
| D-L-Malic acid | NO | YES | NO | YES | YES | YES | NO | YES |
| D-Glucosaminic acid | NO | YES | YES | NO | NO | NO | NO | NO |

TABLE Q-continued

Substrate utilization as determined by BIOLOG PM1 MicroPlates by fungal endophytes belonging to core OTUs.

| | | | | | | | | |
|---|---|---|---|---|---|---|---|---|
| D-Glucose-1-Phosphate | NO | NO | NO | NO | NO | NO | NO | NO |
| m-Inositol | YES | YES | NO | YES | YES | YES | NO | YES |
| L-Serine | NO | NO | NO | YES | YES | YES | NO | YES |
| m-Hydroxy Phenyl Acetic acid | NO | NO | NO | NO | NO | NO | NO | NO |
| D-Saccharic acid | YES | NO | NO | YES | YES | YES | YES | YES |
| L-Fucose | NO | YES | NO | NO | NO | YES | YES | NO |
| D-Ribose | YES | YES | NO | YES | YES | YES | YES | YES |
| 1,2-Propanediol | NO | YES | NO | NO | NO | YES | NO | NO |
| D-Fructose-6-Phosphate | NO | YES | NO | NO | NO | NO | NO | NO |
| D-Threonine | NO | NO | NO | NO | NO | NO | NO | YES |
| L-Threonine | NO | NO | YES | YES | YES | NO | NO | YES |
| Tyramine | YES | YES | NO | NO | YES | YES | NO | YES |
| Succinic acid | YES | YES | NO | YES | YES | YES | NO | YES |
| D-Glucuronic acid | NO | YES | NO | YES | YES | YES | NO | NO |
| Tween 20 | YES | YES | YES | YES | YES | YES | YES | YES |
| Tween 40 | YES | YES | YES | YES | YES | YES | YES | YES |
| Tween 80 | YES | YES | NO | YES | YES | YES | YES | YES |
| Fumaric acid | NO | NO | YES | YES | YES | YES | YES | NO |
| L-Alanine | YES | NO | YES | YES | YES | YES | YES | NO |
| D-Psicose | NO | YES | NO | NO | NO | NO | NO | NO |
| D-Galactose | YES | YES | NO | YES | YES | YES | YES | YES |
| D-Gluconic acid | YES | YES | YES | YES | YES | YES | YES | YES |
| L-Rhamnose | YES | YES | NO | NO | YES | NO | NO | YES |
| a-Keto-Glutaric acid | NO | NO | YES | YES | NO | YES | NO | NO |
| a-Hydroxy Glutaric acid-?-lactone | NO | YES | NO | YES | NO | YES | NO | YES |
| Bromo succinic acid | NO | YES | NO | NO | YES | YES | NO | NO |
| L-Alanyl-Glycine | YES | YES | YES | YES | YES | YES | YES | YES |
| L-Lyxose | NO | NO | NO | NO | NO | NO | NO | NO |
| L-Aspartic acid | YES | NO | NO | YES | YES | YES | YES | YES |
| D-L-a-Glycerol phosphate | NO | YES | YES | YES | NO | YES | NO | YES |
| D-Fructose | YES | YES | YES | YES | YES | YES | YES | YES |
| a-Keto-Butyric acid | NO | YES | NO | NO | YES | NO | NO | NO |
| a-Hydroxy Butyric acid | NO | YES | NO | NO | YES | NO | NO | NO |
| Propionic acid | NO | YES | NO | NO | YES | YES | YES | YES |
| Acetoacetic acid | NO | NO | NO | NO | NO | NO | NO | NO |
| Glucuronamide | NO | NO | YES | NO | NO | NO | NO | YES |
| L-Proline | YES | YES | NO | YES | YES | YES | YES | YES |
| D-Xylose | YES | NO | NO | YES | YES | YES | YES | YES |
| Acetic acid | YES | YES | NO | YES | YES | YES | YES | YES |
| a-Methyl-D-Galactoside | YES | NO | NO | NO | YES | YES | YES | YES |
| β-Methyl-D-glucoside | YES | YES | NO | NO | YES | NO | YES | YES |
| Mucic acid | YES | YES | NO | YES | YES | YES | YES | YES |
| N-acetyl-β-D-Mannosamine | NO | YES | NO | NO | NO | YES | NO | YES |
| Pyruvic acid | YES | YES | NO | YES | YES | YES | YES | NO |
| D-Alanine | YES | NO | YES | YES | NO | YES | YES | YES |
| L-Lactic acid | YES | NO | NO | YES | YES | YES | YES | NO |
| a-D-Glucose | YES | YES | YES | YES | YES | YES | YES | YES |
| a-D-Lactose | YES | NO | NO | NO | YES | NO | NO | YES |
| Adonitol | YES | YES | YES | YES | YES | YES | NO | YES |
| Glycolic acid | NO | YES | NO | NO | YES | NO | NO | NO |
| Mono Methyl Succinate | YES | NO | NO | NO | YES | NO | YES | NO |
| L-Galactonic-acid-?-lactone | YES | YES | NO | YES | YES | YES | YES | YES |
| D-Trehalose | YES | YES | NO | YES | YES | YES | YES | YES |
| Formic acid | YES | NO | NO | NO | YES | NO | NO | NO |
| Maltose | YES | YES | NO | YES | YES | NO | YES | YES |
| Lactulose | YES | YES | NO | NO | YES | NO | YES | YES |
| Maltotriose | YES | NO | NO | YES | YES | YES | YES | YES |
| Glyoxylic acid | NO | YES | NO | NO | YES | NO | NO | NO |
| Methyl Pyruvate | YES | NO | NO | YES | YES | YES | YES | YES |
| D-Galacturonic acid | YES | YES | YES | YES | YES | YES | YES | YES |
| D-Mannose | YES | YES | NO | YES | YES | YES | YES | YES |
| D-Mannitol | YES | YES | YES | YES | YES | YES | YES | YES |
| D-Melibiose | YES | NO | YES | YES | YES | YES | YES | YES |
| Sucrose | YES | YES | NO | YES | YES | YES | YES | YES |
| 2-Deoxy adenosine | YES | NO | NO | NO | YES | NO | NO | NO |
| D-Cellobiose | YES | YES | NO | YES | YES | NO | YES | YES |
| D-Malic acid | YES | YES | YES | NO | YES | NO | NO | YES |
| Phenylethyl-amine | NO | NO | NO | NO | NO | NO | NO | NO |
| Dulcitol | YES | YES | NO | NO | YES | NO | YES | YES |
| L-Glutamic acid | YES | YES | YES | YES | YES | YES | YES | YES |
| Thymidine | NO | YES | NO | NO | YES | NO | YES | NO |
| Uridine | YES | YES | YES | YES | YES | NO | YES | YES |
| Adenosine | NO | YES | YES | YES | NO | YES | YES | YES |
| Inosine | YES | NO | YES | YES | NO | YES | YES | YES |

TABLE Q-continued

Substrate utilization as determined by BIOLOG PM1 MicroPlates by fungal endophytes belonging to core OTUs.

| | | | | | | | | |
|---|---|---|---|---|---|---|---|---|
| L-Malic acid | YES | YES | NO | YES | NO | YES | YES | NO |
| 2-Aminoethanol | YES | YES | NO | YES | YES | YES | NO | YES |

| Strain/Substrate | SYM15839 | SYM15847 | SYM15872 | SYM15890 | SYM15901 | SYM15920 | SYM15926 | SYM15928 |
|---|---|---|---|---|---|---|---|---|
| D-Serine | YES | YES | NO | NO | NO | YES | NO | NO |
| D-Glucose-6-Phosphate | NO | NO | NO | NO | NO | NO | NO | NO |
| L-Asparagine | NO | YES | YES | NO | YES | YES | YES | YES |
| L-glutamine | YES | YES | YES | YES | YES | YES | NO | NO |
| Glycyl-L-Aspartic acid | NO | NO | NO | NO | NO | YES | NO | NO |
| Glycyl-L-Glutamic acid | NO | YES | YES | YES | YES | YES | NO | NO |
| Glycyl-L-Proline | NO | YES | YES | NO | YES | YES | NO | YES |
| L-Arabinose | YES | YES | YES | YES | YES | YES | NO | YES |
| D-Sorbitol | YES | YES | YES | YES | YES | YES | NO | YES |
| D-Galactonic acid-?-lactone | YES | NO | NO | NO | NO | YES | YES | NO |
| D-Aspartic acid | NO | NO | NO | NO | NO | YES | NO | YES |
| m-Tartaric acid | YES | NO | YES | NO | YES | YES | NO | NO |
| Citric acid | NO | YES | NO | YES | NO | NO | NO | NO |
| Tricarballylic acid | YES | YES | YES | YES | YES | YES | NO | NO |
| p-Hydroxy Phenyl acetic acid | YES | NO | NO | NO | NO | YES | NO | NO |
| N-Acetyl-D-Glucosamine | YES | YES | YES | YES | YES | YES | YES | YES |
| Glycerol | YES | YES | YES | YES | YES | YES | YES | YES |
| D-L-Malic acid | YES | NO | YES | YES | YES | YES | NO | NO |
| D-Glucosaminic acid | NO | NO | NO | YES | NO | NO | NO | NO |
| D-Glucose-1-Phosphate | NO | NO | NO | NO | NO | NO | NO | NO |
| m-Inositol | YES | YES | YES | YES | YES | YES | NO | NO |
| L-Serine | NO | NO | YES | NO | YES | YES | NO | NO |
| m-Hydroxy Phenyl Acetic acid | NO | NO | NO | NO | NO | NO | NO | NO |
| D-Saccharic acid | YES | NO | YES | YES | YES | YES | NO | YES |
| L-Fucose | NO | NO | NO | NO | NO | NO | NO | NO |
| D-Ribose | YES | YES | YES | NO | YES | YES | NO | YES |
| 1,2-Propanediol | NO | NO | NO | NO | NO | NO | NO | NO |
| D-Fructose-6-Phosphate | NO | NO | NO | NO | NO | NO | NO | NO |
| D-Threonine | NO | NO | NO | NO | NO | YES | NO | NO |
| L-Threonine | NO | NO | YES | NO | YES | YES | NO | NO |
| Tyramine | YES | YES | YES | NO | YES | YES | YES | NO |
| Succinic acid | NO | NO | NO | YES | YES | YES | NO | NO |
| D-Glucuronic acid | NO | YES | YES | YES | YES | YES | YES | YES |
| Tween 20 | YES | YES | YES | NO | YES | YES | YES | YES |
| Tween 40 | YES | NO | YES | YES | YES | YES | NO | YES |
| Tween 80 | YES | YES | YES | YES | YES | YES | NO | YES |
| Fumaric acid | NO | NO | YES | NO | YES | YES | NO | YES |
| L-Alanine | NO | YES | YES | YES | YES | YES | YES | NO |
| D-Psicose | NO | NO | NO | NO | NO | NO | NO | NO |
| D-Galactose | YES | YES | YES | NO | YES | YES | YES | NO |
| D-Gluconic acid | YES | YES | YES | YES | YES | YES | NO | YES |
| L-Rhamnose | YES | YES | YES | NO | YES | YES | NO | NO |
| a-Keto-Glutaric acid | NO | NO | YES | YES | NO | NO | NO | NO |
| a-Hydroxy Glutaric acid-?-lactone | NO | NO | NO | NO | NO | NO | NO | NO |
| Bromo succinic acid | YES | YES | YES | NO | YES | YES | NO | NO |
| L-Alanyl-Glycine | YES | YES | YES | YES | YES | YES | NO | YES |
| L-Lyxose | NO | NO | NO | NO | NO | YES | YES | NO |
| L-Aspartic acid | NO | YES | YES | YES | YES | YES | NO | YES |
| D-L-a-Glycerol phosphate | YES | NO | YES | NO | NO | NO | YES | NO |
| D-Fructose | YES | YES | YES | YES | YES | YES | NO | NO |
| a-Keto-Butyric acid | NO | YES | YES | NO | NO | NO | NO | NO |
| a-Hydroxy Butyric acid | NO | NO | NO | NO | NO | NO | NO | NO |
| Propionic acid | YES | NO | NO | YES | YES | YES | NO | NO |
| Acetoacetic acid | NO | NO | NO | NO | NO | YES | NO | NO |
| Glucuronamide | NO | NO | NO | NO | NO | NO | NO | NO |
| L-Proline | YES | YES | YES | YES | YES | YES | YES | YES |
| D-Xylose | YES | YES | YES | NO | YES | YES | NO | YES |
| Acetic acid | YES | YES | YES | NO | YES | YES | YES | NO |
| a-Methyl-D-Galactoside | YES | YES | YES | NO | YES | YES | NO | NO |
| β-Methyl-D-glucoside | YES | YES | YES | NO | YES | YES | NO | YES |
| Mucic acid | YES | YES | YES | YES | YES | YES | NO | NO |
| N-acetyl-β-D-Mannosamine | NO | NO | NO | NO | NO | NO | NO | NO |
| Pyruvic acid | YES | YES | YES | YES | YES | YES | NO | YES |
| D-Alanine | NO | NO | NO | NO | NO | YES | YES | NO |
| L-Lactic acid | YES | YES | YES | NO | YES | YES | NO | YES |
| a-D-Glucose | YES | YES | YES | YES | YES | YES | YES | YES |
| a-D-Lactose | NO | YES | YES | NO | YES | YES | NO | NO |
| Adonitol | NO | NO | YES | NO | YES | YES | NO | NO |
| Glycolic acid | NO | NO | NO | NO | NO | NO | NO | NO |
| Mono Methyl Succinate | NO | NO | NO | YES | NO | NO | NO | YES |
| L-Galactonic-acid-?-lactone | YES | YES | YES | YES | YES | YES | YES | YES |

TABLE Q-continued

| Substrate utilization as determined by BIOLOG PM1 MicroPlates by fungal endophytes belonging to core OTUs. | | | | | | | | |
|---|---|---|---|---|---|---|---|---|
| D-Trehalose | YES | YES | YES | YES | YES | YES | NO | YES |
| Formic acid | NO | NO | YES | YES | YES | NO | NO | NO |
| Maltose | YES | YES | YES | YES | YES | YES | YES | YES |
| Lactulose | NO | NO | YES | NO | YES | YES | NO | NO |
| Maltotriose | YES | YES | YES | NO | YES | YES | YES | YES |
| Glyoxylic acid | NO | NO | YES | NO | YES | NO | NO | NO |
| Methyl Pyruvate | YES | YES | YES | YES | YES | YES | NO | YES |
| D-Galacturonic acid | YES | YES | YES | NO | YES | YES | YES | NO |
| D-Mannose | YES | YES | YES | YES | YES | YES | NO | YES |
| D-Mannitol | YES | YES | YES | NO | YES | YES | NO | YES |
| D-Melibiose | YES | YES | YES | NO | YES | YES | NO | YES |
| Sucrose | YES | YES | YES | YES | YES | YES | NO | YES |
| 2-Deoxy adenosine | YES | NO | YES | NO | YES | NO | NO | NO |
| D-Cellobiose | YES | YES | YES | YES | YES | YES | NO | YES |
| D-Malic acid | YES | NO | YES | NO | YES | YES | NO | NO |
| Phenylethyl-amine | NO | NO | NO | NO | NO | NO | NO | NO |
| Dulcitol | YES | YES | YES | NO | YES | YES | NO | YES |
| L-Glutamic acid | YES | YES | YES | YES | YES | YES | NO | NO |
| Thymidine | NO | NO | YES | NO | YES | NO | NO | NO |
| Uridine | NO | YES | YES | YES | YES | NO | NO | NO |
| Adenosine | NO | YES | YES | NO | YES | NO | NO | NO |
| Inosine | NO | NO | NO | YES | YES | YES | YES | NO |
| L-Malic acid | NO | YES | YES | NO | YES | YES | NO | YES |
| 2-Aminoethanol | NO | YES | YES | NO | YES | YES | YES | YES |

TABLE R

| Substrate utilization as determined by BIOLOG PM1 MicroPlates by fungal endophytes belonging to core OTUs. | | | | | | |
|---|---|---|---|---|---|---|
| Strain/Substrate | SYM15932 | SYM00160 | SYM00034 | SYM00566B | SYM00577 | SYM00590 |
| D-Serine | NO | NO | NO | NO | NO | NO |
| D-Glucose-6-Phosphate | NO | NO | NO | NO | NO | NO |
| L-Asparagine | NO | NO | YES | NO | YES | YES |
| L-glutamine | NO | YES | YES | YES | YES | NO |
| Glycyl-L-Aspartic acid | NO | NO | YES | NO | NO | NO |
| Glycyl-L-Glutamic acid | NO | NO | NO | NO | NO | NO |
| Glycyl-L-Proline | NO | YES | NO | YES | YES | NO |
| L-Arabinose | YES | NO | YES | NO | YES | YES |
| D-Sorbitol | NO | NO | YES | NO | YES | YES |
| D-Galactonic acid-?-lactone | NO | NO | NO | YES | NO | NO |
| D-Aspartic acid | NO | NO | NO | NO | NO | NO |
| m-Tartaric acid | NO | NO | NO | YES | YES | NO |
| Citric acid | NO | NO | NO | YES | YES | NO |
| Tricarballylic acid | NO | NO | NO | NO | NO | NO |
| p-Hydroxy Phenyl acetic acid | NO | NO | NO | YES | YES | NO |
| N-Acetyl-D-Glucosamine | NO | NO | YES | YES | YES | YES |
| Glycerol | NO | NO | YES | YES | NO | NO |
| D-L-Malic acid | NO | YES | NO | NO | YES | NO |
| D-Glucosaminic acid | NO | NO | YES | YES | NO | NO |
| D-Glucose-1-Phosphate | NO | NO | NO | NO | NO | NO |
| m-Inositol | NO | NO | NO | YES | YES | NO |
| L-Serine | NO | NO | NO | YES | YES | NO |
| m-Hydroxy Phenyl Acetic acid | NO | NO | NO | NO | NO | NO |
| D-Saccharic acid | NO | NO | NO | YES | YES | NO |
| L-Fucose | NO | NO | NO | NO | NO | NO |
| D-Ribose | NO | NO | YES | YES | YES | YES |
| 1,2-Propanediol | NO | NO | NO | NO | NO | NO |
| D-Fructose-6-Phosphate | NO | NO | NO | YES | NO | NO |
| D-Threonine | NO | NO | NO | NO | NO | NO |
| L-Threonine | NO | NO | NO | NO | YES | NO |
| Tyramine | YES | NO | NO | NO | YES | NO |
| Succinic acid | NO | NO | YES | NO | NO | NO |
| D-Glucuronic acid | YES | NO | NO | NO | YES | NO |
| Tween 20 | NO | NO | YES | NO | YES | YES |
| Tween 40 | NO | YES | YES | YES | YES | NO |
| Tween 80 | NO | NO | YES | YES | YES | NO |
| Fumaric acid | NO | YES | YES | YES | NO | NO |
| L-Alanine | NO | NO | NO | NO | YES | YES |
| D-Psicose | NO | NO | NO | NO | NO | NO |
| D-Galactose | NO | NO | YES | NO | YES | NO |
| D-Gluconic acid | NO | NO | NO | YES | YES | YES |
| L-Rhamnose | NO | NO | YES | NO | YES | NO |

TABLE R-continued

Substrate utilization as determined by BIOLOG PM1 MicroPlates by fungal endophytes belonging to core OTUs.

| | | | | | | |
|---|---|---|---|---|---|---|
| a-Keto-Glutaric acid | NO | NO | YES | NO | NO | NO |
| a-Hydroxy Glutaric acid-?-lactone | NO | NO | NO | YES | YES | NO |
| Bromo succinic acid | NO | NO | YES | NO | NO | NO |
| L-Alanyl-Glycine | NO | NO | NO | NO | NO | NO |
| L-Lyxose | NO | YES | NO | NO | NO | NO |
| L-Aspartic acid | NO | NO | YES | YES | YES | NO |
| D-L-a-Glycerol phosphate | NO | NO | NO | YES | NO | NO |
| D-Fructose | YES | YES | YES | YES | YES | YES |
| a-Keto-Butyric acid | NO | NO | NO | NO | NO | NO |
| a-Hydroxy Butyric acid | NO | NO | NO | NO | NO | NO |
| Propionic acid | NO | NO | NO | NO | NO | NO |
| Acetoacetic acid | NO | NO | NO | NO | NO | NO |
| Glucuronamide | NO | NO | NO | NO | NO | NO |
| L-Proline | NO | NO | YES | NO | YES | NO |
| D-Xylose | NO | NO | NO | YES | YES | NO |
| Acetic acid | NO | NO | NO | NO | NO | NO |
| a-Methyl-D-Galactoside | YES | NO | NO | NO | YES | NO |
| β-Methyl-D-glucoside | YES | YES | YES | YES | YES | YES |
| Mucic acid | NO | NO | NO | YES | YES | NO |
| N-acetyl-β-D-Mannosamine | NO | NO | NO | NO | NO | NO |
| Pyruvic acid | NO | NO | NO | NO | YES | NO |
| D-Alanine | NO | NO | NO | YES | YES | NO |
| L-Lactic acid | NO | NO | NO | NO | NO | NO |
| a-D-Glucose | YES | YES | YES | YES | YES | YES |
| a-D-Lactose | NO | NO | NO | NO | NO | NO |
| Adonitol | NO | NO | NO | NO | YES | NO |
| Glycolic acid | NO | NO | NO | NO | NO | NO |
| Mono Methyl Succinate | YES | NO | NO | NO | YES | NO |
| L-Galaclonic-acid-?-lactone | NO | NO | NO | NO | YES | NO |
| D-Trehalose | YES | NO | YES | YES | YES | YES |
| Formic acid | NO | NO | NO | NO | NO | NO |
| Maltose | YES | YES | YES | NO | YES | YES |
| Lactulose | NO | NO | NO | NO | NO | NO |
| Maltotriose | YES | YES | YES | NO | YES | YES |
| Glyoxylic acid | NO | NO | NO | NO | NO | NO |
| Methyl Pyruvate | NO | YES | NO | NO | NO | NO |
| D-Galacturonic acid | NO | NO | NO | NO | YES | YES |
| D-Mannose | YES | YES | YES | YES | YES | NO |
| D-Mannitol | YES | NO | YES | YES | YES | YES |
| D-Melibiose | NO | NO | NO | NO | YES | NO |
| Sucrose | YES | YES | YES | YES | YES | NO |
| 2-Deoxy adenosine | NO | NO | NO | NO | YES | NO |
| D-Cellobiose | YES | YES | YES | NO | YES | YES |
| D-Malic acid | NO | NO | NO | NO | YES | NO |
| Phenylethyl-amine | NO | NO | NO | NO | NO | NO |
| Dulcitol | NO | NO | YES | YES | YES | YES |
| L-Glutamic acid | NO | NO | YES | NO | NO | NO |
| Thymidine | NO | NO | NO | NO | NO | NO |
| Uridine | NO | NO | NO | NO | YES | NO |
| Adenosine | NO | YES | NO | NO | NO | NO |
| Inosine | NO | NO | NO | YES | YES | NO |
| L-Malic acid | NO | NO | YES | NO | YES | YES |
| 2-Aminoethanol | NO | NO | NO | NO | YES | NO |

| Strain/Substrate | SYM00603 | SYM00061A | SYM00622 | SYM00629 | SYM00066 | SYM00663 |
|---|---|---|---|---|---|---|
| D-Serine | NO | YES | NO | NO | NO | NO |
| D-Glucose-6-Phosphate | NO | NO | NO | NO | NO | NO |
| L-Asparagine | YES | YES | YES | YES | NO | YES |
| L-glutamine | YES | YES | YES | YES | NO | YES |
| Glycyl-L-Aspartic acid | NO | YES | NO | NO | NO | NO |
| Glycyl-L-Glutamic acid | YES | YES | NO | NO | YES | NO |
| Glycyl-L-Proline | YES | YES | NO | NO | NO | NO |
| L-Arabinose | YES | YES | YES | NO | NO | NO |
| D-Sorbitol | YES | YES | YES | YES | NO | NO |
| D-Galactonic acid-?-lactone | YES | NO | YES | NO | NO | NO |
| D-Aspartic acid | NO | NO | NO | NO | NO | YES |
| m-Tartaric acid | NO | YES | NO | NO | NO | NO |
| Citric acid | YES | YES | YES | YES | NO | YES |
| Tricarballylic acid | NO | NO | NO | NO | NO | NO |
| p-Hydroxy Phenyl acetic acid | YES | NO | NO | NO | YES | NO |
| N-Acetyl-D-Glucosamine | YES | YES | YES | YES | NO | YES |
| Glycerol | YES | YES | NO | YES | YES | YES |
| D-L-Malic acid | YES | YES | YES | YES | NO | YES |
| D-Glucosaminic acid | YES | NO | NO | NO | YES | NO |
| D-Glucose-1-Phosphate | NO | NO | NO | NO | YES | NO |

TABLE R-continued

Substrate utilization as determined by BIOLOG PM1 MicroPlates by fungal endophytes belonging to core OTUs.

| | | | | | | |
|---|---|---|---|---|---|---|
| m-Inositol | YES | YES | YES | YES | NO | NO |
| L-Serine | YES | YES | YES | NO | NO | YES |
| m-Hydroxy Phenyl Acetic acid | NO | NO | NO | NO | YES | NO |
| D-Saccharic acid | YES | YES | YES | NO | NO | NO |
| L-Fucose | NO | NO | NO | NO | NO | NO |
| D-Ribose | YES | YES | YES | YES | NO | NO |
| 1,2-Propanediol | NO | NO | NO | NO | YES | NO |
| D-Fructose-6-Phosphate | NO | NO | NO | NO | NO | NO |
| D-Threonine | NO | YES | NO | NO | NO | NO |
| L-Threonine | NO | YES | NO | NO | NO | NO |
| Tyramine | YES | NO | YES | YES | NO | NO |
| Succinic acid | YES | YES | YES | YES | YES | NO |
| D-Glucuronic acid | YES | YES | YES | YES | NO | YES |
| Tween 20 | YES | YES | NO | YES | NO | NO |
| Tween 40 | YES | YES | YES | YES | NO | YES |
| Twecn 80 | YES | YES | YES | YES | YES | YES |
| Fumaric acid | YES | YES | YES | YES | NO | NO |
| L-Alanine | YES | YES | YES | NO | YES | YES |
| D-Psicose | NO | YES | NO | NO | YES | NO |
| D-Galactose | YES | YES | YES | NO | NO | NO |
| D-Gluconic acid | YES | YES | YES | YES | NO | NO |
| L-Rhamnose | NO | YES | NO | NO | NO | NO |
| a-Keto-Glutaric acid | YES | NO | NO | YES | NO | YES |
| a-Hydroxy Glutaric acid-?-lactone | YES | YES | YES | NO | NO | NO |
| Bromo succinic acid | YES | YES | NO | NO | NO | NO |
| L-Alanyl-Glycine | YES | YES | YES | YES | NO | YES |
| L-Lyxose | NO | YES | NO | NO | NO | NO |
| L-Aspartic acid | YES | YES | YES | YES | NO | YES |
| D-L-a-Glycerol phosphate | YES | NO | YES | YES | NO | YES |
| D-Fructose | YES | YES | YES | YES | NO | YES |
| a-Keto-Butyric acid | NO | YES | NO | NO | NO | NO |
| a-Hydroxy Butyric acid | NO | NO | NO | YES | NO | NO |
| Propionic acid | YES | NO | NO | NO | NO | YES |
| Acetoacetic acid | NO | NO | NO | NO | NO | NO |
| Glucuronamide | NO | NO | NO | NO | NO | NO |
| L-Proline | YES | YES | YES | YES | NO | YES |
| D-Xylose | YES | YES | YES | YES | NO | NO |
| Acetic acid | NO | NO | NO | NO | NO | NO |
| a-Methyl-D-Galactoside | NO | YES | NO | NO | NO | NO |
| β-Methyl-D-glucoside | NO | YES | NO | NO | YES | NO |
| Mucic acid | YES | YES | YES | YES | NO | YES |
| N-acetyl-β-D-Mannosamine | NO | YES | NO | NO | NO | NO |
| Pyruvic acid | NO | YES | NO | NO | NO | YES |
| D-Alanine | YES | YES | YES | YES | NO | NO |
| L-Lactic acid | YES | YES | YES | NO | NO | YES |
| a-D-Glucose | YES | YES | YES | YES | YES | YES |
| a-D-Lactose | NO | YES | NO | NO | NO | YES |
| Adonitol | YES | YES | YES | YES | NO | YES |
| Glycolic acid | NO | NO | NO | NO | NO | NO |
| Mono Methyl Succinate | NO | YES | NO | NO | NO | NO |
| L-Galaclonic-acid-?-lactone | YES | YES | NO | YES | NO | NO |
| D-Trehalose | YES | YES | YES | YES | NO | NO |
| Formic acid | NO | NO | NO | NO | NO | NO |
| Maltose | NO | YES | NO | NO | YES | YES |
| Lactulose | NO | YES | NO | NO | NO | YES |
| Maltotriose | NO | YES | NO | NO | YES | YES |
| Glyoxylic acid | NO | NO | NO | NO | NO | NO |
| Methyl Pyruvate | NO | YES | NO | YES | NO | YES |
| D-Galacturonic acid | YES | YES | YES | YES | YES | NO |
| D-Mannose | YES | YES | YES | NO | NO | YES |
| D-Mannitol | YES | YES | NO | YES | YES | NO |
| D-Melibiose | NO | YES | NO | NO | YES | NO |
| Sucrose | YES | YES | YES | YES | NO | YES |
| 2-Deoxy adenosine | NO | YES | NO | NO | NO | NO |
| D-Cellobiose | NO | YES | YES | NO | YES | YES |
| D-Malic acid | YES | YES | NO | YES | NO | NO |
| Phenylethyl-amine | NO | NO | NO | NO | NO | NO |
| Dulcitol | NO | YES | NO | NO | YES | NO |
| L-Glutamic acid | YES | YES | YES | YES | NO | YES |
| Thymidine | NO | NO | NO | NO | NO | NO |
| Uridine | YES | YES | YES | YES | NO | NO |
| Adenosine | YES | NO | YES | YES | NO | NO |
| Inosine | YES | YES | YES | YES | NO | YES |
| L-Malic acid | YES | YES | YES | NO | NO | YES |
| 2-Aminoethanol | YES | YES | YES | YES | NO | NO |

TABLE R-continued

Substrate utilization as determined by BIOLOG PM1 MicroPlates by fungal endophytes belonging to core OTUs.

| Strain/Substrate | SYM00696 | SYM00741A | SYM00741B | SYM00854 | SYM00880 |
|---|---|---|---|---|---|
| D-Serine | NO | NO | NO | NO | NO |
| D-Glucose-6-Phosphate | NO | NO | NO | NO | NO |
| L-Asparagine | YES | YES | YES | YES | YES |
| L-glutamine | YES | YES | YES | YES | NO |
| Glycyl-L-Aspartic acid | NO | NO | NO | NO | NO |
| Glycyl-L-Glutamic acid | NO | NO | YES | NO | NO |
| Glycyl-L-Proline | NO | NO | YES | NO | NO |
| L-Arabinose | YES | NO | YES | YES | NO |
| D-Sorbitol | NO | YES | YES | NO | NO |
| D-Galactonic acid-?-lactone | NO | NO | YES | NO | NO |
| D-Aspartic acid | NO | NO | NO | YES | NO |
| m-Tartaric acid | NO | NO | NO | NO | NO |
| Citric acid | NO | YES | YES | YES | NO |
| Tricarballylic acid | NO | NO | NO | NO | NO |
| p-Hydroxy Phenyl acetic acid | NO | NO | YES | NO | NO |
| N-Acetyl-D-Glucosamine | NO | NO | YES | YES | NO |
| Glycerol | YES | YES | YES | NO | NO |
| D-L-Malic acid | NO | NO | YES | YES | YES |
| D-Glucosaminic acid | NO | NO | YES | NO | NO |
| D-Glucose-1-Phosphate | NO | NO | NO | NO | NO |
| m-Inositol | NO | NO | YES | NO | NO |
| L-Serine | NO | YES | YES | YES | NO |
| m-Hydroxy Phenyl Acetic acid | NO | NO | NO | NO | NO |
| D-Saccharic acid | YES | NO | YES | YES | NO |
| L-Fucose | NO | NO | NO | NO | NO |
| D-Ribose | NO | NO | YES | NO | NO |
| 1,2-Propanediol | NO | NO | NO | NO | NO |
| D-Fructose-6-Phosphate | NO | NO | NO | NO | NO |
| D-Threonine | NO | NO | NO | NO | NO |
| L-Threonine | NO | NO | NO | NO | NO |
| Tyramine | NO | NO | NO | NO | NO |
| Succinic acid | NO | NO | YES | YES | NO |
| D-Glucuronic acid | NO | YES | YES | NO | NO |
| Tween 20 | NO | NO | YES | YES | NO |
| Tween 40 | NO | NO | YES | YES | NO |
| Tween 80 | NO | NO | YES | YES | NO |
| Fumaric acid | NO | YES | YES | YES | NO |
| L-Alanine | YES | YES | YES | YES | NO |
| D-Psicose | NO | NO | NO | NO | NO |
| D-Galactose | YES | NO | YES | YES | NO |
| D-Gluconic acid | NO | YES | YES | YES | NO |
| L-Rhamnose | NO | NO | NO | YES | NO |
| a-Keto-Glutaric acid | NO | YES | YES | YES | NO |
| a-Hydroxy Glutaric acid-?-lactone | NO | NO | YES | NO | NO |
| Bromo succinic acid | NO | NO | YES | YES | NO |
| L-Alanyl-Glycine | NO | NO | YES | YES | NO |
| L-Lyxose | NO | NO | NO | YES | NO |
| L-Aspartic acid | NO | NO | YES | YES | NO |
| D-L-a-Glycerol phosphate | NO | NO | YES | NO | NO |
| D-Fructose | YES | NO | YES | YES | NO |
| a-Keto-Butyric acid | NO | NO | NO | NO | NO |
| a-Hydroxy Butyric acid | NO | NO | NO | NO | NO |
| Propionic acid | NO | NO | YES | NO | NO |
| Acetoacetic acid | NO | NO | NO | NO | NO |
| Glucuronamide | NO | NO | NO | NO | NO |
| L-Proline | YES | YES | YES | YES | NO |
| D-Xylose | YES | NO | YES | YES | NO |
| Acetic acid | NO | NO | YES | NO | NO |
| a-Methyl-D-Galactoside | NO | NO | NO | NO | NO |
| β-Methyl-D-glucoside | YES | NO | NO | YES | YES |
| Mucic acid | NO | YES | YES | YES | NO |
| N-acetyl-β-D-Mannosamine | NO | NO | NO | NO | NO |
| Pyruvic acid | NO | NO | YES | NO | NO |
| D-Alanine | NO | NO | YES | YES | NO |
| L-Lactic acid | YES | NO | YES | NO | NO |
| a-D-Glucose | YES | YES | YES | YES | NO |
| a-D-Lactose | YES | NO | NO | YES | NO |
| Adonitol | NO | NO | YES | YES | NO |
| Glycolic acid | NO | NO | NO | NO | NO |
| Mono Methyl Succinate | YES | NO | NO | YES | NO |
| L-Galaclonic-acid-?-lactone | YES | NO | YES | YES | NO |
| D-Trehalose | YES | YES | YES | YES | NO |
| Formic acid | NO | NO | NO | NO | NO |
| Maltose | YES | YES | NO | YES | YES |

TABLE R-continued

| Substrate utilization as determined by BIOLOG PM1 MicroPlates by fungal endophytes belonging to core OTUs. | | | | | |
|---|---|---|---|---|---|
| Lactulose | YES | NO | NO | YES | NO |
| Maltotriose | YES | NO | NO | YES | YES |
| Glyoxylic acid | NO | NO | NO | NO | NO |
| Methyl Pyruvate | NO | NO | YES | NO | NO |
| D-Galacturonic acid | YES | NO | YES | YES | NO |
| D-Mannose | YES | NO | YES | YES | NO |
| D-Mannitol | NO | NO | YES | YES | NO |
| D-Melibiose | YES | NO | NO | YES | NO |
| Sucrose | YES | YES | YES | YES | YES |
| 2-Deoxy adenosine | NO | NO | NO | NO | NO |
| D-Cellobiose | YES | YES | NO | YES | YES |
| D-Malic acid | NO | NO | NO | YES | NO |
| Phenylethyl-amine | NO | NO | NO | NO | NO |
| Dulcitol | YES | NO | NO | YES | NO |
| L-Glutamic acid | YES | NO | YES | YES | NO |
| Thymidine | NO | NO | NO | NO | NO |
| Uridine | NO | NO | YES | YES | NO |
| Adenosine | NO | NO | YES | NO | NO |
| Inosine | YES | NO | YES | NO | NO |
| L-Malic acid | YES | YES | YES | YES | NO |
| 2-Aminoethanol | NO | NO | YES | NO | NO |

TABLE S

Substrate utilization as determined by BIOLOG PM2A MicroPlates by fungal endophytes belonging to core OTUs.

| Strain/Substrate | SYM00120 | SYM00122 | SYM00123 | SYM00124 | SYM00129 | SYM01300 | SYM01310 | SYM01311 |
|---|---|---|---|---|---|---|---|---|
| N-acetyl-D-Galactosamine | NO | NO | YES | NO | NO | YES | NO | NO |
| Gentiobiose | NO | NO | YES | YES | YES | NO | NO | YES |
| D-Raffinose | NO | NO | YES | YES | YES | NO | NO | YES |
| Capric acid | NO | NO | NO | NO | NO | YES | NO | NO |
| D-lactic acid methyl ester | NO | YES | YES | NO | NO | NO | NO | NO |
| Acetamide | NO | NO | YES | NO | NO | NO | NO | NO |
| L-Ornithine | NO | YES | YES | YES | YES | YES | YES | YES |
| Chondrointin sulfate C | NO | NO | YES | NO | NO | NO | NO | NO |
| N-acetyl-neuraminic acid | NO | YES | YES | NO | NO | YES | NO | NO |
| L-glucose | NO | YES | NO | NO | NO | NO | NO | NO |
| Salicin | YES | NO | NO | YES | NO | NO | NO | YES |
| Caproic acid | NO | NO | NO | NO | NO | YES | NO | NO |
| Malonic acid | NO | NO | YES | YES | NO | YES | NO | NO |
| L-Alaninamide | NO | NO | YES | NO | NO | YES | NO | NO |
| L-Phenylalanine | YES | NO | NO | NO | NO | YES | NO | YES |
| a-Cyclodextrin | YES | YES | YES | YES | YES | YES | YES | YES |
| β-D-allose | NO | NO | YES | NO | NO | NO | NO | NO |
| Lactitol | NO | NO | NO | NO | NO | NO | NO | NO |
| Sedoheptulosan | YES | YES | NO | YES | NO | NO | NO | NO |
| Citraconic acid | NO | YES | YES | NO | NO | NO | NO | NO |
| Melibionic acid | NO | NO | NO | NO | NO | NO | NO | NO |
| N-Acetyl-L-Glutamic acid | NO | NO | NO | NO | NO | YES | YES | NO |
| L-Pyroglutamic acid | NO | NO | YES | NO | NO | YES | YES | YES |
| β-Cyclodextrin | NO | YES | YES | NO | NO | NO | NO | NO |
| Amygdalin | NO | NO | NO | YES | NO | NO | NO | YES |
| D-Melezitose | NO | YES | YES | NO | YES | NO | NO | YES |
| L-Sorbose | NO | NO | YES | NO | YES | NO | NO | NO |
| Citramalic acid | YES | NO | NO | NO | NO | NO | NO | NO |
| Oxalic acid | NO | NO | YES | YES | NO | NO | NO | NO |
| L-Arginine | NO | NO | NO | YES | NO | YES | YES | YES |
| L-Valine | NO | YES | YES | NO | NO | YES | YES | YES |
| γ-Cyclodextrin | NO | NO | YES | YES | NO | NO | NO | NO |
| D-arabinose | NO | NO | NO | YES | NO | NO | NO | NO |
| Maltitol | NO | NO | YES | YES | YES | NO | NO | YES |
| Stachyose | NO | NO | NO | YES | NO | NO | NO | YES |
| D-Glucosamine | NO | NO | NO | NO | NO | YES | NO | NO |
| Oxalomalic acid | NO | NO | YES | YES | NO | NO | NO | NO |
| Glycine | NO | NO | NO | YES | NO | NO | NO | NO |
| D,L-Carnitine | NO | YES | NO | NO | NO | YES | NO | NO |
| Dextrin | NO | NO | YES | NO | YES | NO | NO | YES |
| D-arabitol | NO | YES | NO | YES | NO | NO | NO | YES |
| a-Methyl-D-Glucoside | NO | NO | NO | NO | NO | NO | NO | NO |
| D-Tagatose | NO | NO | NO | YES | NO | NO | NO | NO |
| 2-Hydroxy benzoic acid | NO | YES | NO | NO | NO | NO | NO | NO |
| Quinic acid | NO | NO | NO | NO | NO | YES | NO | YES |

TABLE S-continued

Substrate utilization as determined by BIOLOG PM2A MicroPlates by fungal endophytes belonging to core OTUs.

| | | | | | | | | |
|---|---|---|---|---|---|---|---|---|
| L-Histidine | NO | NO | NO | NO | YES | YES | YES | YES |
| Sec-Butylamine | NO | NO | NO | NO | NO | NO | NO | NO |
| Gelatin | YES | YES | YES | YES | NO | YES | YES | YES |
| L-arabitol | NO | YES | YES | NO | NO | NO | NO | NO |
| β-Methyl-D-Galactoside | NO | NO | YES | NO | NO | NO | NO | YES |
| Turanose | NO | YES | YES | YES | YES | NO | YES | YES |
| 4-Hydroxy benzoic acid | NO | NO | YES | NO | NO | NO | NO | NO |
| D-Ribono-1,4-Lactone | NO | YES | YES | NO | NO | NO | NO | NO |
| L-Homoserine | NO | NO | NO | NO | NO | NO | NO | NO |
| D,L-Octopamine | NO | NO | YES | NO | NO | YES | YES | YES |
| Glycogen | YES | YES | YES | YES | NO | YES | NO | YES |
| Arbutin | NO | NO | YES | YES | NO | NO | NO | YES |
| 3-Methyl Glucose | YES | NO | NO | NO | NO | NO | NO | NO |
| Xylitol | NO | NO | YES | NO | NO | NO | NO | NO |
| β-Hydroxy butyric acid | NO | NO | YES | NO | NO | YES | NO | YES |
| Sebacic acid | YES | YES | YES | NO | NO | YES | NO | NO |
| Hydroxy-L-Proline | NO | NO | NO | YES | NO | YES | YES | YES |
| Putrescine | NO | YES | NO | YES | YES | YES | YES | YES |
| Inulin | NO | YES | YES | NO | NO | NO | NO | NO |
| 2-Deoxy-D-Ribose | NO | NO | NO | NO | NO | NO | NO | NO |
| β-Methyl-D-Glucuronic acid | YES | YES | NO | NO | NO | NO | NO | NO |
| N-Acetyl-D-glucosaminitol | NO | YES | YES | NO | NO | NO | NO | NO |
| γ-Hydroxy butyric acid | NO | YES | YES | NO | NO | NO | NO | NO |
| Sorbic acid | NO | NO | YES | NO | NO | NO | NO | NO |
| L-Isoleucine | NO | NO | NO | YES | YES | YES | YES | YES |
| Dihydroxy acetone | NO | NO | YES | NO | NO | NO | NO | NO |
| Laminarin | NO | NO | NO | NO | NO | NO | NO | NO |
| i-Erythritol | NO | NO | YES | NO | NO | NO | YES | NO |
| a-Methyl-D-Mannoside | NO | NO | YES | NO | NO | NO | NO | NO |
| γ-amino butyric acid | NO | YES | NO | NO | YES | YES | YES | YES |
| a-Keto-valeric acid | NO | NO | YES | NO | NO | NO | NO | NO |
| Succinamic acid | NO | NO | YES | NO | NO | YES | NO | NO |
| L-Leucine | NO | NO | NO | YES | NO | YES | YES | YES |
| 2,3-Butanediol | YES | NO | YES | NO | NO | NO | NO | NO |
| Mannan | NO | NO | YES | NO | NO | NO | NO | NO |
| D-Fucose | NO | NO | NO | NO | NO | NO | NO | NO |
| β-Methyl-D-Xyloside | NO | YES | NO | NO | NO | NO | NO | NO |
| d-amino valeric acid | NO | YES | YES | NO | NO | NO | NO | YES |
| Itaconic acid | NO | NO | YES | NO | NO | NO | NO | NO |
| D-Tartaric acid | NO | YES | NO | NO | NO | NO | NO | NO |
| L-Lysine | NO | NO | YES | NO | NO | NO | NO | YES |
| 2,3-Butanone | NO | NO | YES | NO | NO | NO | NO | NO |
| Pectin | NO | YES | NO | YES | NO | NO | NO | YES |
| 3-0-β-D-Galactopyranosyl-D-arabinose | NO | NO | YES | NO | NO | NO | YES | NO |
| Palatinose | NO | NO | YES | YES | YES | NO | NO | YES |
| Butyric acid | NO | YES | NO | NO | NO | NO | YES | NO |
| 5-Keto-D-Gluconic acid | NO | NO | NO | NO | NO | NO | NO | YES |
| L-Tartaric acid | NO | NO | YES | NO | NO | NO | NO | YES |
| L-Methionine | NO | YES | NO | NO | NO | NO | NO | NO |
| 3-Hydroxy 2-Butanone | NO | NO | NO | NO | NO | NO | NO | NO |

| Strain/Substrate | SYM01314 | SYM01315 | SYM01324 | SYM01325 | SYM01326 | SYM01327 | SYM01333 |
|---|---|---|---|---|---|---|---|
| N-acetyl-D-Galactosamine | YES | YES | NO | NO | NO | YES | NO |
| Gentiobiose | NO | YES | YES | YES | NO | NO | NO |
| D-Raffinose | NO | NO | NO | YES | YES | NO | NO |
| Capric acid | YES | NO | NO | NO | YES | YES | YES |
| D-lactic acid methyl ester | NO | NO | NO | NO | NO | NO | NO |
| Acetamide | NO | NO | NO | NO | NO | NO | NO |
| L-Ornithine | YES | YES | NO | YES | YES | YES | YES |
| Chondrointin sulfate C | NO | YES | NO | NO | NO | NO | NO |
| N-acetyl-neuraminic acid | YES | NO | NO | NO | NO | YES | NO |
| L-glucose | NO | NO | NO | NO | NO | NO | NO |
| Salicin | NO | NO | NO | YES | YES | NO | NO |
| Caproic acid | NO | NO | NO | NO | YES | NO | NO |
| Malonic acid | NO | NO | NO | NO | NO | NO | NO |
| L-Alaninamide | YES | NO | NO | YES | YES | YES | YES |
| L-Phenylalanine | YES | NO | NO | NO | NO | YES | NO |
| a-Cyclodextrin | YES | YES | YES | YES | YES | YES | YES |
| β-D-allose | NO | YES | NO | NO | NO | NO | NO |
| Lactitol | NO | YES | YES | NO | NO | NO | NO |
| Sedoheptulosan | NO | NO | NO | NO | NO | NO | NO |
| Citraconic acid | NO | YES | NO | NO | NO | NO | NO |
| Melibionic acid | YES | YES | NO | NO | NO | NO | NO |
| N-Acetyl-L-Glutamic acid | YES | NO | NO | NO | YES | YES | YES |
| L-Pyroglutamic acid | YES | YES | NO | YES | YES | YES | YES |

TABLE S-continued

Substrate utilization as determined by BIOLOG PM2A MicroPlates by fungal endophytes belonging to core OTUs.

| | | | | | | | |
|---|---|---|---|---|---|---|---|
| β-Cyclodextrin | NO | NO | NO | NO | NO | NO | NO |
| Amygdalin | NO | NO | NO | YES | NO | NO | NO |
| D-Melezitose | NO | NO | YES | YES | NO | NO | NO |
| L-Sorbose | NO | NO | NO | NO | NO | NO | NO |
| Citramalic acid | NO | NO | NO | NO | NO | YES | NO |
| Oxalic acid | NO | NO | NO | NO | NO | NO | NO |
| L-Arginine | YES | YES | NO | YES | YES | YES | YES |
| L-Valine | YES | NO | NO | YES | YES | YES | YES |
| γ-Cyclodextrin | NO | YES | NO | YES | NO | NO | YES |
| D-arabinose | NO | YES | NO | NO | NO | NO | NO |
| Maltitol | NO | NO | YES | NO | NO | NO | NO |
| Stachyose | NO | NO | YES | YES | NO | NO | NO |
| D-Glucosamine | YES | NO | NO | NO | NO | YES | NO |
| Oxalomalic acid | NO | YES | NO | NO | NO | NO | NO |
| Glycine | NO | NO | NO | NO | NO | YES | NO |
| D,L-Carnitine | YES | NO | NO | NO | YES | YES | NO |
| Dextrin | NO | YES | NO | YES | NO | NO | NO |
| D-arabitol | NO | YES | YES | YES | NO | NO | YES |
| a-Methyl-D-Glucoside | NO | NO | YES | NO | NO | NO | NO |
| D-Tagatose | NO | NO | NO | NO | NO | NO | NO |
| 2-Hydroxy benzoic acid | YES | YES | NO | NO | YES | NO | NO |
| Quinic acid | YES | NO | YES | YES | NO | NO | NO |
| L-Histidine | YES | YES | YES | NO | YES | YES | YES |
| Sec-Butylamine | NO | NO | NO | NO | NO | NO | NO |
| Gelatin | YES | YES | YES | YES | YES | YES | YES |
| L-arabitol | NO | YES | NO | NO | NO | NO | NO |
| β-Methyl-D-Galactoside | NO | NO | NO | NO | NO | NO | NO |
| Turanose | NO | NO | NO | NO | NO | NO | NO |
| 4-Hydroxy benzoic acid | NO | YES | NO | NO | NO | NO | NO |
| D-Ribono-1,4-Lactone | NO | YES | NO | NO | YES | NO | NO |
| L-Homoserine | NO | NO | NO | NO | NO | NO | NO |
| D,L-Octopamine | YES | NO | NO | NO | YES | YES | YES |
| Glycogen | NO | YES | YES | YES | YES | NO | NO |
| Arbutin | NO | YES | YES | YES | NO | NO | NO |
| 3-Methyl Glucose | NO | NO | NO | NO | NO | NO | NO |
| Xylitol | NO | YES | NO | NO | NO | NO | NO |
| β-Hydroxy butyric acid | NO | YES | YES | YES | NO | YES | YES |
| Sebacic acid | NO | YES | NO | NO | NO | NO | NO |
| Hydroxy-L-Proline | YES | YES | NO | YES | YES | YES | YES |
| Putrescine | NO | YES | NO | YES | NO | NO | NO |
| Inulin | NO | YES | NO | NO | YES | NO | NO |
| 2-Deoxy-D-Ribose | NO | NO | NO | NO | NO | NO | NO |
| β-Methyl-D-Glucuronic acid | NO | YES | NO | NO | NO | NO | NO |
| N-Acetyl-D-glucosaminitol | NO | NO | NO | NO | NO | NO | NO |
| γ-Hydroxy butyric acid | NO | YES | NO | NO | NO | NO | NO |
| Sorbic acid | NO | NO | NO | NO | NO | NO | NO |
| L-Isoleucine | YES | NO | NO | YES | YES | YES | YES |
| Dihydroxy acetone | NO | NO | NO | NO | NO | NO | NO |
| Laminarin | NO | NO | NO | YES | NO | NO | NO |
| i-Erythritol | NO | YES | NO | NO | NO | NO | YES |
| a-Methyl-D-Mannoside | NO | YES | NO | NO | NO | NO | NO |
| γ-amino butyric acid | YES | YES | YES | YES | YES | YES | YES |
| a-Keto-valeric acid | NO | YES | NO | NO | NO | NO | NO |
| Succinamic acid | YES | YES | NO | YES | YES | YES | NO |
| L-Leucine | YES | YES | NO | NO | YES | YES | YES |
| 2,3-Butanediol | NO | NO | NO | NO | NO | NO | NO |
| Mannan | NO | NO | NO | NO | NO | NO | NO |
| D-Fucose | NO | NO | NO | NO | NO | NO | NO |
| β-Methyl-D-Xyloside | NO | YES | NO | NO | NO | NO | NO |
| d-amino valeric acid | NO | YES | NO | NO | NO | NO | NO |
| Itaconic acid | NO | YES | NO | NO | NO | NO | NO |
| D-Tartaric acid | NO | YES | NO | NO | NO | NO | NO |
| L-Lysine | NO | YES | NO | YES | NO | NO | NO |
| 2,3-Butanone | NO | YES | NO | NO | NO | NO | NO |
| Pectin | NO | YES | NO | NO | NO | NO | NO |
| 3-0-β-D-Galactopyranosyl-D-arabinose | NO | YES | YES | NO | NO | NO | YES |
| Palatinose | NO | YES | YES | YES | NO | NO | NO |
| Butyric acid | NO | NO | NO | NO | NO | NO | NO |
| 5-Keto-D-Gluconic acid | NO | YES | NO | YES | NO | NO | NO |
| L-Tartaric acid | NO | NO | NO | NO | NO | NO | NO |
| L-Methionine | NO | NO | NO | NO | NO | NO | NO |
| 3-Hydroxy 2-Butanone | NO | YES | NO | NO | NO | NO | NO |

TABLE T

Substrate utilization as determined by BIOLOG PM2A MicroPlates by fungal endophytes belonging to core OTUs.

| Strain/Substrate | SYM00135 | SYM00136 | SYM00151 | SYM00154 | SYM15811 | SYM15820 |
|---|---|---|---|---|---|---|
| N-acetyl-D-Galactosamine | NO | NO | NO | NO | NO | NO |
| Gentiobiose | NO | YES | YES | NO | NO | NO |
| D-Raffinose | YES | YES | YES | YES | YES | NO |
| Capric acid | NO | NO | NO | NO | YES | NO |
| D-lactic acid methyl ester | NO | NO | NO | NO | YES | NO |
| Acetamide | NO | NO | NO | NO | NO | NO |
| L-Ornithine | YES | NO | YES | NO | NO | YES |
| Chondrointin sulfate C | NO | NO | NO | NO | NO | NO |
| N-acetyl-neuraminic acid | NO | NO | NO | NO | NO | NO |
| L-glucose | NO | NO | NO | NO | NO | NO |
| Salicin | NO | NO | YES | NO | YES | NO |
| Caproic acid | NO | NO | NO | NO | YES | NO |
| Malonic acid | NO | NO | YES | NO | NO | NO |
| L-Alaninamide | NO | NO | YES | NO | YES | NO |
| L-Phenylalanine | NO | NO | YES | NO | NO | NO |
| a-Cyclodextrin | YES | YES | YES | YES | YES | NO |
| β-D-allose | NO | NO | NO | NO | NO | NO |
| Lactitol | NO | NO | NO | NO | YES | NO |
| Sedoheptulosan | NO | NO | NO | NO | NO | NO |
| Citraconic acid | NO | NO | NO | NO | NO | NO |
| Melibionic acid | NO | NO | NO | NO | NO | NO |
| N-Acetyl-L-Glutamic acid | NO | NO | NO | NO | NO | YES |
| L-Pyroglutamic acid | NO | YES | YES | NO | YES | YES |
| β-Cyclodextrin | NO | NO | NO | NO | NO | NO |
| Amygdalin | NO | NO | YES | NO | NO | NO |
| D-Melezitose | YES | YES | YES | NO | YES | NO |
| L-Sorbose | NO | YES | YES | NO | NO | NO |
| Citramalic acid | NO | NO | NO | NO | NO | NO |
| Oxalic acid | NO | YES | NO | NO | NO | NO |
| L-Arginine | NO | NO | YES | NO | NO | YES |
| L-Valine | NO | NO | NO | NO | NO | YES |
| γ-Cyclodextrin | NO | YES | NO | NO | NO | NO |
| D-arabinose | NO | NO | NO | NO | NO | NO |
| Maltitol | NO | YES | YES | NO | NO | NO |
| Stachyose | YES | YES | YES | NO | NO | NO |
| D-Glucosamine | NO | NO | NO | NO | NO | NO |
| Oxalomalic acid | NO | NO | NO | NO | NO | NO |
| Glycine | NO | NO | NO | NO | YES | NO |
| D,L-Carnitine | NO | NO | NO | NO | NO | NO |
| Dextrin | YES | NO | YES | NO | YES | NO |
| D-arabitol | YES | NO | YES | NO | NO | NO |
| a-Methyl-D-Glucoside | NO | NO | NO | NO | NO | NO |
| D-Tagatose | NO | NO | NO | NO | NO | NO |
| 2-Hydroxy benzoic acid | NO | NO | NO | NO | NO | NO |
| Quinic acid | NO | NO | YES | NO | YES | NO |
| L-Histidine | NO | YES | NO | NO | YES | YES |
| Sec-Butylamine | NO | NO | NO | NO | NO | NO |
| Gelatin | NO | NO | YES | NO | NO | YES |
| L-arabitol | NO | NO | NO | NO | NO | NO |
| β-Methyl-D-Galactoside | NO | YES | NO | NO | NO | NO |
| Turanose | YES | YES | YES | YES | NO | NO |
| 4-Hydroxy benzoic acid | NO | NO | NO | NO | NO | NO |
| D-Ribono-1,4-Lactone | NO | NO | NO | NO | YES | NO |
| L-Homoserine | NO | NO | NO | NO | NO | NO |
| D,L-Octopamine | NO | NO | NO | NO | YES | YES |
| Glycogen | NO | YES | YES | NO | NO | NO |
| Arbutin | NO | YES | YES | NO | NO | NO |
| 3-Methyl Glucose | NO | NO | NO | NO | NO | NO |
| Xylitol | NO | NO | NO | NO | YES | NO |
| β-Hydroxy butyric acid | NO | NO | YES | NO | NO | NO |
| Sebacic acid | NO | NO | NO | NO | NO | NO |
| Hydroxy-L-Proline | NO | NO | YES | NO | YES | YES |
| Putrescine | YES | YES | YES | NO | NO | NO |
| Inulin | NO | NO | NO | NO | NO | NO |
| 2-Deoxy-D-Ribose | NO | NO | NO | NO | NO | NO |
| β-Methyl-D-Glucuronic acid | NO | NO | NO | NO | NO | NO |
| N-Acetyl-D-glucosaminitol | NO | NO | NO | NO | NO | NO |
| γ-Hydroxy butyric acid | NO | NO | NO | NO | YES | NO |
| Sorbic acid | NO | NO | NO | NO | NO | NO |
| L-Isoleucine | NO | NO | YES | NO | NO | YES |
| Dihydroxy acetone | NO | NO | NO | NO | NO | NO |
| Laminarin | NO | NO | YES | NO | NO | NO |
| i-Erythritol | NO | NO | NO | NO | NO | NO |
| a-Methyl-D-Mannoside | NO | NO | NO | NO | NO | NO |
| γ-amino butyric acid | NO | YES | YES | NO | YES | NO |

TABLE T-continued

Substrate utilization as determined by BIOLOG PM2A MicroPlates by fungal endophytes belonging to core OTUs.

| | | | | | | |
|---|---|---|---|---|---|---|
| a-Keto-valeric acid | NO | NO | NO | NO | NO | NO |
| Succinamic acid | NO | NO | NO | NO | NO | NO |
| L-Leucine | NO | NO | YES | YES | NO | NO |
| 2,3-Butanediol | NO | NO | NO | NO | NO | NO |
| Mannan | NO | NO | NO | NO | NO | NO |
| D-Fucose | NO | NO | NO | NO | NO | NO |
| β-Methyl-D-Xyloside | NO | NO | NO | NO | NO | NO |
| d-amino valeric acid | NO | NO | NO | NO | NO | NO |
| Itaconic acid | NO | NO | NO | NO | YES | NO |
| D-Tartaric acid | NO | NO | NO | NO | NO | NO |
| L-Lysine | NO | NO | YES | NO | NO | NO |
| 2,3-Butanone | NO | NO | NO | NO | NO | NO |
| Pectin | NO | NO | YES | NO | NO | NO |
| 3-0-β-D-Galactopyranosyl-D-arabinose | NO | NO | NO | NO | NO | NO |
| Palatinose | YES | YES | YES | NO | YES | NO |
| Butyric acid | NO | NO | NO | NO | YES | NO |
| 5-Keto-D-Gluconic acid | NO | NO | NO | NO | NO | NO |
| L-Tartaric acid | NO | NO | YES | NO | YES | NO |
| L-Methionine | NO | NO | NO | NO | NO | NO |
| 3-Hydroxy 2-Butanone | NO | NO | NO | NO | NO | NO |

| Strain/Substrate | SYM15825 | SYM15828 | SYM15831 | SYM15837 | SYM15839 | SYM15847 |
|---|---|---|---|---|---|---|
| N-acetyl-D-Galactosamine | NO | NO | NO | NO | NO | NO |
| Gentiobiose | YES | NO | NO | NO | YES | YES |
| D-Raffinose | YES | NO | YES | YES | YES | YES |
| Capric acid | NO | NO | NO | NO | NO | NO |
| D-lactic acid methyl ester | NO | NO | NO | NO | NO | NO |
| Acetamide | NO | NO | NO | NO | NO | NO |
| L-Ornithine | YES | YES | YES | YES | YES | YES |
| Chondrointin sulfate C | NO | NO | NO | NO | NO | NO |
| N-acetyl-neuraminic acid | NO | NO | NO | NO | NO | NO |
| L-glucose | NO | NO | NO | NO | NO | NO |
| Salicin | YES | NO | YES | NO | YES | YES |
| Caproic acid | NO | NO | NO | NO | NO | NO |
| Malonic acid | YES | NO | NO | YES | NO | NO |
| L-Alaninamide | YES | NO | NO | NO | NO | YES |
| L-Phenylalanine | YES | NO | NO | NO | YES | YES |
| a-Cyclodextrin | NO | YES | YES | YES | YES | YES |
| β-D-allose | NO | NO | NO | NO | NO | NO |
| Lactitol | NO | NO | NO | NO | NO | NO |
| Sedoheptulosan | NO | NO | NO | NO | NO | YES |
| Citraconic acid | NO | NO | NO | NO | NO | NO |
| Melibionic acid | NO | NO | NO | NO | NO | NO |
| N-Acetyl-L-Glutamic acid | NO | YES | NO | YES | NO | NO |
| L-Pyroglutamic acid | YES | YES | YES | YES | YES | YES |
| β-Cyclodextrin | NO | NO | NO | NO | NO | NO |
| Amygdalin | YES | NO | NO | YES | YES | YES |
| D-Melezitose | YES | NO | YES | YES | YES | YES |
| L-Sorbose | NO | NO | NO | YES | YES | NO |
| Citramalic acid | NO | NO | NO | NO | NO | NO |
| Oxalic acid | NO | NO | NO | NO | NO | NO |
| L-Arginine | YES | YES | YES | YES | YES | YES |
| L-Valine | YES | YES | NO | YES | YES | NO |
| γ-Cyclodextrin | YES | NO | NO | NO | YES | NO |
| D-arabinose | NO | NO | NO | NO | NO | NO |
| Maltitol | YES | NO | NO | NO | NO | NO |
| Stachyose | YES | NO | YES | YES | YES | YES |
| D-Glucosamine | NO | NO | YES | YES | YES | NO |
| Oxalomalic acid | NO | NO | NO | NO | NO | NO |
| Glycine | YES | NO | NO | NO | NO | YES |
| D,L-Carnitine | NO | NO | YES | YES | NO | NO |
| Dextrin | YES | NO | YES | YES | YES | NO |
| D-arabitol | YES | NO | NO | NO | NO | NO |
| a-Methyl-D-Glucoside | NO | NO | NO | NO | YES | NO |
| D-Tagatose | NO | NO | NO | NO | NO | NO |
| 2-Hydroxy benzoic acid | NO | NO | NO | NO | NO | NO |
| Quinic acid | YES | NO | NO | NO | YES | NO |
| L-Histidine | YES | YES | NO | NO | YES | NO |
| Sec-Butylamine | NO | NO | NO | NO | NO | NO |
| Gelatin | YES | YES | NO | YES | YES | YES |
| L-arabitol | NO | NO | NO | NO | NO | NO |
| β-Methyl-D-Galactoside | NO | NO | NO | YES | NO | NO |
| Turanose | YES | NO | YES | YES | YES | YES |
| 4-Hydroxy benzoic acid | NO | NO | NO | NO | NO | NO |
| D-Ribono-1,4-Lactone | NO | NO | NO | NO | NO | NO |

TABLE T-continued

Substrate utilization as determined by BIOLOG PM2A MicroPlates by fungal endophytes belonging to core OTUs.

| | | | | | | |
|---|---|---|---|---|---|---|
| L-Homoserine | NO | NO | NO | NO | NO | NO |
| D,L-Octopamine | NO | YES | NO | YES | NO | NO |
| Glycogen | YES | NO | YES | YES | YES | YES |
| Arbutin | YES | NO | NO | YES | YES | YES |
| 3-Methyl Glucose | NO | NO | NO | NO | NO | NO |
| Xylitol | NO | NO | NO | NO | NO | NO |
| β-Hydroxy butyric acid | NO | NO | NO | NO | NO | NO |
| Sebacic acid | YES | NO | NO | YES | NO | NO |
| Hydroxy-L-Proline | YES | YES | YES | YES | YES | YES |
| Putrescine | YES | YES | NO | NO | YES | YES |
| Inulin | NO | NO | NO | YES | NO | NO |
| 2-Deoxy-D-Ribose | NO | NO | NO | NO | NO | NO |
| β-Methyl-D-Glucuronic acid | NO | NO | NO | NO | NO | NO |
| N-Acetyl-D-glucosaminitol | NO | NO | NO | NO | NO | NO |
| γ-Hydroxy butyric acid | NO | NO | NO | NO | NO | NO |
| Sorbic acid | NO | NO | NO | NO | NO | NO |
| L-Isoleucine | YES | YES | YES | YES | YES | YES |
| Dihydroxy acetone | NO | NO | NO | NO | NO | NO |
| Laminarin | NO | NO | NO | NO | YES | NO |
| i-Erythritol | NO | NO | NO | YES | NO | NO |
| a-Methyl-D-Mannoside | NO | NO | NO | NO | NO | NO |
| γ-amino butyric acid | YES | NO | YES | YES | YES | YES |
| a-Keto-valeric acid | NO | NO | NO | YES | NO | NO |
| Succinamic acid | YES | NO | NO | YES | NO | YES |
| L-Leucine | YES | NO | NO | YES | YES | YES |
| 2,3-Butanediol | NO | NO | NO | NO | NO | NO |
| Mannan | NO | NO | NO | NO | NO | NO |
| D-Fucose | NO | NO | NO | NO | NO | NO |
| β-Methyl-D-Xyloside | NO | NO | NO | NO | NO | NO |
| d-amino valeric acid | NO | NO | NO | NO | NO | YES |
| Itaconic acid | NO | NO | NO | YES | NO | NO |
| D-Tartaric acid | NO | NO | NO | NO | NO | NO |
| L-Lysine | YES | NO | YES | YES | NO | YES |
| 2,3-Butanone | NO | NO | NO | NO | NO | NO |
| Pectin | YES | YES | YES | YES | YES | NO |
| 3-0-β-D-Galactopyranosyl-D-arabinose | YES | NO | NO | NO | NO | NO |
| Palatinose | YES | NO | YES | YES | YES | YES |
| Butyric acid | YES | YES | NO | YES | NO | NO |
| 5-Keto-D-Gluconic acid | NO | NO | NO | NO | NO | NO |
| L-Tartaric acid | YES | NO | NO | NO | NO | NO |
| L-Methionine | NO | NO | NO | NO | NO | NO |
| 3-Hydroxy 2-Butanone | NO | NO | NO | NO | NO | NO |

| Strain/Substrate | SYM15872 | SYM15890 | SYM15901 | SYM15920 | SYM15926 |
|---|---|---|---|---|---|
| N-acetyl-D-Galactosamine | NO | NO | NO | NO | NO |
| Gentiobiose | YES | NO | YES | YES | NO |
| D-Raffinose | YES | NO | YES | YES | NO |
| Capric acid | NO | NO | NO | NO | NO |
| D-lactic acid methyl ester | NO | NO | NO | NO | NO |
| Acetamide | NO | NO | NO | NO | NO |
| L-Ornithine | YES | YES | YES | YES | YES |
| Chondrointin sulfate C | YES | NO | NO | NO | NO |
| N-acetyl-neuraminic acid | NO | NO | NO | NO | NO |
| L-glucose | NO | NO | NO | NO | NO |
| Salicin | YES | NO | YES | YES | NO |
| Caproic acid | NO | NO | NO | NO | NO |
| Malonic acid | YES | NO | NO | NO | NO |
| L-Alaninamide | YES | NO | NO | NO | NO |
| L-Phenylalanine | YES | NO | YES | YES | NO |
| a-Cyclodextrin | YES | YES | YES | YES | YES |
| β-D-allose | NO | NO | NO | NO | NO |
| Lactitol | NO | NO | NO | NO | NO |
| Sedoheptulosan | YES | NO | NO | NO | NO |
| Citraconic acid | NO | NO | NO | NO | NO |
| Melibionic acid | NO | NO | NO | NO | NO |
| N-Acetyl-L-Glutamic acid | NO | NO | NO | NO | YES |
| L-Pyroglutamic acid | YES | YES | YES | YES | NO |
| β-Cyclodextrin | NO | NO | NO | NO | NO |
| Amygdalin | YES | NO | YES | YES | NO |
| D-Melezitose | YES | NO | YES | YES | NO |
| L-Sorbose | NO | NO | YES | NO | NO |
| Citramalic acid | NO | NO | NO | NO | NO |
| Oxalic acid | YES | NO | NO | NO | YES |
| L-Arginine | YES | NO | YES | YES | NO |
| L-Valine | YES | NO | YES | YES | YES |

TABLE T-continued

| Substrate utilization as determined by BIOLOG PM2A MicroPlates by fungal endophytes belonging to core OTUs. | | | | | |
|---|---|---|---|---|---|
| γ-Cyclodextrin | YES | NO | YES | YES | NO |
| D-arabinose | YES | NO | NO | NO | NO |
| Maltitol | YES | NO | YES | YES | YES |
| Stachyose | YES | NO | YES | YES | NO |
| D-Glucosamine | NO | NO | NO | NO | NO |
| Oxalomalic acid | NO | NO | NO | NO | NO |
| Glycine | YES | NO | YES | NO | NO |
| D,L-Carnitine | NO | NO | NO | NO | NO |
| Dextrin | YES | NO | YES | YES | YES |
| D-arabitol | YES | NO | YES | YES | NO |
| a-Methyl-D-Glucoside | YES | NO | NO | YES | NO |
| D-Tagatose | NO | NO | NO | NO | NO |
| 2-Hydroxy benzoic acid | NO | NO | NO | NO | NO |
| Quinic acid | YES | NO | NO | YES | NO |
| L-Histidine | YES | NO | YES | YES | YES |
| Sec-Butylamine | NO | NO | YES | NO | NO |
| Gelatin | YES | YES | YES | YES | YES |
| L-arabitol | YES | NO | NO | NO | NO |
| β-Methyl-D-Galactoside | YES | NO | NO | NO | NO |
| Turanose | YES | NO | YES | YES | NO |
| 4-Hydroxy benzoic acid | YES | NO | NO | NO | NO |
| D-Ribono-1,4-Lactone | NO | NO | NO | NO | NO |
| L-Homoserine | NO | NO | NO | NO | NO |
| D,L-Octopamine | YES | YES | NO | NO | NO |
| Glycogen | YES | NO | YES | YES | NO |
| Arbutin | YES | NO | YES | YES | NO |
| 3-Methyl Glucose | NO | NO | NO | NO | NO |
| Xylitol | YES | NO | NO | NO | NO |
| β-Hydroxy butyric acid | NO | YES | YES | YES | NO |
| Sebacic acid | YES | NO | NO | NO | NO |
| Hydroxy-L-Proline | YES | YES | YES | YES | YES |
| Putrescine | YES | NO | YES | YES | NO |
| Inulin | NO | YES | NO | NO | NO |
| 2-Deoxy-D-Ribose | NO | NO | NO | NO | NO |
| β-Methyl-D-Glucuronic acid | YES | NO | NO | NO | YES |
| N-Acetyl-D-glucosaminitol | NO | NO | NO | NO | NO |
| γ-Hydroxy butyric acid | NO | NO | NO | NO | NO |
| Sorbic acid | NO | NO | NO | NO | NO |
| L-Isoleucine | YES | NO | YES | YES | NO |
| Dihydroxy acetone | NO | NO | NO | NO | NO |
| Laminarin | NO | YES | NO | YES | NO |
| i-Erythritol | NO | NO | NO | NO | NO |
| a-Methyl-D-Mannoside | NO | NO | NO | NO | NO |
| γ-amino butyric acid | YES | NO | YES | YES | YES |
| a-Keto-valeric acid | YES | YES | NO | NO | NO |
| Succinamic acid | YES | NO | YES | NO | NO |
| L-Leucine | YES | NO | YES | YES | NO |
| 2,3-Butanediol | YES | NO | NO | NO | NO |
| Mannan | NO | NO | NO | NO | NO |
| D-Fucose | NO | NO | NO | NO | NO |
| β-Methyl-D-Xyloside | NO | NO | NO | NO | NO |
| d-amino valeric acid | YES | NO | YES | NO | YES |
| Itaconic acid | NO | NO | NO | NO | YES |
| D-Tartaric acid | NO | NO | NO | NO | NO |
| L-Lysine | YES | NO | YES | NO | NO |
| 2,3-Butanone | NO | NO | NO | NO | NO |
| Pectin | YES | NO | YES | YES | YES |
| 3-0-β-D-Galactopyranosyl-D-arabinose | YES | NO | NO | NO | NO |
| Palatinose | YES | YES | YES | YES | NO |
| Butyric acid | YES | NO | YES | YES | NO |
| 5-Keto-D-Gluconic acid | NO | NO | YES | NO | NO |
| L-Tartaric acid | YES | NO | YES | YES | NO |
| L-Methionine | NO | NO | NO | NO | NO |
| 3-Hydroxy 2-Butanone | NO | NO | NO | NO | NO |

TABLE U

Substrate utilization as determined by BIOLOG PM2A MicroPlates by fungal endophytes belonging to core OTUs.

| Strain/Substrate | SYM15928 | SYM15932 | SYM00160 | SYM00034 | SYM00566B | SYM00577 |
|---|---|---|---|---|---|---|
| N-acetyl-D-Galactosamine | NO | NO | NO | NO | NO | NO |
| Gentiobiose | YES | YES | YES | YES | NO | YES |
| D-Raffinose | YES | YES | YES | NO | NO | YES |
| Capric acid | NO | NO | NO | NO | NO | NO |
| D-lactic acid methyl ester | NO | NO | NO | NO | NO | NO |
| Acetamide | NO | NO | NO | NO | NO | NO |
| L-Ornithine | YES | YES | NO | YES | NO | YES |
| Chondrointin sulfate C | NO | YES | NO | NO | NO | NO |
| N-acetyl-neuraminic acid | NO | NO | NO | NO | NO | NO |
| L-glucose | NO | NO | NO | NO | NO | NO |
| Salicin | YES | YES | YES | YES | NO | YES |
| Caproic acid | NO | NO | NO | NO | NO | NO |
| Malonic acid | NO | NO | NO | NO | YES | NO |
| L-Alaninamide | NO | NO | NO | YES | NO | YES |
| L-Phenylalanine | NO | NO | NO | NO | NO | YES |
| a-Cyclodextrin | YES | YES | YES | YES | YES | NO |
| β-D-allose | YES | NO | NO | NO | NO | NO |
| Lactitol | NO | NO | NO | NO | NO | NO |
| Sedoheptulosan | NO | NO | NO | NO | NO | NO |
| Citraconic acid | NO | NO | NO | NO | NO | NO |
| Melibionic acid | NO | NO | NO | NO | NO | YES |
| N-Acetyl-L-Glutamic acid | NO | NO | NO | NO | NO | NO |
| L-Pyroglutamic acid | YES | NO | NO | YES | YES | YES |
| β-Cyclodextrin | NO | YES | YES | NO | NO | NO |
| Amygdalin | NO | YES | NO | YES | NO | YES |
| D-Melezitose | YES | YES | YES | YES | NO | YES |
| L-Sorbose | NO | NO | NO | NO | NO | YES |
| Citramalic acid | NO | NO | NO | NO | NO | NO |
| Oxalic acid | NO | YES | NO | NO | NO | NO |
| L-Arginine | YES | YES | NO | YES | NO | YES |
| L-Valine | NO | NO | NO | YES | NO | YES |
| γ-Cyclodextrin | YES | YES | YES | NO | NO | YES |
| D-arabinose | NO | NO | NO | NO | NO | NO |
| Maltitol | YES | YES | YES | NO | NO | YES |
| Stachyose | YES | YES | YES | NO | NO | YES |
| D-Glucosamine | NO | NO | NO | YES | NO | YES |
| Oxalomalic acid | NO | NO | NO | NO | NO | NO |
| Glycine | NO | NO | NO | NO | NO | NO |
| D,L-Carnitine | NO | NO | NO | NO | NO | NO |
| Dextrin | YES | YES | YES | YES | NO | YES |
| D-arabitol | YES | NO | NO | YES | NO | YES |
| a-Methyl-D-Glucoside | YES | NO | YES | NO | NO | NO |
| D-Tagatose | NO | NO | NO | NO | NO | NO |
| 2-Hydroxy benzoic acid | NO | NO | NO | NO | NO | NO |
| Quinic acid | NO | YES | NO | YES | NO | NO |
| L-Histidine | NO | NO | NO | NO | YES | YES |
| Sec-Butylamine | NO | NO | NO | NO | NO | NO |
| Gelatin | YES | YES | NO | YES | NO | YES |
| L-arabitol | NO | YES | NO | NO | NO | NO |
| β-Methyl-D-Galactoside | NO | YES | NO | YES | NO | NO |
| Turanose | YES | YES | YES | YES | NO | YES |
| 4-Hydroxy benzoic acid | NO | NO | NO | NO | NO | NO |
| D-Ribono-1,4-Lactone | NO | NO | NO | NO | NO | NO |
| L-Homoserine | NO | NO | NO | NO | NO | NO |
| D,L-Octopamine | NO | NO | NO | NO | NO | YES |
| Glycogen | YES | YES | YES | YES | NO | YES |
| Arbutin | YES | YES | YES | YES | NO | YES |
| 3-Methyl Glucose | NO | NO | NO | NO | NO | NO |
| Xylitol | NO | NO | YES | NO | YES | NO |
| β-Hydroxy butyric acid | YES | NO | NO | NO | YES | YES |
| Sebacic acid | NO | NO | NO | NO | NO | NO |
| Hydroxy-L-Proline | NO | NO | NO | NO | YES | YES |
| Putrescine | YES | NO | NO | YES | NO | YES |
| Inulin | YES | NO | NO | NO | NO | NO |
| 2-Deoxy-D-Ribose | NO | NO | NO | NO | NO | NO |
| β-Methyl-D-Glucuronic acid | NO | YES | NO | NO | NO | NO |
| N-Acetyl-D-glucosaminitol | NO | NO | NO | NO | NO | NO |
| γ-Hydroxy butyric acid | NO | NO | NO | NO | NO | NO |
| Sorbic acid | NO | NO | NO | NO | YES | NO |
| L-Isoleucine | NO | YES | NO | YES | NO | YES |
| Dihydroxy acetone | NO | NO | NO | NO | NO | NO |
| Laminarin | NO | NO | NO | YES | NO | NO |
| i-Erythritol | YES | NO | NO | YES | NO | NO |
| a-Methyl-D-Mannoside | NO | NO | NO | NO | NO | NO |
| γ-amino butyric acid | YES | NO | NO | YES | NO | YES |

TABLE U-continued

Substrate utilization as determined by BIOLOG PM2A MicroPlates by fungal endophytes belonging to core OTUs.

| | | | | | | |
|---|---|---|---|---|---|---|
| a-Keto-valeric acid | NO | YES | NO | NO | YES | NO |
| Succinamic acid | NO | NO | NO | YES | NO | NO |
| L-Leucine | NO | NO | NO | YES | NO | YES |
| 2,3-Butanediol | NO | NO | NO | NO | NO | NO |
| Mannan | NO | NO | NO | NO | NO | NO |
| D-Fucose | NO | YES | NO | NO | NO | NO |
| β-Methyl-D-Xyloside | NO | NO | NO | NO | NO | NO |
| d-amino valeric acid | NO | NO | NO | NO | NO | YES |
| Itaconic acid | NO | NO | NO | NO | NO | NO |
| D-Tartaric acid | NO | NO | NO | NO | NO | NO |
| L-Lysine | NO | NO | NO | YES | YES | NO |
| 2,3-Butanone | NO | NO | NO | NO | NO | NO |
| Pectin | YES | YES | YES | YES | NO | YES |
| 3-0-β-D-Galactopyranosyl-D-arabinose | NO | NO | NO | NO | NO | YES |
| Palatinose | YES | YES | YES | YES | NO | YES |
| Butyric acid | NO | NO | NO | NO | NO | NO |
| 5-Keto-D-Gluconic acid | NO | NO | NO | NO | NO | NO |
| L-Tartaric acid | NO | YES | NO | NO | NO | YES |
| L-Methionine | NO | NO | YES | NO | NO | NO |
| 3-Hydroxy 2-Butanone | NO | NO | NO | NO | NO | NO |

| Strain/Substrate | SYM00590 | SYM00603 | SYM00061A | SYM00622 | SYM00629 | SYM00066 |
|---|---|---|---|---|---|---|
| N-acetyl-D-Galactosamine | NO | NO | NO | NO | NO | NO |
| Gentiobiose | YES | NO | YES | NO | NO | NO |
| D-Raffinose | NO | NO | YES | NO | NO | YES |
| Capric acid | NO | YES | NO | NO | NO | NO |
| D-lactic acid methyl ester | NO | NO | NO | NO | NO | NO |
| Acetamide | NO | NO | NO | NO | NO | NO |
| L-Ornithine | YES | YES | YES | YES | YES | NO |
| Chondrointin sulfate C | NO | NO | NO | NO | NO | NO |
| N-acetyl-neuraminic acid | NO | NO | NO | NO | NO | NO |
| L-glucose | NO | NO | NO | NO | NO | NO |
| Salicin | YES | NO | YES | NO | NO | NO |
| Caproic acid | NO | NO | NO | NO | NO | NO |
| Malonic acid | NO | NO | YES | NO | NO | NO |
| L-Alaninamide | NO | YES | YES | NO | NO | NO |
| L-Phenylalanine | NO | YES | NO | NO | NO | NO |
| a-Cyclodextrin | NO | YES | YES | YES | NO | YES |
| β-D-allose | NO | NO | NO | NO | NO | NO |
| Lactitol | NO | NO | YES | NO | NO | NO |
| Sedoheptulosan | NO | NO | NO | NO | NO | NO |
| Citraconic acid | NO | NO | NO | NO | NO | NO |
| Melibionic acid | NO | NO | YES | NO | NO | NO |
| N-Acetyl-L-Glutamic acid | NO | YES | NO | YES | YES | NO |
| L-Pyroglutamic acid | NO | YES | YES | YES | NO | NO |
| β-Cyclodextrin | NO | NO | NO | NO | NO | NO |
| Amygdalin | NO | NO | NO | NO | NO | NO |
| D-Melezitose | NO | NO | YES | NO | NO | NO |
| L-Sorbose | NO | NO | NO | NO | NO | NO |
| Citramalic acid | NO | NO | NO | NO | NO | NO |
| Oxalic acid | NO | NO | NO | NO | NO | NO |
| L-Arginine | NO | YES | YES | YES | YES | NO |
| L-Valine | NO | YES | NO | YES | YES | NO |
| γ-Cyclodextrin | NO | NO | YES | NO | NO | NO |
| D-arabinose | NO | NO | NO | NO | NO | NO |
| Maltitol | NO | NO | YES | NO | NO | NO |
| Stachyose | NO | NO | YES | NO | NO | NO |
| D-Glucosamine | NO | YES | NO | YES | NO | NO |
| Oxalomalic acid | NO | NO | NO | NO | NO | NO |
| Glycine | NO | NO | NO | NO | NO | NO |
| D,L-Carnitine | NO | YES | NO | YES | NO | NO |
| Dextrin | NO | NO | YES | NO | NO | NO |
| D-arabitol | NO | NO | YES | NO | YES | NO |
| a-Methyl-D-Glucoside | NO | NO | NO | NO | NO | NO |
| D-Tagatose | NO | NO | NO | NO | NO | NO |
| 2-Hydroxy benzoic acid | NO | NO | NO | NO | NO | NO |
| Quinic acid | NO | YES | NO | NO | NO | NO |
| L-Histidine | NO | YES | YES | YES | NO | NO |
| Sec-Butylamine | NO | NO | NO | NO | NO | NO |
| Gelatin | YES | NO | YES | NO | NO | NO |
| L-arabitol | NO | NO | YES | NO | NO | NO |
| β-Methyl-D-Galactoside | NO | NO | YES | NO | NO | NO |
| Turanose | NO | NO | YES | NO | NO | NO |
| 4-Hydroxy benzoic acid | NO | NO | YES | NO | NO | NO |
| D-Ribono-1,4-Lactone | NO | NO | NO | NO | NO | NO |

TABLE U-continued

Substrate utilization as determined by BIOLOG PM2A MicroPlates by fungal endophytes belonging to core OTUs.

| | | | | | | |
|---|---|---|---|---|---|---|
| L-Homoserine | NO | NO | YES | NO | NO | NO |
| D,L-Octopamine | NO | YES | YES | YES | YES | NO |
| Glycogen | YES | NO | YES | YES | NO | NO |
| Arbutin | YES | NO | YES | NO | NO | NO |
| 3-Methyl Glucose | NO | NO | NO | NO | NO | NO |
| Xylitol | NO | NO | NO | NO | NO | NO |
| β-Hydroxy butyric acid | NO | NO | NO | NO | NO | NO |
| Sebacic acid | NO | NO | YES | YES | NO | NO |
| Hydroxy-L-Proline | YES | YES | YES | YES | YES | NO |
| Putrescine | NO | YES | YES | NO | NO | NO |
| Inulin | YES | NO | NO | YES | YES | NO |
| 2-Deoxy-D-Ribose | NO | NO | NO | NO | NO | NO |
| β-Methyl-D-Glucuronic acid | NO | NO | YES | NO | NO | NO |
| N-Acetyl-D-glucosaminitol | NO | NO | NO | NO | NO | NO |
| γ-Hydroxy butyric acid | NO | NO | YES | NO | NO | NO |
| Sorbic acid | NO | NO | YES | NO | NO | NO |
| L-Isoleucine | NO | YES | NO | YES | YES | NO |
| Dihydroxy acetone | NO | NO | NO | NO | NO | NO |
| Laminarin | NO | NO | YES | NO | NO | NO |
| i-Erythritol | YES | NO | NO | NO | YES | NO |
| a-Methyl-D-Mannoside | NO | NO | NO | NO | NO | NO |
| γ-amino butyric acid | YES | YES | YES | YES | YES | NO |
| a-Keto-valeric acid | NO | NO | YES | NO | NO | NO |
| Succinamic acid | NO | NO | YES | NO | NO | NO |
| L-Leucine | NO | YES | NO | YES | YES | NO |
| 2,3-Butanediol | NO | NO | YES | NO | NO | NO |
| Mannan | NO | NO | NO | NO | NO | NO |
| D-Fucose | NO | NO | NO | NO | NO | NO |
| β-Methyl-D-Xyloside | NO | NO | NO | NO | NO | NO |
| d-amino valeric acid | NO | NO | YES | NO | NO | NO |
| Itaconic acid | NO | NO | NO | NO | NO | NO |
| D-Tartaric acid | NO | NO | NO | NO | NO | NO |
| L-Lysine | NO | NO | YES | NO | NO | NO |
| 2,3-Butanone | NO | NO | NO | NO | NO | NO |
| Pectin | NO | NO | YES | NO | NO | NO |
| 3-0-β-D-Galactopyranosyl-D-arabinose | NO | NO | NO | NO | NO | NO |
| Palatinose | YES | NO | NO | NO | NO | NO |
| Butyric acid | NO | NO | YES | NO | NO | NO |
| 5-Keto-D-Gluconic acid | NO | NO | NO | NO | NO | NO |
| L-Tartaric acid | NO | NO | YES | NO | NO | NO |
| L-Methionine | NO | NO | NO | NO | NO | NO |
| 3-Hydroxy 2-Butanone | NO | NO | NO | NO | NO | NO |

| Strain/Substrate | SYM00663 | SYM00696 | SYM00741A | SYM00741B | SYM00854 | SYM00880 |
|---|---|---|---|---|---|---|
| N-acetyl-D-Galactosamine | NO | NO | NO | NO | NO | YES |
| Gentiobiose | NO | YES | YES | NO | NO | NO |
| D-Raffinose | NO | YES | YES | NO | YES | NO |
| Capric acid | NO | NO | NO | NO | NO | NO |
| D-lactic acid methyl ester | NO | NO | NO | NO | NO | NO |
| Acetamide | NO | YES | NO | NO | NO | YES |
| L-Ornithine | YES | YES | YES | YES | NO | NO |
| Chondrointin sulfate C | NO | YES | YES | NO | NO | NO |
| N-acetyl-neuraminic acid | NO | NO | NO | NO | NO | YES |
| L-glucose | NO | NO | YES | NO | NO | NO |
| Salicin | NO | YES | NO | NO | NO | NO |
| Caproic acid | NO | YES | NO | NO | NO | NO |
| Malonic acid | NO | NO | NO | NO | NO | NO |
| L-Alaninamide | NO | YES | NO | YES | NO | YES |
| L-Phenylalanine | NO | NO | YES | NO | NO | NO |
| a-Cyclodextrin | NO | NO | NO | YES | NO | YES |
| β-D-allose | NO | YES | NO | NO | NO | YES |
| Lactitol | NO | YES | YES | NO | NO | YES |
| Sedoheptulosan | NO | NO | YES | NO | NO | YES |
| Citraconic acid | NO | YES | NO | NO | NO | YES |
| Melibionic acid | NO | NO | YES | NO | NO | NO |
| N-Acetyl-L-Glutamic acid | NO | YES | NO | YES | NO | YES |
| L-Pyroglutamic acid | YES | NO | YES | YES | YES | YES |
| β-Cyclodextrin | NO | NO | YES | NO | NO | YES |
| Amygdalin | NO | NO | YES | NO | YES | YES |
| D-Melezitose | NO | YES | YES | NO | NO | YES |
| L-Sorbose | NO | NO | YES | NO | NO | NO |
| Citramalic acid | NO | NO | NO | NO | NO | YES |
| Oxalic acid | NO | YES | NO | NO | NO | YES |
| L-Arginine | YES | YES | YES | YES | YES | YES |
| L-Valine | NO | YES | YES | YES | NO | YES |

TABLE U-continued

Substrate utilization as determined by BIOLOG PM2A MicroPlates by fungal endophytes belonging to core OTUs.

| | | | | | | |
|---|---|---|---|---|---|---|
| γ-Cyclodextrin | NO | YES | NO | NO | YES | NO |
| D-arabinose | NO | YES | NO | NO | NO | NO |
| Maltitol | NO | YES | YES | NO | YES | YES |
| Stachyose | NO | YES | YES | NO | YES | YES |
| D-Glucosamine | NO | NO | NO | NO | NO | NO |
| Oxalomalic acid | NO | NO | NO | NO | NO | NO |
| Glycine | NO | YES | YES | NO | NO | YES |
| D,L-Carnitine | NO | NO | NO | YES | NO | NO |
| Dextrin | NO | YES | YES | NO | YES | YES |
| D-arabitol | NO | YES | YES | NO | YES | NO |
| a-Methyl-D-Glucoside | NO | NO | YES | NO | NO | NO |
| D-Tagatose | YES | NO | NO | NO | NO | NO |
| 2-Hydroxy benzoic acid | NO | YES | YES | NO | NO | NO |
| Quinic acid | NO | YES | NO | NO | NO | YES |
| L-Histidine | NO | YES | NO | YES | NO | NO |
| Sec-Butylamine | NO | NO | NO | NO | NO | NO |
| Gelatin | NO | YES | YES | YES | YES | NO |
| L-arabitol | NO | YES | NO | NO | NO | YES |
| β-Methyl-D-Galactoside | NO | YES | NO | NO | NO | NO |
| Turanose | NO | YES | NO | NO | YES | YES |
| 4-Hydroxy benzoic acid | NO | YES | NO | NO | NO | YES |
| D-Ribono-1,4-Lactone | YES | YES | NO | NO | YES | YES |
| L-Homoserine | NO | NO | NO | NO | NO | NO |
| D,L-Octopamine | NO | NO | YES | YES | YES | NO |
| Glycogen | YES | YES | YES | NO | YES | YES |
| Arbutin | NO | YES | YES | YES | YES | YES |
| 3-Methyl Glucose | NO | NO | YES | NO | NO | NO |
| Xylitol | NO | NO | NO | NO | NO | YES |
| β-Hydroxy butyric acid | NO | YES | YES | NO | NO | NO |
| Sebacic acid | NO | NO | NO | NO | NO | NO |
| Hydroxy-L-Proline | YES | NO | YES | YES | YES | YES |
| Putrescine | NO | YES | YES | NO | NO | YES |
| Inulin | NO | YES | YES | YES | NO | YES |
| 2-Deoxy-D-Ribose | NO | NO | NO | NO | NO | NO |
| β-Methyl-D-Glucuronic acid | NO | YES | NO | NO | NO | NO |
| N-Acetyl-D-glucosaminitol | NO | YES | NO | NO | NO | YES |
| γ-Hydroxy butyric acid | NO | YES | NO | NO | NO | NO |
| Sorbic acid | NO | NO | NO | NO | NO | NO |
| L-Isoleucine | NO | YES | YES | YES | NO | YES |
| Dihydroxy acetone | NO | NO | NO | NO | NO | NO |
| Laminarin | NO | NO | NO | NO | NO | NO |
| i-Erythritol | NO | YES | NO | YES | YES | NO |
| a-Methyl-D-Mannoside | NO | YES | NO | NO | NO | NO |
| γ-amino butyric acid | NO | YES | YES | YES | YES | YES |
| a-Keto-valeric acid | NO | YES | NO | NO | NO | YES |
| Succinamic acid | NO | YES | YES | NO | YES | YES |
| L-Leucine | NO | NO | YES | YES | NO | NO |
| 2,3-Butanediol | NO | YES | NO | NO | NO | YES |
| Mannan | NO | YES | NO | NO | NO | YES |
| D-Fucose | NO | YES | NO | NO | NO | YES |
| β-Methyl-D-Xyloside | NO | NO | NO | NO | NO | NO |
| d-amino valeric acid | NO | NO | NO | NO | NO | NO |
| Itaconic acid | NO | YES | NO | NO | NO | NO |
| D-Tartaric acid | NO | YES | NO | NO | NO | NO |
| L-Lysine | NO | YES | YES | NO | NO | YES |
| 2,3-Butanone | NO | NO | NO | NO | NO | NO |
| Pectin | NO | YES | YES | NO | YES | YES |
| 3-0-β-D-Galactopyranosyl-D-arabinose | NO | YES | YES | YES | NO | YES |
| Palatinose | YES | YES | YES | NO | YES | YES |
| Butyric acid | NO | NO | NO | NO | YES | NO |
| 5-Keto-D-Gluconic acid | NO | YES | NO | NO | NO | NO |
| L-Tartaric acid | NO | NO | NO | NO | NO | NO |
| L-Methionine | NO | NO | NO | NO | NO | NO |
| 3-Hydroxy 2-Butanone | YES | NO | NO | NO | NO | NO |

Characterization of Culturable Microbes: Substrate Use

Additional BIOLOG analyses were performed. For additional biolog analyses, microbes were cultivated in three biological replicates for each strain. Each bacterium was initially streaked on Reasoner's 2A (R2A) agar, distinct CFUs selected and cultured in 6 mL R2A broth for 4 days. Fungal strains were streaked on potato dextrose (PD) agar and individual plugs containing spores and mycelial tissues were used to initiate growth in 6 mL PD broth for 6 days. All strains were grown with agitation at room temperature. One mL liquid cultures of each sample were harvested by centrifugation for 15 minutes at 4500 RPM and subsequently washed at least four times with sterile distilled water to remove any traces of residual media. Additionally, fungal cultures were first sonicated to achieve homogeneity after the growth period. Microbes were resuspended in 500 μL sterile distilled water and measurements of absorbance were taken using a SpectraMax M microplate reader (Molecular Devices, Sunnyvale, Calif.).

Sole carbon substrate assays were done using BIOLOG Phenotype MicroArray (PM) 1 and 2A MicroPlates (Hayward, Calif.). An aliquot of each bacterial cell culture corresponding to a final absorbance of 0.2 were inoculated into 20 mL sterile IF-0a GN/GP Base inoculating fluid (IF-0), 0.24 mL 100× Dye B obtained from BIOLOG, and brought to a final volume of 24 mL with sterile distilled water in 50 mL Falcon tubes. Negative control PM1 and PM2A assays were done similarly for each dye minus bacterial cells to detect abiotic reactions. Fungal culture of each strain with a final absorbance of 0.2 (~63% turbidity) was brought to a final volume of 24 mL with the FF-1F medium (BIOLOG). Microbial cell suspensions in tubes were gently shaken to achieve uniformity. One hundred microliters of the microbial cell suspension was added per well using a multichannel pipettor to the 96-well BIOLOG PM1 and PM2A MicroPlates that each contained 95 carbon sources and one water-only (negative control) well. All steps were performed under sterile conditions using biosafety cabinets.

MicroPlates were sealed in paper surgical tape (Dynarex, Orangeburg, N.Y.) to minimize plate edge effects, and incubated stationary at 24° C. in an enclosed container for a minimum of 72 hours. Absorbance at 590 nm was measured for all MicroPlates at least every 24 hours or at a defined interval (72 hours post-assay) to determine carbon substrate utilization for each strain. Measurements were normalized relative to the negative control (water only) well of each plate (Garland and Mills, 1991; Barua et al., 2010; Siemens et al., 2012; Blumenstein et al., 2015). Bacterial MicroPlates were also visually examined for the irreversible formation of violet color in wells indicating the reduction of the tetrazolium redox dye to formazan that result from cell respiration (Garland and Mills, 1991), and assessed against the negative control (no cells) PM1 and PM2A MicroPlates to detect any abiotic color changes potentially introduced by the medium and/or dyes (Borglin et al., 2012). Normalized absorbance values that were negative were considered as zero for subsequent analysis (Garland and Mills, 1991; Blumenstein et al., 2015) and a threshold value of 0.1 and above was used to indicate the ability of a particular microbial strain to use a given carbon substrate (Barua et al., 2010; Blumenstein et al., 2015). Fungal PM tests were measured as growth assays and visual observation of mycelial growth in each well was made.

TABLE V

Substrate utilization as determined by BIOLOG PM1 MicroPlates by bacterial endophytes belonging to OTUs present in cereal seeds, fruit seeds, vegetable seeds, and oil seeds.

| Strain/Substrate | SYM00021b | SYM00044 | SYM00057b | SYM00074 | SYM00091 | SYM00092d |
|---|---|---|---|---|---|---|
| 1,2-Propanediol | NO | NO | NO | NO | NO | NO |
| 2-Aminoethanol | NO | NO | NO | NO | NO | NO |
| 2'-Deoxyadenosine | YES | YES | YES | YES | YES | YES |
| a-D-Glucose | YES | YES | YES | YES | YES | YES |
| a-D-Lactose | YES | YES | YES | YES | YES | YES |
| a-Hydroxybutyric acid | NO | NO | NO | NO | YES | NO |
| a-Hydroxyglutaric acid-g-Lactone | NO | NO | NO | NO | YES | NO |
| a-Ketobutyric acid | NO | NO | NO | NO | YES | NO |
| a-Ketoglutaric acid | YES | NO | NO | NO | YES | NO |
| a-Methyl-D-Galactoside | YES | YES | YES | YES | YES | NO |
| Acetic acid | YES | YES | YES | YES | YES | YES |
| Acetoacetic acid | NO | NO | NO | NO | NO | NO |
| Adenosine | YES | YES | YES | YES | YES | YES |
| Adonitol | YES | YES | YES | YES | YES | NO |
| Ala-Gly | YES | YES | YES | YES | YES | YES |
| b-Methyl-D-Glucoside | YES | YES | YES | YES | YES | YES |
| Bromosuccinic acid | NO | NO | NO | YES | YES | YES |
| Citric acid | YES | YES | YES | YES | YES | YES |
| D-Alanine | YES | YES | YES | YES | YES | YES |
| D-Aspartic acid | NO | NO | NO | NO | NO | NO |
| D-Cellobiose | YES | YES | YES | YES | YES | YES |
| D-Fructose | YES | YES | YES | YES | YES | YES |
| D-Fructose-6-Phosphate | YES | YES | YES | YES | YES | YES |
| D-Galactonic acid-g-Lactone | YES | YES | YES | YES | YES | YES |
| D-Galactose | YES | YES | YES | YES | YES | YES |
| D-Galacturonic acid | YES | YES | YES | YES | YES | YES |
| D-Gluconic acid | YES | YES | YES | YES | YES | YES |
| D-Glucosaminic acid | YES | YES | YES | NO | YES | YES |
| D-Glucose-1-Phosphate | YES | YES | YES | YES | YES | YES |
| D-Glucose-6-Phosphate | YES | YES | YES | YES | YES | YES |
| D-Glucuronic acid | YES | YES | YES | YES | YES | YES |
| D-Malic acid | NO | NO | NO | NO | YES | NO |
| D-Mannitol | YES | YES | YES | YES | YES | YES |
| D-Mannose | YES | YES | YES | YES | YES | YES |
| D-Melibiose | YES | YES | YES | YES | YES | YES |
| D-Psicose | YES | NO | NO | NO | YES | YES |
| D-Ribose | YES | YES | YES | YES | YES | YES |
| D-Saccharic acid | YES | YES | YES | YES | YES | YES |
| D-Serine | NO | NO | NO | NO | NO | NO |
| D-Sorbitol | YES | YES | YES | YES | YES | NO |
| D-Threonine | NO | NO | NO | NO | NO | NO |
| D-Trehalose | YES | YES | YES | YES | YES | YES |

TABLE V-continued

Substrate utilization as determined by BIOLOG PM1 MicroPlates by bacterial endophytes belonging to OTUs present in cereal seeds, fruit seeds, vegetable seeds, and oil seeds.

| | | | | | | |
|---|---|---|---|---|---|---|
| D-Xylose | YES | YES | YES | YES | YES | YES |
| DL-a-Glycerol Phosphate | YES | YES | YES | YES | YES | YES |
| DL-Malic acid | YES | YES | YES | YES | YES | YES |
| Dulcitol | YES | YES | YES | YES | NO | YES |
| Formic acid | YES | YES | YES | NO | YES | YES |
| Fumaric acid | YES | YES | YES | YES | YES | YES |
| Glucuronamide | NO | NO | NO | YES | NO | NO |
| Gly-Asp | NO | YES | YES | YES | NO | YES |
| Gly-Glu | NO | YES | YES | YES | NO | YES |
| Gly-Pro | NO | YES | YES | YES | YES | YES |
| Glycerol | YES | YES | YES | YES | YES | YES |
| Glycolic acid | NO | NO | NO | NO | YES | NO |
| Glyoxylic acid | NO | YES | YES | NO | NO | NO |
| Inosine | YES | YES | YES | YES | YES | YES |
| L-Alanine | YES | YES | YES | YES | YES | YES |
| L-Arabinose | YES | YES | YES | YES | YES | YES |
| L-Asparagine | YES | YES | YES | YES | YES | YES |
| L-Aspartic acid | YES | YES | YES | YES | YES | YES |
| L-Fucose | NO | NO | NO | NO | YES | NO |
| L-Galactonic acid-g-Lactone | YES | YES | YES | YES | YES | YES |
| L-Glutamic acid | YES | YES | YES | YES | YES | YES |
| L-Glutamine | YES | YES | YES | YES | YES | YES |
| L-Lactic acid | YES | YES | YES | YES | YES | YES |
| L-Lyxose | NO | NO | NO | YES | YES | YES |
| L-Malic acid | YES | YES | YES | YES | YES | YES |
| L-Proline | YES | YES | YES | YES | YES | YES |
| L-Rhamnose | YES | YES | YES | YES | YES | YES |
| L-Serine | YES | YES | YES | YES | YES | YES |
| L-Threonine | NO | NO | NO | YES | YES | NO |
| Lactulose | NO | NO | NO | NO | YES | YES |
| m-Hydroxyphenyl Acetic acid | NO | YES | YES | YES | NO | NO |
| m-Inositol | YES | NO | NO | NO | YES | YES |
| m-Tartaric acid | YES | NO | NO | NO | YES | YES |
| Maltose | YES | YES | YES | YES | YES | YES |
| Maltotriose | YES | YES | YES | YES | YES | YES |
| Methylpyruvate | YES | YES | YES | YES | YES | YES |
| Mono-Methylsuccinate | NO | NO | NO | NO | YES | NO |
| Mucic acid | YES | YES | YES | YES | YES | YES |
| N-Acetyl-D-Glucosamine | YES | YES | YES | YES | YES | YES |
| N-Acetyl-D-Mannosamine | NO | NO | NO | NO | NO | NO |
| Negative Control | NO | NO | NO | NO | NO | NO |
| p-Hydroxyphenyl Acetic acid | NO | YES | YES | YES | YES | NO |
| Phenylethylamine | NO | NO | NO | NO | NO | NO |
| Propionic acid | NO | NO | NO | NO | YES | NO |
| Pyruvic acid | YES | YES | YES | YES | YES | YES |
| Succinic acid | YES | YES | YES | YES | YES | YES |
| Sucrose | YES | YES | YES | YES | YES | YES |
| Thymidine | YES | YES | YES | YES | NO | YES |
| Tricarballylic acid | NO | NO | NO | NO | NO | NO |
| Tween 20 | NO | NO | NO | YES | YES | YES |
| Tween 40 | YES | NO | NO | YES | YES | YES |
| Tween 80 | YES | NO | NO | YES | YES | YES |
| Tyramine | NO | NO | NO | NO | NO | NO |
| Uridine | NO | NO | NO | YES | YES | YES |

| Strain/Substrate | SYM00212 | SYM00290 | SYM00619 | SYM00865 | SYM00879 | SYM00879b |
|---|---|---|---|---|---|---|
| 1,2-Propanediol | NO | NO | NO | NO | NO | NO |
| 2-Aminoethanol | NO | NO | NO | NO | NO | NO |
| 2'-Deoxyadenosine | YES | NO | YES | YES | NO | YES |
| a-D-Glucose | YES | NO | YES | YES | YES | YES |
| a-D-Lactose | YES | NO | NO | YES | YES | YES |
| a-Hydroxybutyric acid | NO | YES | NO | NO | NO | YES |
| a-Hydroxyglutaric acid-g-Lactone | NO | NO | YES | YES | NO | YES |
| a-Ketobutyric acid | NO | YES | YES | NO | NO | YES |
| a-Ketoglutaric acid | NO | NO | YES | YES | YES | YES |
| a-Methyl-D-Galactoside | YES | NO | NO | YES | YES | YES |
| Acetic acid | YES | YES | YES | YES | YES | YES |
| Acetoacetic acid | NO | NO | NO | NO | NO | NO |
| Adenosine | YES | NO | YES | YES | NO | YES |
| Adonitol | YES | NO | YES | YES | NO | YES |
| Ala-Gly | YES | NO | YES | YES | NO | YES |

TABLE V-continued

Substrate utilization as determined by BIOLOG PM1 MicroPlates by bacterial endophytes belonging to OTUs present in cereal seeds, fruit seeds, vegetable seeds, and oil seeds.

| | | | | | | |
|---|---|---|---|---|---|---|
| b-Methyl-D-Glucoside | YES | YES | YES | YES | YES | YES |
| Bromosuccinic acid | YES | YES | YES | YES | YES | YES |
| Citric acid | NO | NO | YES | YES | YES | YES |
| D-Alanine | YES | YES | YES | YES | NO | YES |
| D-Aspartic acid | NO | NO | NO | NO | NO | NO |
| D-Cellobiose | YES | NO | YES | YES | YES | YES |
| D-Fructose | YES | YES | YES | YES | YES | YES |
| D-Fructose-6-Phosphate | YES | NO | NO | YES | NO | YES |
| D-Galactonic acid-g-Lactone | NO | NO | NO | NO | NO | NO |
| D-Galactose | YES | YES | NO | YES | NO | YES |
| D-Galacturonic acid | YES | NO | YES | YES | YES | YES |
| D-Gluconic acid | YES | YES | YES | YES | NO | YES |
| D-Glucosaminic acid | NO | NO | YES | YES | NO | YES |
| D-Glucose-1-Phosphate | YES | NO | NO | YES | NO | YES |
| D-Glucose-6-Phosphate | YES | YES | NO | YES | YES | YES |
| D-Glucuronic acid | YES | NO | YES | YES | NO | YES |
| D-Malic acid | NO | YES | YES | YES | NO | YES |
| D-Mannitol | YES | NO | YES | YES | YES | YES |
| D-Mannose | YES | YES | NO | YES | YES | YES |
| D-Melibiose | YES | NO | NO | YES | NO | YES |
| D-Psicose | NO | NO | NO | YES | NO | YES |
| D-Ribose | YES | YES | YES | YES | YES | YES |
| D-Saccharic acid | YES | YES | NO | YES | YES | YES |
| D-Serine | NO | NO | NO | NO | NO | NO |
| D-Sorbitol | NO | NO | NO | NO | NO | NO |
| D-Threonine | NO | NO | NO | NO | NO | NO |
| D-Trehalose | YES | YES | YES | YES | YES | YES |
| D-Xylose | YES | YES | YES | YES | NO | YES |
| DL-a-Glycerol Phosphate | YES | YES | YES | YES | NO | YES |
| DL-Malic acid | YES | YES | YES | YES | YES | YES |
| Dulcitol | NO | YES | NO | YES | NO | YES |
| Formic acid | NO | NO | NO | YES | YES | YES |
| Fumaric acid | YES | YES | YES | YES | YES | YES |
| Glucuronamide | NO | NO | NO | NO | NO | NO |
| Gly-Asp | YES | NO | NO | YES | NO | YES |
| Gly-Glu | YES | YES | YES | YES | YES | YES |
| Gly-Pro | YES | NO | YES | YES | YES | YES |
| Glycerol | YES | YES | YES | YES | NO | YES |
| Glycolic acid | NO | NO | NO | NO | NO | YES |
| Glyoxylic acid | NO | NO | NO | NO | NO | NO |
| Inosine | YES | NO | YES | YES | NO | YES |
| L-Alanine | YES | YES | NO | YES | NO | YES |
| L-Arabinose | YES | YES | YES | YES | YES | YES |
| L-Asparagine | YES | YES | YES | YES | NO | YES |
| L-Aspartic acid | YES | YES | YES | YES | YES | YES |
| L-Fucose | NO | NO | YES | NO | NO | YES |
| L-Galactonic acid-g-Lactone | YES | YES | YES | YES | YES | YES |
| L-Glutamic acid | YES | YES | YES | YES | NO | YES |
| L-Glutamine | YES | YES | YES | YES | YES | YES |
| L-Lactic acid | YES | YES | YES | YES | YES | YES |
| L-Lyxose | YES | YES | NO | NO | YES | NO |
| L-Malic acid | YES | YES | YES | YES | YES | YES |
| L-Proline | YES | YES | YES | YES | YES | YES |
| L-Rhamnose | YES | NO | NO | NO | NO | YES |
| L-Serine | YES | NO | YES | YES | NO | YES |
| L-Threonine | NO | NO | NO | YES | NO | NO |
| Lactulose | YES | NO | YES | YES | YES | YES |
| m-Hydroxyphenyl Acetic acid | YES | NO | YES | YES | NO | YES |
| m-Inositol | NO | NO | NO | YES | NO | YES |
| m-Tartaric acid | NO | NO | NO | YES | NO | YES |
| Maltose | YES | NO | YES | YES | YES | YES |
| Maltotriose | YES | NO | YES | YES | YES | YES |
| Methylpyruvate | YES | YES | YES | YES | YES | YES |
| Mono-Methylsuccinate | NO | YES | YES | YES | NO | YES |
| Mucic acid | NO | YES | NO | YES | NO | YES |
| N-Acetyl-D-Glucosamine | YES | YES | YES | YES | YES | YES |
| N-Acetyl-D-Mannosamine | YES | NO | NO | NO | NO | NO |
| Negative Control | NO | NO | NO | NO | NO | NO |
| p-Hydroxyphenyl Acetic acid | YES | NO | YES | NO | NO | YES |
| Phenylethylamine | NO | NO | NO | NO | NO | NO |
| Propionic acid | NO | NO | NO | YES | YES | YES |
| Pyruvic acid | YES | YES | YES | YES | YES | YES |

TABLE V-continued

Substrate utilization as determined by BIOLOG PM1 MicroPlates by bacterial endophytes belonging to OTUs present in cereal seeds, fruit seeds, vegetable seeds, and oil seeds.

| | | | | | | |
|---|---|---|---|---|---|---|
| Succinic acid | YES | YES | YES | YES | YES | YES |
| Sucrose | YES | NO | YES | YES | YES | YES |
| Thymidine | YES | NO | NO | YES | NO | YES |
| Tricarballylic acid | NO | NO | YES | NO | NO | YES |
| Tween 20 | NO | YES | YES | YES | YES | YES |
| Tween 40 | YES | YES | YES | YES | YES | YES |
| Tween 80 | YES | YES | YES | YES | YES | YES |
| Tyramine | NO | NO | NO | NO | NO | NO |
| Uridine | YES | YES | YES | YES | YES | YES |

| Strain/Substrate | SYM00906 | SYM00965 | SYM01004 | SYM01022 | SYM01158 |
|---|---|---|---|---|---|
| 1,2-Propanediol | NO | NO | YES | NO | NO |
| 2-Aminoethanol | NO | NO | YES | NO | YES |
| 2'-Deoxyadenosine | YES | YES | YES | YES | NO |
| a-D-Glucose | YES | YES | YES | YES | YES |
| a-D-Lactose | YES | YES | YES | YES | NO |
| a-Hydroxybutyric acid | YES | YES | NO | NO | YES |
| a-Hydroxyglutaric acid-g-Lactone | NO | YES | YES | YES | NO |
| a-Ketobutyric acid | YES | YES | NO | NO | YES |
| a-Ketoglutaric acid | YES | YES | YES | YES | YES |
| a-Methyl-D-Galactoside | YES | YES | YES | YES | NO |
| Acetic acid | YES | YES | YES | YES | YES |
| Acetoacetic acid | NO | NO | NO | NO | NO |
| Adenosine | YES | YES | YES | YES | NO |
| Adonitol | NO | YES | YES | NO | YES |
| Ala-Gly | YES | YES | YES | YES | YES |
| b-Methyl-D-Glucoside | YES | YES | YES | YES | NO |
| Bromosuccinic acid | YES | YES | YES | YES | YES |
| Citric acid | YES | YES | YES | YES | YES |
| D-Alanine | YES | YES | YES | YES | YES |
| D-Aspartic acid | NO | NO | NO | NO | NO |
| D-Cellobiose | YES | YES | YES | YES | YES |
| D-Fructose | YES | YES | YES | YES | YES |
| D-Fructose-6-Phosphate | YES | YES | YES | YES | NO |
| D-Galactonic acid-g-Lactone | NO | YES | YES | YES | YES |
| D-Galactose | YES | YES | YES | YES | YES |
| D-Galacturonic acid | NO | YES | YES | YES | NO |
| D-Gluconic acid | YES | YES | YES | YES | YES |
| D-Glucosaminic acid | NO | YES | YES | YES | YES |
| D-Glucose-1-Phosphate | NO | YES | YES | YES | NO |
| D-Glucose-6-Phosphate | NO | YES | YES | YES | NO |
| D-Glucuronic acid | YES | YES | YES | YES | YES |
| D-Malic acid | NO | YES | YES | YES | YES |
| D-Mannitol | YES | YES | YES | YES | NO |
| D-Mannose | YES | YES | YES | YES | YES |
| D-Melibiose | YES | YES | YES | YES | NO |
| D-Psicose | YES | YES | YES | YES | NO |
| D-Ribose | YES | YES | YES | YES | YES |
| D-Saccharic acid | NO | YES | YES | YES | NO |
| D-Serine | NO | NO | NO | NO | NO |
| D-Sorbitol | YES | YES | YES | YES | NO |
| D-Threonine | NO | NO | NO | NO | NO |
| D-Trehalose | YES | YES | YES | YES | YES |
| D-Xylose | YES | YES | YES | YES | YES |
| DL-a-Glycerol Phosphate | YES | YES | YES | YES | NO |
| DL-Malic acid | YES | YES | YES | YES | YES |
| Dulcitol | NO | YES | YES | NO | YES |
| Formic acid | NO | YES | YES | YES | NO |
| Fumaric acid | YES | YES | YES | YES | YES |
| Glucuronamide | NO | NO | NO | NO | NO |
| Gly-Asp | NO | YES | YES | NO | YES |
| Gly-Glu | YES | YES | YES | YES | YES |
| Gly-Pro | YES | YES | YES | YES | YES |
| Glycerol | YES | YES | YES | YES | NO |
| Glycolic acid | NO | YES | NO | YES | YES |
| Glyoxylic acid | NO | YES | NO | NO | NO |
| Inosine | YES | YES | YES | YES | NO |
| L-Alanine | YES | YES | YES | YES | YES |
| L-Arabinose | YES | YES | YES | YES | YES |
| L-Asparagine | YES | YES | YES | YES | YES |
| L-Aspartic acid | YES | YES | YES | YES | YES |
| L-Fucose | YES | YES | YES | YES | YES |
| L-Galactonic acid-g-Lactone | YES | YES | YES | YES | YES |

TABLE V-continued

Substrate utilization as determined by BIOLOG PM1 MicroPlates by bacterial endophytes belonging to OTUs present in cereal seeds, fruit seeds, vegetable seeds, and oil seeds.

| | | | | | |
|---|---|---|---|---|---|
| L-Glutamic acid | YES | YES | YES | YES | YES |
| L-Glutamine | YES | YES | YES | YES | YES |
| L-Lactic acid | YES | YES | YES | YES | YES |
| L-Lyxose | YES | YES | YES | NO | NO |
| L-Malic acid | YES | YES | YES | YES | YES |
| L-Proline | YES | YES | YES | YES | YES |
| L-Rhamnose | NO | YES | YES | NO | YES |
| L-Serine | YES | YES | YES | YES | YES |
| L-Threonine | YES | YES | YES | NO | NO |
| Lactulose | YES | YES | YES | YES | NO |
| m-Hydroxyphenyl Acetic acid | YES | YES | YES | YES | NO |
| m-Inositol | NO | YES | YES | YES | YES |
| m-Tartaric acid | NO | YES | YES | YES | NO |
| Maltose | NO | YES | YES | YES | YES |
| Maltotriose | YES | YES | YES | YES | YES |
| Methylpyruvate | YES | YES | YES | YES | YES |
| Mono-Methylsuccinate | YES | YES | YES | YES | NO |
| Mucic acid | NO | YES | YES | YES | NO |
| N-Acetyl-D-Glucosamine | YES | YES | YES | YES | YES |
| N-Acetyl-D-Mannosamine | NO | NO | YES | NO | NO |
| Negative Control | NO | NO | NO | NO | NO |
| p-Hydroxyphenyl Acetic acid | YES | YES | NO | YES | NO |
| Phenylethylamine | NO | YES | NO | YES | NO |
| Propionic acid | YES | YES | YES | YES | YES |
| Pyruvic acid | YES | YES | YES | YES | YES |
| Succinic acid | YES | YES | YES | YES | YES |
| Sucrose | YES | YES | YES | YES | YES |
| Thymidine | NO | YES | NO | YES | NO |
| Tricarballylic acid | NO | YES | NO | YES | NO |
| Tween 20 | YES | YES | YES | YES | NO |
| Tween 40 | YES | YES | YES | YES | NO |
| Tween 80 | YES | YES | YES | YES | YES |
| Tyramine | NO | YES | NO | NO | NO |
| Uridine | YES | YES | YES | YES | YES |

TABLE W

Substrate utilization as determined by BIOLOG PM1 MicroPlates by fungal endophytes belonging to OTUs present in cereal seeds, fruit seeds, vegetable seeds, and oil seeds.

| | SYM00157 | SYM00300 | SYM00301 | SYM00577 | SYM01314 | SYM01324 | SYM01326 | SYM01329 |
|---|---|---|---|---|---|---|---|---|
| 1,2-Propanediol | YES | YES | NO | YES | YES | NO | NO | YES |
| 2-Aminoethanol | YES | YES | YES | YES | YES | YES | YES | NO |
| 2'-Deoxyadenosine | YES | YES | YES | YES | YES | YES | YES | YES |
| a-D-Glucose | YES | YES | YES | YES | YES | YES | YES | YES |
| a-D-Lactose | YES | YES | YES | YES | YES | YES | YES | YES |
| a-Hydroxybutyric acid | NO | YES | YES | NO | YES | YES | NO | NO |
| a-Hydroxyglutaric acid-g-Lactone | YES | NO | NO | NO | YES | YES | YES | NO |
| a-Ketobutyric acid | YES | YES | YES | YES | YES | YES | YES | NO |
| a-Ketoglutaric acid | YES | YES | YES | YES | YES | YES | YES | YES |
| a-Methyl-D-Galactoside | YES | YES | YES | YES | YES | YES | YES | YES |
| Acetic acid | YES | YES | YES | YES | YES | YES | YES | YES |
| Acetoacetic acid | YES | NO | YES | NO | YES | NO | YES | NO |
| Adenosine | YES | YES | YES | YES | YES | YES | YES | NO |
| Adonitol | YES | YES | YES | YES | YES | YES | YES | YES |
| Ala-Gly | YES | YES | YES | YES | YES | YES | YES | YES |
| b-Methyl-D-Glucoside | YES | YES | YES | YES | YES | YES | YES | YES |
| Bromosuccinic acid | YES | YES | YES | YES | YES | YES | YES | NO |
| Citric acid | YES | YES | YES | YES | YES | YES | YES | YES |
| D-Alanine | YES | YES | YES | YES | YES | NO | YES | NO |
| D-Aspartic acid | NO | YES | NO | NO | YES | YES | YES | YES |
| D-Cellobiose | YES | YES | YES | YES | YES | YES | YES | YES |
| D-Fructose | YES | YES | YES | YES | YES | YES | YES | YES |
| D-Fructose-6-Phosphate | NO | YES | NO | NO | YES | NO | YES | YES |
| D-Galactonic acid-g-Lactone | NO | NO | NO | NO | NO | NO | NO | NO |
| D-Galactose | YES | YES | YES | YES | YES | YES | YES | YES |
| D-Galacturonic acid | YES | YES | YES | YES | YES | YES | YES | YES |
| D-Gluconic acid | YES | NO | YES | NO | YES | YES | YES | YES |
| D-Glucosaminic acid | YES | YES | YES | YES | YES | YES | YES | YES |
| D-Glucose-1-Phosphate | NO | YES | NO | NO | NO | NO | NO | NO |

TABLE W-continued

Substrate utilization as determined by BIOLOG PM1 MicroPlates by fungal endophytes belonging to OTUs present in cereal seeds, fruit seeds, vegetable seeds, and oil seeds.

| | | | | | | | | |
|---|---|---|---|---|---|---|---|---|
| D-Glucose-6-Phosphate | NO | YES | NO | NO | YES | NO | YES | NO |
| D-Glucuronic acid | YES | YES | YES | YES | YES | YES | YES | YES |
| D-Malic acid | NO | YES | YES | YES | YES | YES | YES | YES |
| D-Mannitol | YES | YES | YES | YES | YES | YES | YES | YES |
| D-Mannose | YES | YES | YES | YES | YES | YES | YES | YES |
| D-Melibiose | YES | YES | YES | YES | YES | YES | YES | YES |
| D-Psicose | YES | YES | YES | NO | NO | YES | YES | YES |
| D-Ribose | YES | YES | YES | YES | YES | YES | YES | YES |
| D-Saccharic acid | YES | YES | YES | NO | YES | YES | NO | YES |
| D-Serine | YES | YES | YES | YES | YES | YES | YES | NO |
| D-Sorbitol | YES | YES | YES | YES | YES | YES | YES | YES |
| D-Threonine | YES | NO | NO | NO | YES | NO | YES | YES |
| D-Trehalose | YES | YES | YES | YES | YES | YES | YES | YES |
| D-Xylose | YES | YES | YES | YES | YES | YES | YES | NO |
| DL-a-Glycerol Phosphate | NO | NO | NO | NO | YES | NO | YES | NO |
| DL-Malic acid | YES | YES | YES | YES | YES | YES | YES | YES |
| Dulcitol | YES | YES | YES | YES | YES | YES | YES | YES |
| Formic acid | YES | NO | YES | NO | YES | YES | YES | NO |
| Fumaric acid | YES | YES | YES | YES | YES | YES | YES | YES |
| Glucuronamide | NO | NO | NO | NO | NO | NO | YES | NO |
| Gly-Asp | YES | YES | YES | YES | YES | YES | YES | YES |
| Gly-Glu | YES | YES | YES | YES | YES | YES | YES | YES |
| Gly-Pro | YES | YES | YES | YES | YES | YES | YES | YES |
| Glycerol | YES | YES | YES | YES | YES | YES | YES | NO |
| Glycolic acid | NO | NO | NO | NO | YES | YES | NO | NO |
| Glyoxylic acid | YES | NO | NO | NO | YES | YES | NO | NO |
| Inosine | YES | YES | YES | NO | YES | YES | YES | NO |
| L-Alanine | YES | YES | YES | YES | YES | YES | YES | YES |
| L-Arabinose | YES | YES | YES | YES | YES | YES | YES | YES |
| L-Asparagine | YES | YES | YES | YES | YES | YES | YES | NO |
| L-Aspartic acid | YES | YES | YES | YES | YES | YES | YES | NO |
| L-Fucose | YES | YES | YES | YES | YES | YES | YES | YES |
| L-Galactonic acid-g-Lactone | YES | YES | YES | YES | YES | YES | YES | YES |
| L-Glulamic acid | YES | YES | YES | YES | YES | YES | YES | YES |
| L-Glutamine | YES | YES | YES | YES | YES | YES | YES | YES |
| L-Lactic acid | YES | YES | YES | YES | YES | YES | YES | NO |
| L-Lyxose | YES | YES | YES | YES | YES | NO | YES | NO |
| L-Malic acid | YES | YES | YES | YES | YES | YES | YES | YES |
| L-Proline | YES | YES | YES | YES | YES | YES | YES | YES |
| L-Rhamnose | YES | YES | YES | YES | YES | YES | YES | YES |
| L-Serine | YES | YES | YES | YES | YES | YES | YES | YES |
| L-Threonine | YES | YES | YES | YES | YES | YES | YES | YES |
| Lactulose | YES | YES | YES | YES | YES | YES | YES | YES |
| m-Hydroxyphenyl Acetic acid | YES | YES | YES | NO | YES | YES | NO | YES |
| m-Inositol | YES | YES | YES | YES | YES | YES | YES | YES |
| m-Tartaric acid | YES | YES | YES | NO | YES | YES | YES | YES |
| Maltose | YES | YES | YES | YES | YES | YES | YES | YES |
| Maltotriose | YES | YES | YES | YES | YES | YES | YES | YES |
| Methylpyruvate | YES | YES | YES | YES | YES | YES | YES | NO |
| Mono-Methylsuccinate | YES | YES | YES | YES | YES | YES | YES | NO |
| Mucic acid | YES | YES | YES | NO | YES | YES | NO | YES |
| N-Acetyl-D-Glucosamine | YES | YES | YES | YES | YES | YES | YES | YES |
| N-Acetyl-D-Mannosamine | NO | YES | NO | NO | YES | NO | YES | NO |
| Negative Control | NO | NO | NO | NO | NO | NO | NO | NO |
| p-Hydroxyphenyl Acetic acid | YES | NO | YES | YES | YES | YES | NO | NO |
| Phenylethylamine | NO | NO | NO | NO | YES | NO | YES | NO |
| Propionic acid | YES | YES | YES | YES | YES | YES | YES | NO |
| Pyruvic acid | YES | YES | YES | YES | YES | YES | YES | YES |
| Succinic acid | YES | YES | YES | YES | YES | YES | YES | YES |
| Sucrose | YES | YES | YES | YES | YES | YES | YES | YES |
| Thymidine | YES | NO | NO | NO | NO | YES | YES | NO |
| Tricarballylic acid | NO | NO | YES | YES | YES | YES | NO | NO |
| Tween 20 | YES | YES | YES | YES | YES | YES | YES | NO |
| Tween 40 | YES | YES | YES | YES | YES | YES | YES | YES |
| Tween 80 | YES | YES | YES | YES | YES | YES | YES | YES |
| Tyramine | YES | YES | YES | YES | YES | YES | YES | YES |
| Uridine | YES | NO | YES | YES | YES | NO | YES | YES |

| | SYM01330 | SYM01331 | SYM12462 | SYM15774 | SYM15783 | SYM15810 | SYM15879 | SYM15880 |
|---|---|---|---|---|---|---|---|---|
| 1,2-Propanediol | NO | NO | YES | NO | NO | YES | YES | NO |
| 2-Aminoethanol | NO | NO | NO | NO | YES | YES | YES | YES |
| 2'-Deoxyadenosine | NO | NO | NO | YES | YES | YES | YES | YES |
| a-D-Glucose | YES | YES | YES | YES | YES | YES | YES | YES |
| a-D-Lactose | YES | YES | YES | YES | YES | YES | YES | YES |
| a-Hydroxybutyric acid | YES | NO | NO | NO | YES | YES | YES | NO |
| a-Hydroxyglutaric acid-g-Lactone | YES | NO | YES | YES | YES | NO | YES | NO |

TABLE W-continued

Substrate utilization as determined by BIOLOG PM1 MicroPlates by fungal endophytes belonging to OTUs present in cereal seeds, fruit seeds, vegetable seeds, and oil seeds.

| | | | | | | | | |
|---|---|---|---|---|---|---|---|---|
| a-Ketobutyric acid | YES | NO | YES | YES | YES | YES | YES | YES |
| a-Ketoglutaric acid | YES | YES | YES | NO | YES | YES | YES | YES |
| a-Methyl-D-Galactoside | NO | YES | YES | YES | YES | YES | YES | YES |
| Acetic acid | NO | YES | YES | NO | YES | YES | YES | YES |
| Acetoacetic acid | NO | NO | YES | YES | YES | NO | YES | NO |
| Adenosine | NO | YES | YES | NO | YES | YES | YES | YES |
| Adonitol | NO | YES | YES | YES | YES | YES | YES | YES |
| Ala-Gly | YES | YES | YES | YES | YES | YES | YES | YES |
| b-Methyl-D-Glucoside | YES | YES | YES | YES | YES | YES | YES | YES |
| Bromosuccinic acid | YES | YES | YES | YES | YES | YES | YES | YES |
| Citric acid | YES | NO | YES | NO | YES | NO | YES | YES |
| D-Alanine | NO | NO | NO | NO | NO | YES | YES | YES |
| D-Aspartic acid | NO | YES | YES | YES | YES | YES | YES | NO |
| D-Cellobiose | YES | YES | YES | YES | YES | YES | YES | YES |
| D-Fructose | YES | YES | YES | YES | YES | YES | YES | YES |
| D-Fructose-6-Phosphate | YES | NO | NO | YES | NO | YES | YES | NO |
| D-Galactonic acid-g-Lactone | NO | NO | YES | NO | NO | NO | YES | NO |
| D-Galactose | YES | YES | YES | YES | YES | YES | YES | YES |
| D-Galacturonic acid | YES | YES | YES | YES | YES | YES | YES | YES |
| D-Gluconic acid | YES | YES | YES | YES | YES | YES | YES | YES |
| D-Glucosaminic acid | NO | NO | YES | YES | YES | NO | NO | NO |
| D-Glucose-1-Phosphate | YES | NO | YES | YES | NO | NO | NO | NO |
| D-Glucose-6-Phosphate | YES | NO | YES | YES | YES | YES | YES | NO |
| D-Glucuronic acid | YES | YES | YES | YES | YES | YES | YES | YES |
| D-Malic acid | NO | YES | NO | NO | YES | YES | YES | YES |
| D-Mannitol | YES | YES | YES | NO | YES | YES | YES | YES |
| D-Mannose | YES | YES | YES | YES | YES | YES | YES | YES |
| D-Melibiose | YES | YES | YES | YES | YES | YES | YES | YES |
| D-Psicose | NO | YES | NO | NO | YES | YES | YES | YES |
| D-Ribose | YES | YES | YES | YES | YES | YES | YES | YES |
| D-Saccharic acid | YES | YES | YES | NO | YES | YES | YES | YES |
| D-Serine | NO | NO | NO | NO | YES | YES | YES | NO |
| D-Sorbitol | YES | YES | YES | NO | YES | YES | YES | YES |
| D-Threonine | NO | YES | YES | YES | YES | NO | YES | NO |
| D-Trehalose | YES | YES | YES | YES | YES | YES | YES | YES |
| D-Xylose | YES | YES | YES | NO | YES | YES | YES | YES |
| DL-a-Glycerol Phosphate | YES | NO | NO | YES | YES | YES | YES | YES |
| DL-Malic acid | NO | YES | YES | YES | YES | YES | YES | YES |
| Dulcitol | NO | YES | YES | NO | YES | YES | YES | YES |
| Formic acid | NO | NO | NO | YES | NO | YES | YES | NO |
| Fumaric acid | NO | YES | YES | YES | YES | YES | YES | YES |
| Glucuronamide | NO | NO | NO | NO | NO | NO | YES | NO |
| Gly-Asp | NO | YES | YES | YES | YES | YES | YES | YES |
| Gly-Glu | YES | YES | YES | YES | YES | YES | YES | YES |
| Gly-Pro | YES | YES | YES | YES | YES | YES | YES | YES |
| Glycerol | YES | NO | YES | YES | YES | YES | YES | YES |
| Glycolic acid | YES | NO | NO | YES | YES | YES | NO | YES |
| Glyoxylic acid | NO | NO | YES | NO | YES | YES | YES | YES |
| Inosine | NO | YES | YES | NO | NO | YES | YES | YES |
| L-Alanine | YES | YES | YES | YES | YES | YES | YES | YES |
| L-Arabinose | YES | YES | YES | NO | YES | YES | YES | YES |
| L-Asparagine | YES | YES | YES | YES | YES | YES | YES | YES |
| L-Aspartic acid | NO | YES | YES | YES | YES | YES | YES | YES |
| L-Fucose | YES | YES | NO | YES | NO | YES | YES | NO |
| L-Galactonic acid-g-Lactone | YES | YES | YES | YES | YES | YES | YES | YES |
| L-Glulamic acid | NO | YES | YES | YES | YES | YES | YES | YES |
| L-Glutamine | YES | YES | YES | YES | YES | YES | YES | YES |
| L-Lactic acid | NO | YES | YES | YES | YES | YES | YES | YES |
| L-Lyxose | YES | YES | NO | NO | YES | YES | YES | YES |
| L-Malic acid | YES | YES | YES | YES | YES | YES | YES | YES |
| L-Proline | YES | YES | YES | NO | YES | YES | YES | YES |
| L-Rhamnose | YES | YES | YES | YES | YES | YES | YES | YES |
| L-Serine | YES | YES | YES | YES | YES | YES | YES | YES |
| L-Threonine | NO | NO | YES | YES | YES | YES | YES | YES |
| Lactulose | NO | YES | YES | YES | YES | YES | YES | NO |
| m-Hydroxyphenyl Acetic acid | NO | NO | YES | YES | YES | NO | NO | YES |
| m-Inositol | NO | YES | YES | YES | YES | YES | YES | YES |
| m-Tartaric acid | NO | YES | NO | NO | YES | YES | YES | NO |
| Maltose | YES | YES | YES | YES | YES | YES | YES | YES |
| Maltotriose | YES | YES | YES | YES | YES | YES | YES | YES |
| Methylpyruvate | YES | YES | YES | YES | YES | YES | YES | YES |
| Mono-Methylsuccinate | YES | YES | YES | YES | YES | YES | YES | YES |
| Mucic acid | NO | YES | YES | YES | YES | YES | YES | YES |
| N-Acetyl-D-Glucosamine | YES | YES | YES | YES | YES | YES | YES | YES |
| N-Acetyl-D-Mannosamine | YES | NO | NO | YES | YES | NO | NO | NO |
| Negative Control | NO | NO | NO | NO | NO | NO | NO | NO |
| p-Hydroxyphenyl Acetic acid | YES | YES | YES | NO | YES | YES | YES | YES |

TABLE W-continued

Substrate utilization as determined by BIOLOG PM1 MicroPlates by fungal endophytes belonging to OTUs present in cereal seeds, fruit seeds, vegetable seeds, and oil seeds.

| | | | | | | | | |
|---|---|---|---|---|---|---|---|---|
| Phenylethylamine | NO | NO | NO | NO | NO | NO | NO | YES |
| Propionic acid | NO | NO | YES | YES | YES | YES | YES | YES |
| Pyruvic acid | NO | YES | YES | YES | YES | YES | YES | YES |
| Succinic acid | NO | YES | YES | YES | YES | YES | YES | YES |
| Sucrose | YES | YES | YES | YES | YES | YES | YES | YES |
| Thymidine | NO | NO | YES | NO | NO | YES | YES | NO |
| Tricarballylic acid | NO | NO | NO | YES | YES | YES | NO | NO |
| Tween 20 | YES | YES | YES | YES | YES | YES | YES | YES |
| Tween 40 | YES | YES | YES | YES | YES | YES | YES | YES |
| Tween 80 | YES | YES | YES | YES | YES | YES | YES | YES |
| Tyramine | NO | YES | YES | NO | YES | YES | YES | YES |
| Uridine | NO | NO | NO | NO | NO | YES | YES | YES |

TABLE X

Substrate utilization as determined by BIOLOG PM2 MicroPlates by bacterial endophytes belonging to OTUs present in cereal seeds, fruit seeds, vegetable seeds, and oil seeds.

| | Substrate | | | | | | | | |
|---|---|---|---|---|---|---|---|---|---|
| Strain | SYM00021b | SYM00044 | SYM00057b | SYM00074 | SYM00091 | SYM00092d | SYM00212 | SYM00290 | SYM00619 |
| 2-Deoxy-D-Ribose | NO | YES | YES | YES | YES | NO | YES | YES | YES |
| 2-Hydroxybenzoic acid | NO | NO | NO | NO | NO | NO | NO | NO | NO |
| 2,3-Butanediol | YES | NO | NO | NO | NO | NO | NO | NO | NO |
| 2,3-Butanedione | NO | NO | NO | NO | NO | NO | NO | NO | NO |
| 3-Hydroxy-2-butanone | NO | NO | NO | YES | NO | NO | NO | NO | NO |
| 3-Methylglucose | NO | NO | NO | NO | NO | YES | NO | NO | NO |
| 3-O-b-D-Galactopyranosyl-D-Arabinose | YES | YES | YES | YES | YES | YES | NO | YES | NO |
| 4-Hydroxybenzoic acid | NO | NO | NO | NO | YES | NO | NO | NO | NO |
| 5-Keto-D-Gluconic acid | YES | YES | YES | NO | NO | YES | YES | YES | NO |
| a-Cyclodextrin | NO | NO | NO | YES | YES | YES | NO | NO | YES |
| a-Keto-Valeric acid | NO | NO | NO | NO | NO | NO | NO | YES | NO |
| a-Methyl-D-Glucoside | NO | NO | NO | NO | YES | YES | NO | NO | YES |
| a-Methyl-D-Mannoside | NO | NO | NO | NO | NO | NO | NO | NO | NO |
| Acetamide | YES | NO | NO | NO | NO | NO | NO | NO | NO |
| Amygdalin | YES | YES | YES | YES | YES | YES | NO | YES | YES |
| Arbutin | YES | YES | YES | YES | YES | YES | YES | NO | NO |
| b-Cyclodextrin | NO | NO | NO | NO | YES | YES | NO | YES | YES |
| b-D-Allose | NO | NO | NO | NO | NO | NO | NO | NO | NO |
| b-Hydroxybutyric acid | YES | NO | NO | NO | YES | NO | NO | YES | NO |
| b-Methyl-D-Galactoside | YES | YES | YES | YES | YES | YES | YES | NO | YES |
| b-Methyl-D-Glucuronic acid | NO | NO | NO | YES | NO | NO | NO | NO | NO |
| b-Methyl-D-Xyloside | NO | NO | NO | NO | NO | NO | NO | NO | NO |
| Butyric acid | NO | NO | NO | YES | NO | NO | NO | YES | NO |
| Capric acid | NO | NO | NO | NO | NO | NO | NO | NO | NO |
| Caproic acid | NO | NO | NO | NO | NO | NO | NO | YES | NO |
| Chondroitin Sulfate C | YES | NO | NO | YES | YES | NO | NO | NO | NO |
| Citraconic acid | NO | NO | NO | NO | NO | YES | NO | NO | NO |
| Citramalic acid | YES | NO | NO | NO | NO | NO | NO | NO | NO |
| d-Amino Valeric acid | NO | NO | NO | NO | YES | NO | NO | NO | NO |
| D-Arabinose | NO | NO | NO | NO | YES | YES | YES | YES | NO |
| D-Arabitol | YES | YES | YES | YES | YES | YES | YES | NO | YES |
| D-Fucose | YES | YES | YES | NO | YES | YES | NO | NO | NO |
| D-Glucosamine | YES | YES | YES | YES | YES | YES | YES | YES | YES |
| D-Lactic acid Methyl Ester | NO | NO | NO | YES | NO | NO | NO | YES | NO |
| D-Lactitol | NO | NO | NO | YES | YES | NO | NO | NO | NO |
| D-Melezitose | NO | NO | NO | NO | NO | NO | YES | NO | NO |
| D-Raffinose | YES | YES | YES | YES | YES | NO | YES | NO | NO |

TABLE X-continued

Substrate utilization as determined by BIOLOG PM2 MicroPlates by bacterial endophytes belonging to OTUs present in cereal seeds, fruit seeds, vegetable seeds, and oil seeds.

| | | | | | | | | | |
|---|---|---|---|---|---|---|---|---|---|
| D-Ribono-1,4-Lactone | YES | NO | NO | NO | NO | YES | NO | NO | NO |
| D-Tagatose | NO | NO | NO | NO | NO | NO | NO | NO | NO |
| D-Tartaric acid | YES | NO | NO | YES | NO | NO | NO | NO | NO |
| D,L-Carnitine | NO | NO | NO | NO | YES | NO | NO | NO | NO |
| D,L-Octopamine | NO | NO | NO | NO | NO | NO | NO | NO | NO |
| Dextrin | YES | YES | YES | YES | YES | YES | YES | YES | YES |
| Dihydroxyacetone | NO | NO | NO | YES | YES | YES | YES | YES | YES |
| g-Amino-N-Butyric acid | YES | NO | NO | NO | YES | YES | NO | NO | NO |
| g-Cyclodextrin | NO | NO | NO | NO | NO | NO | NO | NO | NO |
| g-Hydroxybutyric acid | NO | NO | NO | NO | NO | NO | NO | NO | NO |
| Gelatin | NO | NO | NO | YES | YES | NO | NO | YES | NO |
| Gentiobiose | YES | YES | YES | YES | YES | YES | YES | NO | YES |
| Glycine | NO | NO | NO | YES | NO | NO | NO | NO | NO |
| Glycogen | NO | YES | YES | YES | NO | YES | YES | YES | YES |
| Hydroxy-L-Proline | NO | NO | NO | NO | YES | NO | NO | NO | NO |
| i-Erythritol | YES | NO | NO | NO | YES | YES | YES | NO | NO |
| Inulin | NO | NO | NO | NO | NO | NO | NO | NO | NO |
| Itaconic acid | NO | NO | NO | NO | YES | NO | NO | NO | NO |
| L-Alaninamide | YES | NO | NO | YES | YES | YES | NO | YES | NO |
| L-Arabitol | NO | NO | NO | NO | YES | YES | NO | NO | NO |
| L-Arginine | YES | YES | YES | YES | YES | YES | NO | NO | NO |
| L-Glucose | NO | NO | NO | NO | NO | NO | NO | NO | NO |
| L-Histidine | YES | NO | NO | YES | YES | YES | YES | NO | NO |
| L-Homoserine | NO | NO | NO | NO | NO | NO | NO | NO | NO |
| L-Isoleucine | NO | NO | NO | NO | YES | NO | NO | NO | NO |
| L-Leucine | YES | NO | NO | NO | NO | NO | NO | NO | NO |
| L-Lysine | NO | NO | NO | NO | YES | NO | NO | NO | NO |
| L-Methionine | NO | NO | NO | NO | NO | YES | NO | NO | NO |
| L-Ornithine | YES | YES | YES | YES | YES | YES | YES | YES | NO |
| L-Phenylalanine | YES | NO | NO | YES | NO | NO | YES | NO | NO |
| L-Pyroglutamic acid | YES | NO | NO | YES | NO | YES | NO | NO | NO |
| L-Sorbose | NO | NO | NO | NO | NO | NO | NO | NO | NO |
| L-Tartaric acid | YES | YES | YES | NO | NO | YES | YES | NO | NO |
| L-Valine | NO | NO | NO | NO | NO | NO | NO | NO | NO |
| Laminarin | NO | NO | NO | NO | YES | NO | NO | YES | NO |
| Malonic acid | YES | NO | NO | YES | NO | NO | YES | NO | NO |
| Maltitol | YES | NO | NO | NO | YES | NO | NO | NO | NO |
| Mannan | NO | NO | NO | YES | NO | YES | YES | YES | NO |
| Melibionic acid | YES | YES | YES | YES | YES | NO | NO | YES | NO |
| N-Acetyl-D-Galactosamine | YES | NO | NO | NO | NO | NO | NO | NO | NO |
| N-Acetyl-D-Glucosaminitol | NO | NO | NO | NO | NO | NO | NO | NO | NO |
| N-Acetyl-L-Glutamic acid | NO | NO | NO | YES | NO | YES | NO | NO | NO |
| N-Acetyl-Neuraminic acid | NO | YES | YES | YES | NO | NO | YES | NO | NO |
| Negative Control. 1 | NO | NO | NO | NO | NO | NO | NO | NO | NO |
| Oxalic acid | NO | NO | NO | NO | NO | NO | NO | NO | NO |
| Oxalomalic acid | NO | NO | NO | NO | YES | YES | NO | YES | NO |
| Palatinose | YES | NO | NO | NO | YES | NO | NO | NO | YES |
| Pectin | YES | YES | YES | YES | YES | YES | YES | YES | NO |
| Putrescine | YES | NO | NO | YES | NO | NO | NO | NO | NO |
| Quinic acid | YES | NO | NO | NO | YES | YES | NO | NO | NO |
| Salicin | YES | YES | YES | YES | YES | YES | YES | NO | YES |
| Sebacic acid | YES | NO | NO | NO | NO | NO | NO | YES | YES |
| sec-Butylamine | NO | NO | NO | NO | NO | NO | NO | NO | NO |
| Sedoheptulosan | NO | NO | NO | NO | NO | NO | NO | NO | NO |
| Sorbic acid | NO | NO | NO | NO | NO | NO | NO | YES | NO |
| Stachyose | NO | NO | NO | NO | YES | NO | NO | NO | NO |
| Succinamic acid | YES | YES | YES | YES | YES | YES | YES | YES | NO |
| Turanose | YES | NO | NO | NO | YES | YES | NO | NO | YES |
| Xylitol | NO | NO | NO | NO | YES | NO | NO | NO | NO |

| | Substrate | | | | | | | |
|---|---|---|---|---|---|---|---|---|
| Strain | SYM00865 | SYM00879 | SYM00879b | SYM00906 | SYM00965 | SYM01004 | SYM01022 | SYM01158 |
| 2-Deoxy-D-Ribose | YES | YES | YES | YES | YES | NO | YES | YES |
| 2-Hydroxybenzoic acid | NO | NO | NO | NO | NO | NO | NO | NO |
| 2,3-Butanediol | NO | NO | YES | NO | YES | YES | NO | YES |
| 2,3-Butanedione | NO | NO | NO | NO | NO | NO | NO | NO |

TABLE X-continued

| Substrate utilization as determined by BIOLOG PM2 MicroPlates by bacterial endophytes belonging to OTUs present in cereal seeds, fruit seeds, vegetable seeds, and oil seeds. | | | | | | | | |
|---|---|---|---|---|---|---|---|---|
| 3-Hydroxy-2-butanone | NO | NO | NO | NO | NO | NO | YES | YES |
| 3-Methylglucose | NO | NO | YES | NO | YES | YES | YES | YES |
| 3-O-b-D-Galactopyranosyl-D-Arabinose | YES | YES | YES | YES | YES | YES | YES | YES |
| 4-Hydroxybenzoic acid | NO | NO | NO | NO | NO | YES | NO | YES |
| 5-Keto-D-Gluconic acid | YES | YES | YES | NO | YES | YES | YES | YES |
| a-Cyclodextrin | YES | NO | YES | NO | YES | YES | YES | NO |
| a-Keto-Valeric acid | NO | NO | NO | NO | YES | NO | YES | YES |
| a-Methyl-D-Glucoside | NO | NO | NO | YES | YES | YES | YES | YES |
| a-Methyl-D-Mannoside | NO | NO | YES | NO | NO | NO | NO | NO |
| Acetamide | NO | YES | NO | NO | YES | NO | NO | NO |
| Amygdalin | YES | YES | YES | YES | YES | YES | YES | YES |
| Arbutin | YES | YES | YES | YES | YES | YES | YES | YES |
| b-Cyclodextrin | NO | NO | YES | NO | YES | YES | YES | NO |
| b-D-Allose | NO | NO | NO | NO | YES | NO | NO | NO |
| b-Hydroxybutyric acid | NO | YES | YES | YES | YES | YES | YES | YES |
| b-Methyl-D-Galactoside | YES | YES | YES | YES | YES | YES | YES | YES |
| b-Methyl-D-Glucuronic acid | NO | NO | NO | NO | NO | NO | YES | YES |
| b-Methyl-D-Xyloside | NO | NO | YES | NO | YES | YES | NO | YES |
| Butyric acid | YES | YES | YES | YES | YES | YES | YES | YES |
| Capric acid | NO | NO | NO | NO | NO | NO | NO | NO |
| Caproic acid | NO | NO | NO | NO | NO | NO | NO | YES |
| Chondroitin Sulfate C | YES | YES | YES | YES | YES | NO | YES | YES |
| Citraconic acid | NO | NO | YES | NO | YES | YES | NO | YES |
| Citramalic acid | NO | NO | YES | NO | YES | YES | YES | YES |
| d-Amino Valeric acid | NO | NO | NO | NO | YES | NO | YES | YES |
| D-Arabinose | NO | YES | YES | YES | YES | YES | NO | YES |
| D-Arabitol | YES | NO | YES | NO | YES | YES | YES | YES |
| D-Fucose | NO | NO | NO | NO | YES | YES | NO | YES |
| D-Glucosamine | YES | YES | YES | YES | YES | YES | YES | YES |
| D-Lactic acid Methyl Ester | YES | YES | NO | NO | NO | YES | YES | YES |
| D-Lactitol | YES | YES | NO | YES | YES | YES | YES | YES |
| D-Melezitose | NO | NO | YES | YES | YES | YES | YES | YES |
| D-Raffinose | YES | NO | YES | YES | YES | YES | YES | YES |
| D-Ribono-1,4-Lactone | NO | NO | YES | YES | YES | YES | NO | YES |
| D-Tagatose | YES | NO | YES | NO | YES | YES | NO | YES |
| D-Tartaric acid | NO | NO | NO | NO | NO | YES | NO | YES |
| D,L-Carnitine | NO | NO | NO | NO | YES | YES | NO | YES |
| D,L-Octopamine | NO | NO | NO | NO | NO | NO | YES | NO |
| Dextrin | YES | YES | YES | YES | YES | YES | YES | YES |
| Dihydroxyacetone | YES | YES | YES | YES | YES | YES | YES | YES |
| g-Amino-N-Butyric acid | YES | NO | YES | NO | YES | YES | YES | YES |
| g-Cyclodextrin | YES | NO | YES | NO | YES | NO | YES | YES |
| g-Hydroxybutyric acid | NO | YES | YES | NO | YES | YES | YES | YES |
| Gelatin | YES | YES | YES | YES | YES | YES | YES | YES |
| Gentiobiose | YES | YES | YES | YES | YES | YES | YES | YES |
| Glycine | NO | NO | NO | NO | YES | NO | YES | YES |
| Glycogen | YES | NO | YES | YES | YES | YES | YES | YES |
| Hydroxy-L-Proline | YES | NO | YES | NO | YES | YES | YES | YES |
| i-Erythritol | NO | YES | NO | NO | YES | YES | NO | YES |
| Inulin | YES | NO | NO | NO | NO | NO | YES | YES |
| Itaconic acid | NO | NO | YES | YES | YES | NO | YES | YES |
| L-Alaninamide | YES | YES | YES | YES | YES | NO | YES | YES |
| L-Arabitol | NO | NO | YES | NO | YES | YES | NO | YES |
| L-Arginine | YES | NO | YES | NO | YES | YES | YES | YES |
| L-Glucose | NO | NO | NO | NO | NO | NO | NO | NO |
| L-Histidine | YES | NO | YES | YES | YES | YES | YES | YES |
| L-Homoserine | NO | NO | NO | NO | YES | NO | YES | NO |
| L-Isoleucine | YES | NO | YES | YES | YES | YES | YES | YES |
| L-Leucine | YES | YES | YES | YES | YES | YES | YES | YES |
| L-Lysine | YES | NO | YES | NO | YES | YES | YES | YES |

TABLE X-continued

Substrate utilization as determined by BIOLOG PM2 MicroPlates by bacterial endophytes belonging to OTUs present in cereal seeds, fruit seeds, vegetable seeds, and oil seeds.

| | | | | | | | | |
|---|---|---|---|---|---|---|---|---|
| L-Methionine | NO | NO | NO | NO | NO | NO | NO | NO |
| L-Ornithine | YES | NO | YES | YES | YES | YES | YES | YES |
| L-Phenylalanine | YES | NO | YES | YES | YES | NO | YES | NO |
| L-Pyroglutamic acid | NO | NO | YES | YES | YES | YES | YES | YES |
| L-Sorbose | NO | NO | NO | NO | NO | NO | NO | NO |
| L-Tartaric acid | NO | YES | NO | NO | NO | NO | YES | YES |
| L-Valine | YES | NO | YES | YES | YES | NO | YES | YES |
| Laminarin | YES | YES | YES | YES | YES | YES | YES | YES |
| Malonic acid | YES | YES | NO | YES | YES | YES | NO | YES |
| Maltitol | YES | YES | NO | YES | YES | YES | YES | YES |
| Mannan | NO | NO | NO | YES | YES | YES | NO | YES |
| Melibionic acid | YES | NO | YES | NO | YES | YES | YES | YES |
| N-Acetyl-D-Galactosamine | YES | YES | YES | YES | YES | YES | YES | YES |
| N-Acetyl-D-Glucosaminitol | NO | NO | NO | NO | NO | NO | NO | YES |
| N-Acetyl-L-Glutamic acid | YES | NO | YES | YES | YES | NO | YES | YES |
| N-Acetyl-Neuraminic acid | NO | NO | YES | YES | YES | NO | NO | YES |
| Negative Control. 1 | NO | NO | NO | NO | NO | NO | NO | NO |
| Oxalic acid | NO | YES | NO | NO | NO | YES | NO | NO |
| Oxalomalic acid | YES | YES | YES | YES | YES | YES | YES | YES |
| Palatinose | YES | YES | YES | YES | YES | YES | YES | YES |
| Pectin | YES | YES | YES | YES | YES | YES | YES | YES |
| Putrescine | NO | NO | YES | YES | YES | YES | YES | YES |
| Quinic acid | YES | NO | YES | NO | YES | YES | YES | YES |
| Salicin | YES | YES | YES | YES | YES | YES | YES | YES |
| Sebacic acid | NO | NO | YES | NO | YES | NO | YES | YES |
| sec-Butylamine | NO | NO | NO | NO | NO | NO | NO | NO |
| Sedoheptulosan | NO | NO | NO | NO | NO | NO | NO | NO |
| Sorbic acid | YES | NO | YES | YES | YES | NO | YES | YES |
| Stachyose | NO | NO | NO | NO | YES | YES | YES | YES |
| Succinamic acid | YES | YES | YES | YES | YES | YES | YES | YES |
| Turanose | YES | YES | YES | YES | YES | YES | YES | YES |
| Xylitol | NO | NO | YES | NO | YES | YES | NO | NO |

TABLE Y

Substrate utilization as determined by BIOLOG PM2 MicroPlates by fungal endophytes belonging to OTUs present in cereal seeds, fruit seeds, vegetable seeds, and oil seeds.

| | Substrate | | | | | | | |
|---|---|---|---|---|---|---|---|---|
| Strain | SYM00157 | SYM00300 | SYM00301 | SYM00577 | SYM01314 | SYM01324 | SYM01326 | SYM01329 |
| 2-Deoxy-D-Ribose | YES | NO | NO | NO | YES | NO | NO | NO |
| 2-Hydroxybenzoic acid | YES | YES | YES | YES | YES | YES | YES | NO |
| 2,3-Butanediol | NO | NO | YES | NO | NO | YES | NO | NO |
| 2,3-Butanedione | NO | NO | YES | NO | NO | YES | NO | NO |
| 3-Hydroxy-2-butanone | NO | NO | NO | NO | NO | YES | NO | NO |
| 3-Methylglucose | YES | NO | YES | YES | NO | NO | NO | YES |
| 3-O-b-D-Galactopyranosyl-D-Arabinose | YES | YES | YES | YES | YES | YES | NO | YES |
| 4-Hydroxybenzoic acid | YES | YES | YES | YES | YES | YES | YES | YES |
| 5-Keto-D-Gluconic acid | NO | NO | YES | NO | YES | YES | YES | NO |
| a-Cyclodextrin | YES | YES | YES | YES | YES | YES | YES | YES |
| a-Keto-Valeric acid | YES | YES | YES | YES | YES | YES | YES | YES |
| a-Methyl-D-Glucoside | YES | YES | YES | YES | YES | YES | YES | YES |
| a-Methyl-D-Mannoside | YES | NO | YES | NO | NO | YES | YES | NO |
| Acetamide | YES | YES | YES | NO | NO | NO | NO | NO |
| Amygdalin | YES | YES | YES | YES | YES | YES | YES | YES |
| Arbutin | YES | YES | YES | YES | YES | YES | YES | YES |
| b-Cyclodextrin | YES | YES | YES | NO | NO | YES | YES | NO |
| b-D-Allose | NO | NO | YES | NO | NO | NO | YES | NO |
| b-Hydroxybutyric acid | YES | YES | YES | YES | YES | YES | YES | YES |
| b-Methyl-D-Galactoside | YES | YES | YES | YES | YES | YES | YES | YES |
| b-Methyl-D-Glucuronic acid | YES | NO | NO | NO | YES | NO | NO | NO |
| b-Methyl-D-Xyloside | NO | NO | YES | NO | YES | YES | YES | NO |
| Butyric acid | YES | YES | YES | YES | YES | YES | YES | YES |
| Capric acid | NO | NO | NO | NO | NO | NO | NO | NO |
| Caproic acid | NO | YES | YES | YES | YES | YES | YES | NO |

TABLE Y-continued

Substrate utilization as determined by BIOLOG PM2 MicroPlates by fungal endophytes belonging to OTUs present in cereal seeds, fruit seeds, vegetable seeds, and oil seeds.

| | | | | | | | | |
|---|---|---|---|---|---|---|---|---|
| Chondroitin Sulfate C | YES | NO | YES | NO | YES | YES | NO | NO |
| Citraconic acid | YES | NO | YES | NO | YES | YES | NO | NO |
| Citramalic acid | YES | NO | NO | NO | YES | YES | NO | YES |
| d-Amino Valeric acid | NO | YES | YES | YES | YES | YES | YES | NO |
| D-Arabinose | YES | YES | YES | YES | YES | YES | YES | YES |
| D-Arabitol | YES | YES | YES | YES | YES | YES | YES | YES |
| D-Fucose | YES | NO | YES | NO | YES | YES | NO | NO |
| D-Glucosamine | YES | YES | YES | YES | YES | YES | YES | NO |
| D-Lactic acid Methyl Ester | YES | NO | YES | NO | NO | NO | NO | NO |
| D-Lactitol | YES | YES | YES | YES | NO | NO | YES | YES |
| D-Melezitose | YES | YES | YES | YES | YES | YES | YES | YES |
| D-Raffinose | YES | YES | YES | YES | YES | YES | YES | YES |
| D-Ribono-1,4-Lactone | YES | NO | YES | YES | YES | NO | YES | NO |
| D-Tagatose | NO | YES | YES | NO | YES | NO | YES | NO |
| D-Tartaric acid | YES | NO | NO | NO | YES | NO | NO | NO |
| D,L-Carnitine | YES | NO | YES | NO | NO | NO | NO | NO |
| D,L-Octopamine | YES | NO | YES | NO | YES | YES | NO | NO |
| Dextrin | YES | YES | YES | YES | YES | YES | YES | YES |
| Dihydroxyacetone | YES | YES | YES | YES | YES | YES | YES | NO |
| g-Amino-N-Butyric acid | YES | YES | YES | YES | YES | YES | YES | YES |
| g-Cyclodextrin | YES | YES | YES | YES | YES | YES | YES | YES |
| g-Hydroxybutyric acid | YES | YES | YES | YES | YES | YES | YES | YES |
| Gelatin | YES | YES | YES | YES | YES | YES | YES | YES |
| Gentiobiose | YES | YES | YES | YES | YES | YES | YES | YES |
| Glycine | YES | YES | YES | YES | YES | YES | YES | NO |
| Glycogen | YES | YES | YES | YES | YES | YES | YES | YES |
| Hydroxy-L-Proline | YES | YES | YES | YES | YES | YES | YES | NO |
| i-Erythritol | YES | YES | YES | YES | YES | YES | YES | YES |
| Inulin | YES | YES | YES | YES | YES | NO | NO | NO |
| Itaconic acid | NO | NO | YES | NO | NO | NO | NO | YES |
| L-Alaninamide | YES | YES | YES | YES | YES | YES | YES | YES |
| L-Arabitol | YES | YES | YES | YES | YES | YES | YES | YES |
| L-Arginine | YES | YES | YES | YES | YES | YES | YES | YES |
| L-Glucose | NO | NO | YES | NO | NO | NO | YES | NO |
| L-Histidine | YES | YES | YES | YES | YES | YES | YES | NO |
| L-Homoserine | YES | YES | YES | YES | NO | YES | YES | NO |
| L-Isoleucine | YES | YES | YES | YES | YES | YES | YES | YES |
| L-Leucine | YES | YES | YES | YES | YES | YES | YES | NO |
| L-Lysine | YES | YES | YES | YES | YES | YES | YES | NO |
| L-Methionine | NO | NO | NO | NO | NO | NO | NO | NO |
| L-Ornithine | YES | YES | YES | YES | YES | YES | YES | YES |
| L-Phenylalanine | YES | YES | YES | YES | YES | YES | YES | NO |
| L-Pyroglutamic acid | YES | YES | YES | YES | YES | YES | YES | YES |
| L-Sorbose | NO | YES | YES | YES | YES | YES | YES | NO |
| L-Tartaric acid | YES | NO | YES | NO | YES | YES | YES | YES |
| L-Valine | YES | YES | YES | YES | YES | YES | YES | YES |
| Laminarin | YES | YES | YES | YES | YES | YES | YES | NO |
| Malonic acid | YES | NO | YES | YES | YES | YES | YES | NO |
| Maltitol | YES | YES | YES | YES | YES | YES | YES | YES |
| Mannan | YES | NO | YES | NO | YES | NO | NO | NO |
| Melibionic acid | YES | NO | YES | YES | YES | YES | YES | NO |
| N-Acetyl-D-Galactosamine | YES | NO | NO | NO | NO | NO | YES | NO |
| N-Acetyl-D-Glucosaminitol | NO | NO | NO | NO | YES | YES | NO | YES |
| N-Acetyl-L-Glutamic acid | NO | NO | YES | NO | NO | YES | NO | NO |
| N-Acetyl-Neuraminic acid | NO | NO | NO | NO | NO | NO | NO | NO |
| Negative Control. 1 | NO | NO | NO | NO | NO | NO | NO | NO |
| Oxalic acid | YES | YES | YES | YES | YES | YES | YES | NO |
| Oxalomalic acid | NO | NO | NO | NO | YES | NO | NO | NO |
| Palatinose | YES | YES | YES | YES | YES | YES | YES | YES |
| Pectin | YES | NO | YES | NO | YES | YES | YES | YES |
| Putrescine | YES | YES | YES | YES | YES | YES | YES | YES |
| Quinic acid | YES | YES | YES | YES | YES | YES | YES | YES |
| Salicin | YES | YES | YES | YES | YES | YES | YES | YES |
| Sebacic acid | YES | YES | YES | YES | YES | YES | YES | NO |
| sec-Butylamine | NO | YES | YES | NO | NO | NO | NO | NO |
| Sedoheptulosan | YES | YES | NO | NO | YES | YES | YES | YES |
| Sorbic acid | YES | YES | YES | YES | YES | YES | YES | NO |
| Stachyose | YES | YES | YES | YES | YES | YES | YES | YES |
| Succinamic acid | YES | YES | YES | YES | YES | YES | NO | YES |
| Turanose | YES | YES | YES | YES | YES | YES | YES | YES |
| Xylitol | YES | YES | YES | YES | YES | YES | YES | YES |

TABLE Y-continued

Substrate utilization as determined by BIOLOG PM2 MicroPlates by fungal endophytes belonging to OTUs present in cereal seeds, fruit seeds, vegetable seeds, and oil seeds.

| | Substrate | | | | | | | |
|---|---|---|---|---|---|---|---|---|
| Strain | SYM01330 | SYM01331 | SYM12462 | SYM15774 | SYM15783 | SYM15810 | SYM15879 | SYM15880 |
| 2-Deoxy-D-Ribose | NO | NO | NO | NO | YES | YES | YES | NO |
| 2-Hydroxybenzoic acid | YES | YES | YES | YES | YES | YES | YES | YES |
| 2,3-Butanediol | YES | YES | NO | YES | NO | YES | NO | NO |
| 2,3-Butanedione | YES | YES | NO | NO | NO | YES | NO | NO |
| 3-Hydroxy-2-butanone | YES | NO | NO | NO | NO | NO | NO | NO |
| 3-Methylglucose | YES | YES | NO | NO | YES | NO | YES | NO |
| 3-O-b-D-Galactopyranosyl-D-Arabinose | NO | YES | YES | YES | YES | YES | NO | YES |
| 4-Hydroxybenzoic acid | YES | YES | NO | YES | YES | YES | YES | YES |
| 5-Keto-D-Gluconic acid | YES | YES | YES | YES | YES | YES | YES | YES |
| a-Cyclodextrin | YES | YES | YES | YES | YES | YES | YES | YES |
| a-Keto-Valeric acid | YES | YES | YES | YES | YES | YES | YES | YES |
| a-Methyl-D-Glucoside | YES | YES | NO | YES | YES | YES | YES | YES |
| a-Methyl-D-Mannoside | YES | YES | NO | NO | YES | YES | YES | NO |
| Acetamide | YES | YES | NO | YES | NO | NO | NO | NO |
| Amygdalin | YES | YES | YES | YES | YES | YES | YES | YES |
| Arbutin | YES | YES | YES | YES | YES | YES | YES | YES |
| b-Cyclodextrin | NO | YES | YES | YES | YES | YES | YES | YES |
| b-D-Allose | NO | NO | NO | YES | YES | YES | YES | YES |
| b-Hydroxybutyric acid | YES | YES | YES | YES | YES | YES | YES | NO |
| b-Methyl-D-Galactoside | YES | YES | YES | YES | YES | YES | YES | YES |
| b-Methyl-D-Glucuronic acid | YES | NO | NO | NO | NO | NO | YES | NO |
| b-Methyl-D-Xyloside | NO | NO | NO | NO | YES | YES | NO | NO |
| Butyric acid | YES | YES | NO | NO | YES | YES | YES | YES |
| Capric acid | NO | NO | NO | NO | NO | NO | NO | NO |
| Caproic acid | NO | YES | NO | NO | YES | YES | YES | YES |
| Chondroitin Sulfate C | YES | YES | YES | NO | NO | YES | YES | NO |
| Citraconic acid | YES | YES | YES | NO | YES | YES | NO | NO |
| Citramalic acid | YES | YES | NO | NO | YES | YES | YES | YES |
| d-Amino Valeric acid | YES | YES | YES | NO | YES | YES | YES | YES |
| D-Arabinose | NO | YES | YES | YES | YES | YES | YES | YES |
| D-Arabitol | YES | YES | YES | YES | YES | YES | YES | YES |
| D-Fucose | NO | YES | NO | YES | YES | YES | YES | YES |
| D-Glucosamine | YES | YES | NO | NO | NO | YES | YES | YES |
| D-Lactic acid Methyl Ester | YES | NO | YES | NO | NO | YES | NO | NO |
| D-Lactitol | NO | YES | YES | YES | YES | YES | YES | NO |
| D-Melezitose | YES | YES | YES | YES | YES | YES | YES | YES |
| D-Raffinose | YES | YES | YES | YES | YES | YES | YES | YES |
| D-Ribono-1,4-Lactone | YES | YES | NO | NO | YES | NO | NO | YES |
| D-Tagatose | YES | NO | NO | NO | YES | YES | YES | YES |
| D-Tartaric acid | YES | NO | NO | YES | YES | NO | YES | NO |
| D,L-Carnitine | YES | YES | YES | NO | NO | NO | NO | NO |
| D,L-Octopamine | NO | YES | NO | YES | YES | YES | YES | NO |
| Dextrin | YES | YES | YES | YES | YES | YES | YES | YES |
| Dihydroxyacetone | YES | YES | NO | NO | YES | YES | YES | NO |
| g-Amino-N-Butyric acid | YES | YES | YES | NO | YES | YES | YES | YES |
| g-Cyclodextrin | YES | YES | YES | YES | YES | YES | YES | YES |
| g-Hydroxybutyric acid | YES | YES | YES | YES | YES | YES | NO | NO |
| Gelatin | YES | YES | YES | YES | YES | YES | YES | NO |
| Gentiobiose | YES | YES | YES | YES | YES | YES | YES | YES |
| Glycine | YES | YES | YES | NO | YES | YES | YES | YES |
| Glycogen | YES | YES | YES | YES | YES | YES | YES | YES |
| Hydroxy-L-Proline | YES | YES | YES | NO | YES | YES | YES | YES |
| i-Erythritol | YES | YES | YES | NO | YES | YES | NO | YES |
| Inulin | YES | NO | YES | YES | NO | YES | YES | YES |
| Itaconic acid | NO | YES | NO | NO | NO | NO | NO | NO |
| L-Alaninamide | YES | YES | YES | YES | YES | YES | YES | NO |
| L-Arabitol | YES | YES | YES | NO | YES | YES | YES | YES |
| L-Arginine | YES | YES | YES | YES | YES | YES | YES | YES |
| L-Glucose | NO | YES | NO | NO | YES | YES | YES | NO |
| L-Histidine | YES | NO | YES | YES | YES | YES | YES | YES |
| L-Homoserine | NO | YES | NO | NO | YES | NO | YES | NO |
| L-Isoleucine | YES | YES | YES | YES | YES | YES | YES | YES |
| L-Leucine | YES | YES | NO | YES | YES | YES | YES | NO |
| L-Lysine | YES | YES | YES | YES | YES | YES | YES | YES |
| L-Methionine | NO | NO | NO | YES | YES | NO | NO | NO |
| L-Ornithine | YES | YES | YES | YES | YES | YES | YES | YES |
| L-Phenylalanine | YES | YES | YES | YES | YES | YES | YES | YES |
| L-Pyroglutamic acid | YES | YES | YES | YES | NO | YES | YES | YES |
| L-Sorbose | YES | NO | YES | NO | YES | YES | YES | YES |

TABLE Y-continued

| Substrate utilization as determined by BIOLOG PM2 MicroPlates by fungal endophytes belonging to OTUs present in cereal seeds, fruit seeds, vegetable seeds, and oil seeds. | | | | | | | | |
|---|---|---|---|---|---|---|---|---|
| L-Tartaric acid | NO | YES | NO | YES | NO | YES | YES | NO |
| L-Valine | YES | YES | NO | NO | YES | YES | YES | YES |
| Laminarin | NO | YES | YES | YES | YES | YES | YES | NO |
| Malonic acid | YES | YES | NO | YES | YES | YES | YES | NO |
| Maltitol | YES | YES | NO | YES | YES | YES | YES | YES |
| Mannan | YES | NO | YES | YES | NO | NO | NO | NO |
| Melibionic acid | YES | YES | YES | YES | NO | YES | YES | NO |
| N-Acetyl-D-Galactosamine | YES | NO | NO | YES | NO | YES | NO | NO |
| N-Acetyl-D-Glucosaminitol | NO | NO | NO | NO | NO | YES | YES | NO |
| N-Acetyl-L-Glutamic acid | YES | YES | NO | YES | NO | NO | NO | NO |
| N-Acetyl-Neuraminic acid | NO | NO | NO | NO | NO | NO | NO | NO |
| Negative Control. 1 | NO | NO | NO | NO | NO | NO | NO | NO |
| Oxalic acid | YES | YES | YES | NO | YES | YES | YES | NO |
| Oxalomalic acid | YES | NO | NO | NO | YES | YES | YES | NO |
| Palatinose | YES | YES | YES | YES | YES | YES | YES | YES |
| Pectin | YES | YES | YES | YES | YES | YES | YES | YES |
| Putrescine | YES | YES | YES | NO | YES | YES | YES | YES |
| Quinic acid | YES | YES | NO | YES | YES | YES | YES | YES |
| Salicin | YES | YES | YES | YES | YES | YES | YES | YES |
| Sebacic acid | YES | YES | YES | NO | YES | YES | YES | YES |
| sec-Butylamine | NO | NO | NO | NO | NO | NO | NO | NO |
| Sedoheptulosan | YES | YES | YES | YES | YES | YES | YES | YES |
| Sorbic acid | YES | YES | NO | NO | YES | YES | YES | NO |
| Stachyose | YES | YES | YES | YES | YES | YES | YES | YES |
| Succinamic acid | YES | YES | YES | YES | YES | YES | YES | NO |
| Turanose | YES | YES | YES | YES | YES | YES | YES | YES |
| Xylitol | YES | YES | YES | YES | YES | YES | YES | YES |

Seventeen (17) bacterial SYM strains and sixteen (16) fungal SYM strains were tested in biological triplicate for sole carbon substrate utilization using BIOLOG PM1 and PM2A MicroPlates. The most utilized substrates overall by these strains are a-D-Glucose, Arbutin, b-Methyl-D-Galactoside, b-Methyl-D-Glucoside, D-Arabitol, D-Cellobiose, Dextrin, D-Fructose, D-Galactose, D-Gluconic acid, D-Glucosamine, Dihydroxyacetone, DL-Malic acid, D-Mannitol, D-Mannose, D-Melezitose, D-Melibiose, D-Raffinose, D-Ribose, D-Trehalose, D-Xylose, g-Amino-N-Butyric acid, g-Cyclodextrin, Gelatin, Gentiobiose, Glycogen, i-Erythritol, L-Alanine, L-Arabinose, L-Galactonic acid-g-Lactone, L-Histidine, L-Proline, L-Rhamnose, Maltitol, Maltose, Maltotriose, N-Acetyl-D-Glucosamine, Palatinose, Pectin, Salicin, Stachyose, Sucrose, and Turanose. Overall, these strains did not utilize 2,3-Butanediol, 2,3-Butanedione, b-Methyl-D-Glucuronic acid, b-Methyl-D-Xyloside, Capric acid, D,L-Carnitine, Glucuronamide, Itaconic acid, L-Methionine, N-Acetyl-D-Glucosaminitol, N-Acetyl-Neuraminic acid, Phenylethylamine, or sec-Butylamine as sole carbon sources.

The most utilized substrates by these seventeen bacterial endophytes are 2-Deoxy-D-Ribose, a-D-Glucose, a-Methyl-D-Galactoside, Arbutin, b-Methyl-D-Galactoside, b-Methyl-D-Glucoside, D-Arabitol, D-Cellobiose, Dextrin, D-Fructose, D-Galactose, D-Galacturonic acid, D-Gluconic acid, D-Glucosamine, Dihydroxyacetone, DL-Malic acid, D-Mannitol, D-Mannose, D-Melibiose, D-Raffinose, D-Ribose, D-Trehalose, D-Xylose, Gelatin, Gentiobiose, L-Arabinose, L-Aspartic acid, L-Galactonic acid-g-Lactone, L-Glutamic acid, L-Glutamine, L-Histidine, L-Ornithine, L-Proline, Maltose, Maltotriose, N-Acetyl-D-Glucosamine, Pyruvic acid, Salicin, Sucrose, and Turanose. These bacterial endophytes did not utilize 1,2-Propanediol, 2,3-Butanediol, 2,3-Butanedione, 2-Aminoethanol, 2-Hydroxybenzoic acid, 3-Hydroxy-2-butanone, 3-Methylglucose, 4-Hydroxybenzoic acid, Acetamide, Acetoacetic acid, a-Hydroxybutyric acid, a-Hydroxyglutaric acid-g-Lactone, a-Ketobutyric acid, a-Keto-Valeric acid, a-Methyl-D-Glucoside, a-Methyl-D-Mannoside, b-D-Allose, b-Methyl-D-Glucuronic acid, b-Methyl-D-Xyloside, Capric acid, Caproic acid, Citraconic acid, Citramalic acid, D,L-Carnitine, D,L-Octopamine, d-Amino Valeric acid, D-Aspartic acid, D-Melezitose, D-Serine, D-Tagatose, D-Tartaric acid, D-Threonine, g-Cyclodextrin, g-Hydroxybutyric acid, Glucuronamide, Glycine, Glycolic acid, Glyoxylic acid, Hydroxy-L-Proline, i-Erythritol, Inulin, Itaconic acid, L-Arabitol, L-Fucose, L-Glucose, L-Homoserine, L-Methionine, L-Sorbose, L-Threonine, L-Valine, m-Tartaric acid, N-Acetyl-D-Glucosaminitol, N-Acetyl-D-Mannosamine, N-Acetyl-Neuraminic acid, Oxalic acid, Phenylethylamine, Sebacic acid, sec-Butylamine, Sedoheptulosan, Stachyose, Tricarballylic acid, Tyramine, or Xylitol as sole carbon sources.

The most utilized substrates by these sixteen fungal endophytes are a-D-Glucose, a-Methyl-D-Glucoside, Amygdalin, Arbutin, b-Methyl-D-Galactoside, b-Methyl-D-Glucoside, D-Arabitol, D-Cellobiose, Dextrin, D-Fructose, D-Galactose, D-Mannitol, D-Mannose, D-Melezitose, D-Melibiose, D-Raffinose, D-Trehalose, D-Xylose, g-Amino-N-Butyric acid, g-Cyclodextrin, Gentiobiose, Glycogen, i-Erythritol, L-Alanine, L-Arabinose, L-Arginine, L-Ornithine, L-Rhamnose, Maltitol, Maltose, Maltotriose, N-Acetyl-D-Glucosamine, Palatinose, Pectin, Putrescine, Quinic acid, Salicin, Stachyose, Sucrose, and Turanose. These fungal endophytes did not utilize 2,3-Butanediol, 2,3-Butanedione, 2-Deoxy-D-Ribose, b-Methyl-D-Glucuronic acid, b-Methyl-D-Xyloside, Capric acid, D,L-Carnitine, D-Galactonic acid-g-Lactone, D-Glucose-1-Phosphate, Glucuronamide, Itaconic acid, L-Methionine, N-Acetyl-D-Galactosamine, N-Acetyl-D-Glucosaminitol, N-Acetyl-L-Glutamic acid, N-Acetyl-Neuraminic acid, Phenylethylamine, or sec-Butylamine as sole carbon sources.

Example 5: Transcriptomic Characterization of Host Plant Response to Synthetic Compositions Comprising Plant Seeds and an Endophyte (Soy RNA-SEQ Experiments)

This Example describes the ability of synthetic compositions comprising plant seeds a single endophyte strain or a plurality of endophyte strains described herein, to confer beneficial traits to a host plant. Among other things, this Example describe the ability of endophytes (e.g., endophytes described herein) to confer beneficial traits on a variety of host plants by modulating the transcriptome of the host plant. In some embodiments, host plants include, but are not limited to, dicots (e.g., soy, peanuts) and monocots (e.g., plants described herein, e.g., corn, soy, wheat, cotton, sorghum), and combinations thereof.

Among other things, this Example describes surprising and unexpected modulations in the transcriptome of a host plant in response to synthetic compositions comprising plant seeds and a beneficial fungal endophyte strain, compared to a neutral fungal strain of the same genus.

Plant Seedling

Untreated soy seeds were surface sterilized using chlorine fumes. Briefly, Erlenmyer flasks containing seeds and a bottle with 100 mL of fresh bleach solution were placed in a desiccation jar located in a fume hood. Immediately prior to closing the lid of the desiccation jar, 3 mL hydrochloric acid was carefully pipetted into the bleach. Sterilization was done for 17 hours, and upon completion the flasks with seeds were removed, sealed in sterile foil, and opened in a sterile biosafety cabinet or laminar flow hood for subsequent work.

Soy Seedling Assay

Seeds were first coated with 3% sodium alginate, and gently shaken to obtain homogenous coverage. SYM strain fungal inoculum grown as described previously was added to the sodium alginate coated seeds and gently mixed. For every one gram of seeds, 10 μL of sodium alginate and inoculum were applied. Formulation only soybean seeds were coated with 3% sodium alginate and fresh PDB.

Ten seeds were placed on a 150 mm Petri plate that contained a single heavy germination paper (SD5-1/4 76# heavy weight seed germination paper, Anchor Paper Co., St. Paul, Minn.) added with 10 mL 8% polyethylene glycol (PEG 6000). Plates were incubated at 22° Celsius in dark and 60% relative humidity for five days. Seedlings were harvested at the end of the incubation period and stored in −80° C. until total RNA isolation using standard extraction method using TriReagent (Sigma-Aldrich, St. Louis, Mo., USA) and purification with RNeasy Mini Kit (Qiagen, Hilden, Germany). All experiments (beneficial, neural, formulation) were done in triplicate under sterile conditions resulting in a total of nine samples.

Soy RNA-SEQ

Initial quality control was performed using Agilent Bioanalyzer and Tapestation.

PolyA cDNA Preparation

For each of the 9 soybean RNAs, polyA cDNA was prepared using a Clontech cDNA synthesis kit. Briefly, after initial QC passed, 500 ng of total RNA was used to generate 1-2 ug of cDNA using Clontech SMARTer PCR cDNA kit (Clontech Laboratories, Inc., Mountain View, Calif. USA, catalog #634925). Manufacturer's instructions were strictly followed to perform polyA cDNA construction; 14 PCR cycles were performed.

Fragmentation

Briefly, cDNA was fragmented using Bioruptor (Diagenode, Inc., Denville, N.J. USA). Fragmented cDNAs were tested for size distribution and concentration using an Agilent Bioanalyzer 2100 or Tapestation 2200 and Nanodrop.

DNA Library Construction

For each the 9 soybean samples, Illumina libraries were made from qualified fragmented cDNA using Beckman Coulter SPRIworks HT Reagent Kit (Beckman. Coulter, Inc. Indianapolis, Ind. USA, catalog # B06938) on the Biomek FXp liquid handler.

Beckman Biomek FXp (Biomek 6000, Beckman Coulter) fully automatic workstation and a Beckman HT library kit were used to generate fragment libraries. The instructions were strictly followed to perform library construction. Briefly, after fragmentation the ends were repaired and 'A' bases were added to the 3' end of the fragments. Adapters were then ligated to both ends. The adaptor-ligated templates were further purified using Agencourt AMPure SPRI beads. The adaptor-ligated library was amplified by ligation-mediated PCR which consisted of 10 cycles of amplification, and the PCR product was purified using Agencourt AMPure SPRI beads again. After the library construction procedure was completed, QC was performed using a Nanodrop and Agilent Bioanalyzer to ensure the library quality and quantity.

RNA Sequencing

Sequencing was performed on an Illumina HiSeq 2500, using Rapid run v2.0 chemistry which generated paired-end reads of 106 nucleotides (nt.) according to Illumina manufacturer's instructions. The initial data analysis was started directly on the HiSeq 2500 System during the run. The HiSeq Control Software 2.2.58 in combination with RTA 1.18.64 (real time analysis) performed the initial image analysis and base calling. In addition, bcl2fastq1.8.4 generated and reported run statistics. Data was analyzed using FASTQC (Babraham Institute, Cambridge, UK) comprising the sequence information which was used for all subsequent bioinformatics analyses. Sequences were de-multiplexed according to the 6 bp index code with 1 mismatch allowed.

Analysis

Differential analysis of the soy transcriptome in the presence of neutral vs beneficial fungi was performed using standard RNA-seq analysis methods. Briefly, mapped reads overlapping with exon features were counted and aggregated by gene. These gene-level counts were analyzed with the DESeq2 R package, available through the Bioconductor software repository. All possible comparisons of the three groups (control, neutral, beneficial) were performed, and the false discovery rate method was used to adjust p-values for multiple testing. High- and low-confidence differential gene lists were created using false discovery rate thresholds of 0.1 and 0.05, and log 2 fold-change thresholds of 1 and 2, respectively. Set differences were extracted, e.g., genes differentially expressed in beneficial vs control but not in neutral vs control. Gene Ontology (GO) enrichment analysis was performed for all differential gene lists.

TABLE 500

This table shows the genes that are up-regulated (negative log FC) or down-regulated (positive log FC) in soybean as a result of treatment with a beneficial endophyte, as compared to formulation control.

| SEQ ID | Gene | Annotation | log FC | Adj. p-value | Median Exp. Beneficial | Median Exp. Formulation |
|---|---|---|---|---|---|---|
| 4127 | GLYMA01G31730 | GO:0006952, GO, defense response | −1.369956983 | 3.89E−08 | 12.63236736 | 3.673553109 |
| 4128 | GLYMA01G31921 | NA | −1.238022219 | 1.45E−06 | 8.528180493 | 2.738466863 |
| 4129 | GLYMA01G38630 | GO:0055114, GO, oxidation-reduction process | −1.099323189 | 0.000263359 | 4.903703783 | 1.347924708 |
| 4130 | GLYMA01G41070 | GO:0008150, GO, biological_process | −1.568722399 | 1.04E−14 | 13.25341979 | 3.395530442 |
| 4131 | GLYMA01G43420 | GO:0006355, GO, regulation of transcription, DNA-dependent | −1.253171009 | 1.81E−09 | 22.27987154 | 8.177409896 |
| 4132 | GLYMA01G44660 | GO:0008150, GO, biological_process | −1.163160876 | 1.25E−05 | 7.245224059 | 1.797232944 |
| 4133 | GLYMA02G01400 | GO:0008152, GO, metabolic process | −1.1051522 | 1.17E−05 | 5.985185092 | 2.156679533 |
| 4134 | GLYMA02G03420 | GO:0019761, GO, glucosinolate biosynthetic process | −1.015176361 | 4.96E−05 | 24.06891956 | 9.008550154 |
| 4135 | GLYMA02G04000 | GO:0080167, GO, response to karrikin | −1.070349401 | 8.30E−10 | 27.49585031 | 12.58063061 |
| 4136 | GLYMA02G06150 | GO:0008150, GO, biological_process | −1.034377122 | 2.01E−05 | 49.3568446 | 19.85942403 |
| 4137 | GLYMA02G09750 | GO:0006468, GO, protein phosphorylation | −1.109501892 | 1.06E−05 | 18.65539483 | 5.75161279 |
| 4138 | GLYMA02G14260 | GO:0008150, GO, biological_process | −1.251479824 | 4.10E−10 | 30.38164301 | 12.49076896 |
| 4139 | GLYMA02G36700 | GO:0006457, GO, protein folding | 1.234514786 | 1.70E−08 | 5.983985525 | 17.25483837 |
| 4140 | GLYMA02G40990 | GO:0010200, GO, response to chitin | −1.627009953 | 7.37E−22 | 34.59243212 | 10.33408943 |
| 4141 | GLYMA02G42251 | NA | −1.411718736 | 9.82E−18 | 83.37686498 | 28.48614217 |
| 4142 | GLYMA02G45420 | GO:0006508, GO, proteolysis | −1.424759326 | 7.78E−14 | 51.01901733 | 15.27648003 |
| 4143 | GLYMA03G00540 | GO:0006468, GO, protein phosphorylation | −1.349391458 | 2.98E−07 | 9.405290859 | 1.803380617 |
| 4144 | GLYMA03G01820 | GO:0008150, GO, biological_process | −1.012023704 | 0.000952197 | 3.464573325 | 0.988478119 |
| 4145 | GLYMA03G01835 | NA | −1.259097901 | 1.11E−08 | 22.70628056 | 8.626718132 |
| 4146 | GLYMA03G01840 | GO:0008150, GO, biological_process | −1.407747152 | 6.51E−15 | 50.47616829 | 19.58983909 |
| 4147 | GLYMA03G03480 | GO:0009733, GO, response to auxin stimulus | −1.008891294 | 3.93E−06 | 14.00695871 | 5.543723171 |
| 4148 | GLYMA03G05220 | GO:0006355, GO, regulation of transcription, DNA-dependent | −1.368776464 | 5.33E−08 | 11.67294705 | 3.873928733 |
| 4149 | GLYMA03G30410 | GO:0006499, GO, N-terminal protein myristoylation | −1.076960853 | 0.000354785 | 4.230130817 | 1.068669995 |
| 4150 | GLYMA03G34780 | GO:0006979, GO, response to oxidative stress | 1.536202396 | 9.85E−09 | 0.576235643 | 3.953912477 |
| 4151 | GLYMA03G35950 | GO:0005575, GO, cellular_component | −1.037941628 | 6.65E−05 | 5.718030613 | 2.27092374 |
| 4152 | GLYMA03G35980 | GO:0010150, GO, leaf senescence | −1.093799446 | 2.45E−08 | 27.18357532 | 9.618029959 |
| 4153 | GLYMA03G36330 | GO:0009870, GO, defense response signaling pathway, resistance gene-dependent | −1.456183569 | 7.05E−14 | 14.35544394 | 3.606761235 |
| 4154 | GLYMA03G42390 | GO:0008270, GO, zinc ion binding | −1.155489867 | 7.37E−09 | 20.94734334 | 7.6919159 |
| 4155 | GLYMA04G00490 | GO:0008150, GO, biological_process | −1.066752001 | 0.000134501 | 5.490016192 | 2.066817886 |
| 4156 | GLYMA04G00890 | GO:0009409, GO, response to cold | −1.23197541 | 1.83E−05 | 2.97009185 | 0.667918747 |
| 4157 | GLYMA04G02280 | GO:0008150, GO, biological_process | −1.129891407 | 1.65E−07 | 27.07697307 | 12.08932932 |
| 4158 | GLYMA04G04760 | GO:0006979, GO, response to oxidative stress | −1.145087639 | 1.78E−13 | 110.3884138 | 47.53681137 |
| 4159 | GLYMA04G09110 | GO:0006108, GO, malate metabolic process | −1.023288707 | 6.87E−08 | 62.46892211 | 27.71861586 |
| 4160 | GLYMA04G09770 | GO:0006810, GO, transport | −1.067742926 | 9.20E−06 | 7.225108449 | 2.785711064 |
| 4161 | GLYMA04G11140 | GO:0006810, GO, transport | −1.034043016 | 0.000731927 | 3.411272197 | 0.667918747 |
| 4162 | GLYMA04G12600 | GO:0003824, GO, catalytic activity | −1.311303393 | 8.14E−10 | 40.34895396 | 12.12689444 |
| 4163 | GLYMA04G12610 | GO:0003824, GO, catalytic activity | −1.283734962 | 9.78E−06 | 1.652334971 | 0 |
| 4164 | GLYMA04G17650 | GO:0010193, GO, response to ozone | −1.384727165 | 3.29E−11 | 12.87039802 | 3.594465888 |
| 4165 | GLYMA04G37530 | GO:0008150, GO, biological_process | 1.196382319 | 7.27E−06 | 2.216290935 | 8.800660535 |
| 4166 | GLYMA04G40700 | NA | −1.056299293 | 8.46E−11 | 67.64119934 | 32.350193 |
| 4167 | GLYMA04G40710 | GO:0008150, GO, biological_process | −1.564590555 | 2.15E−18 | 24.55650356 | 7.278793424 |
| 4168 | GLYMA04G40861 | NA | −1.006211746 | 7.60E−06 | 19.61481513 | 7.146730595 |
| 4169 | GLYMA04G41701 | NA | −1.201080148 | 1.28E−05 | 5.170209424 | 1.247337714 |
| 4170 | GLYMA05G03243 | NA | −1.226133282 | 7.41E−08 | 14.53544951 | 5.476933727 |
| 4171 | GLYMA05G22760 | PF05678, PFAM, VQ motif | −1.058133573 | 0.000138289 | 7.995169212 | 2.217489269 |
| 4172 | GLYMA05G25920 | GO:0008150, GO, biological_process | −1.461542925 | 7.05E−14 | 22.86618395 | 7.368655071 |
| 4173 | GLYMA05G33340 | GO:0008150, GO, biological_process | 1.371586716 | 5.70E−09 | 2.475076542 | 8.038398599 |
| 4174 | GLYMA05G34760 | GO:0010112, GO, regulation of systemic acquired resistance | −1.093610202 | 3.89E−08 | 18.28228693 | 8.348984339 |
| 4175 | GLYMA05G37690 | GO:0006813, GO, potassium ion transport | −1.152485783 | 4.56E−13 | 64.84867276 | 29.1151737 |
| 4176 | GLYMA06G02340 | GO:0008150, GO, biological_process | −1.000797368 | 1.73E−07 | 50.90257732 | 23.63361322 |
| 4177 | GLYMA06G10450 | GO:0008150, GO, biological_process | −1.442423906 | 2.55E−11 | 10.54954485 | 2.771861586 |
| 4178 | GLYMA06G10580 | GO:0008150, GO, biological_process | −1.333680454 | 9.34E−11 | 13.65235216 | 3.774189183 |
| 4179 | GLYMA06G13090 | GO:0006355, GO, regulation of transcription, DNA-dependent | −1.099137285 | 0.000134501 | 7.195652291 | 2.938842487 |
| 4180 | GLYMA06G14090 | GO:0008150, GO, biological_process | −1.147251562 | 5.98E−13 | 143.6465402 | 58.94924057 |
| 4181 | GLYMA06G45020 | NA | −1.262217964 | 3.80E−15 | 53.83413936 | 18.7100657 |
| 4182 | GLYMA06G45043 | NA | 1.138574305 | 3.09E−10 | 3928.774615 | 8118.418788 |
| 4183 | GLYMA07G06320 | GO:0006355, GO, regulation of transcription, DNA-dependent | −1.006619206 | 2.17E−07 | 33.46599312 | 13.89270994 |

TABLE 500-continued

This table shows the genes that are up-regulated (negative log FC) or down-regulated (positive log FC) in soybean as a result of treatment with a beneficial endophyte, as compared to formulation control.

| SEQ ID | Gene | Annotation | log FC | Adj. p-value | Median Exp. Beneficial | Median Exp. Formulation |
|---|---|---|---|---|---|---|
| 4184 | GLYMA07G11960 | GO:0010200, GO, response to chitin | −1.161974193 | 8.23E−07 | 43.02133043 | 12.67049226 |
| 4185 | GLYMA07G15800 | GO:0008150, GO, biological_process | 1.009903371 | 2.03E−06 | 5127.965314 | 11633.54157 |
| 4186 | GLYMA07G29730 | GO:0006499, GO, N-terminal protein myristoylation | −1.193477886 | 7.29E−05 | 2.437920029 | 0.400751248 |
| 4187 | GLYMA08G01900 | GO:0006813, GO, potassium ion transport | −1.203154273 | 2.80E−12 | 62.30901873 | 28.12669558 |
| 4188 | GLYMA08G02580 | GO:0006355, GO, regulation of transcription, DNA-dependent | −1.102088699 | 1.08E−07 | 59.11095104 | 27.85221176 |
| 4189 | GLYMA08G08360 | GO:0006952, GO, defense response | −1.107144375 | 4.96E−05 | 6.556038754 | 1.870172492 |
| 4190 | GLYMA08G10435 | NA | 1.27926219 | 6.52E−06 | 1.305040358 | 4.642868156 |
| 4191 | GLYMA08G11260 | GO:0008150, GO, biological_process | −1.031833196 | 3.58E−09 | 51.55092715 | 23.63361322 |
| 4192 | GLYMA08G16810 | GO:0009061, GO, anaerobic respiration | −1.153355774 | 1.13E−09 | 32.75678002 | 14.02629369 |
| 4193 | GLYMA08G17140 | GO:0007275, GO, multicellular organismal development | 1.013378053 | 0.001635642 | 0.479710153 | 1.803380617 |
| 4194 | GLYMA08G22630 | GO:0009408, GO, response to heat | 1.167051089 | 1.64E−05 | 1.950336023 | 6.144852474 |
| 4195 | GLYMA09G00720 | GO:0008150, GO, biological_process | −1.297617667 | 9.76E−07 | 6.023027473 | 1.335837494 |
| 4196 | GLYMA09G06840 | NA | 1.043842712 | 0.000230515 | 1.980061233 | 6.236688568 |
| 4197 | GLYMA09G12440 | GO:0008168, GO, methyltransferase activity | −1.110391457 | 0.000138289 | 4.637198143 | 0.868294371 |
| 4198 | GLYMA09G21040 | NA | −1.129686949 | 0.000191718 | 3.015093242 | 0.449308236 |
| 4199 | GLYMA09G30250 | GO:0010200, GO, response to chitin | −1.480411528 | 3.22E−16 | 37.95040319 | 10.04799825 |
| 4200 | GLYMA09G38930 | GO:0009611, GO, response to wounding | −1.114614822 | 3.43E−05 | 5.809822961 | 2.00959965 |
| 4201 | GLYMA09G41670 | GO:0006355, GO, regulation of transcription, DNA-dependent | −1.282700181 | 1.93E−09 | 17.21626437 | 5.127943934 |
| 4202 | GLYMA10G04210 | GO:0006355, GO, regulation of transcription, DNA-dependent | −1.021042996 | 1.99E−05 | 9.380998542 | 4.672805655 |
| 4203 | GLYMA10G22100 | GO:0055114, GO, oxidation-reduction process | −1.184360983 | 7.75E−05 | 1.595729473 | 0.179723294 |
| 4204 | GLYMA10G37920 | GO:0004497, GO, monooxygenase activity | −1.440645295 | 3.88E−10 | 13.27198089 | 3.339593736 |
| 4205 | GLYMA10G39971 | NA | −1.199223405 | 2.01E−05 | 5.223510552 | 1.87100657 |
| 4206 | GLYMA10G44160 | GO:0006355, GO, regulation of transcription, DNA-dependent | −1.469325378 | 1.70E−11 | 28.40950127 | 8.549359964 |
| 4207 | GLYMA11G06660 | GO:0055114, GO, oxidation-reduction process | −1.013056688 | 6.65E−05 | 40.40225509 | 14.96137994 |
| 4208 | GLYMA11G13290 | NA | −1.186249968 | 1.08E−06 | 34.87607854 | 13.47924708 |
| 4209 | GLYMA11G13800 | GO:0005975, GO, carbohydrate metabolic process | −1.212845405 | 8.71E−11 | 32.35378475 | 12.62366432 |
| 4210 | GLYMA11G13810 | GO:0005975, GO, carbohydrate metabolic process | −1.025842415 | 0.000230184 | 5.330112808 | 2.204131866 |
| 4211 | GLYMA11G16120 | NA | −1.343091922 | 6.61E−11 | 16.52334971 | 4.313359066 |
| 4212 | GLYMA11G21250 | GO:0006468, GO, protein phosphorylation | −1.06809702 | 0.000495067 | 2.77165866 | 0.718893178 |
| 4213 | GLYMA11G25670 | GO:0010193, GO, response to ozone | −1.137836997 | 1.03E−05 | 8.634782749 | 2.695849416 |
| 4214 | GLYMA11G33450 | GO:0010200, GO, response to chitin | −1.387745046 | 4.11E−19 | 57.82678829 | 19.16926804 |
| 4215 | GLYMA12G00460 | GO:0006468, GO, protein phosphorylation | −1.042089407 | 1.75E−09 | 35.01739678 | 15.63592661 |
| 4216 | GLYMA12G00780 | GO:0005975, GO, carbohydrate metabolic process | 1.075138028 | 0.000616457 | 0.443258187 | 1.536213118 |
| 4217 | GLYMA12G01420 | GO:0006952, GO, defense response | −1.02645451 | 1.87E−07 | 30.36318581 | 14.73731014 |
| 4218 | GLYMA12G05770 | GO:0005975, GO, carbohydrate metabolic process | 1.235797291 | 3.38E−07 | 9.663028477 | 25.91524739 |
| 4219 | GLYMA12G05800 | GO:0005975, GO, carbohydrate metabolic process | −1.014997151 | 7.90E−06 | 29.83592268 | 13.15799932 |
| 4220 | GLYMA12G08020 | GO:0006887, GO, exocytosis | −1.088877462 | 8.78E−06 | 7.18078263 | 2.494675427 |
| 4221 | GLYMA12G09830 | GO:0000289, GO, nuclear-transcribed mRNA poly(A) tail shortening | −1.038592224 | 5.61E−09 | 269.4683333 | 120.4146073 |
| 4222 | GLYMA12G12260 | NA | −1.305617284 | 9.36E−18 | 48.29082204 | 15.69609056 |
| 4223 | GLYMA12G15620 | GO:0005975, GO, carbohydrate metabolic process | −1.21921729 | 2.12E−08 | 28.83591029 | 10.41953246 |
| 4224 | GLYMA12G36310 | GO:0006814, GO, sodium ion transport | −1.417198792 | 1.03E−07 | 6.076328601 | 1.335837494 |
| 4225 | GLYMA13G09690 | GO:0006071, GO, glycerol metabolic process | −1.091584652 | 1.88E−07 | 29.58212608 | 11.0874512 |
| 4226 | GLYMA13G09840 | GO:0006071, GO, glycerol metabolic process | −1.048336234 | 2.07E−07 | 45.73236789 | 20.63868929 |
| 4227 | GLYMA13G10010 | GO:0006468, GO, protein phosphorylation | −1.18204335 | 2.97E−06 | 7.515459059 | 2.286785808 |
| 4228 | GLYMA13G19560 | GO:0006355, GO, regulation of transcription, DNA-dependent | −1.2382138 | 5.37E−07 | 6.870501899 | 2.078896189 |
| 4229 | GLYMA13G22540 | NA | −1.055564007 | 1.97E−08 | 31.66087008 | 13.47924708 |
| 4230 | GLYMA13G35320 | GO:0006952, GO, defense response | 1.440915562 | 2.97E−12 | 52.07520214 | 149.0804727 |
| 4231 | GLYMA13G35710 | GO:0008150, GO, biological_process | 1.011655056 | 0.000625306 | 0.045001392 | 1.61750965 |
| 4232 | GLYMA14G05710 | PTHR10499:SF51, Panther, VON WILLEBRAND FACTOR A3 | −1.079821764 | 0.000308777 | 1.935059842 | 0.138593079 |
| 4233 | GLYMA14G06640 | GO:0006979, GO, response to oxidative stress | −1.215771987 | 1.16E−08 | 20.25689915 | 6.791060885 |

TABLE 500-continued

This table shows the genes that are up-regulated (negative log FC) or down-regulated (positive log FC) in soybean as a result of treatment with a beneficial endophyte, as compared to formulation control.

| SEQ ID | Gene | Annotation | log FC | Adj. p-value | Median Exp. Beneficial | Median Exp. Formulation |
|---|---|---|---|---|---|---|
| 4234 | GLYMA14G06900 | GO:0009408, GO, response to heat | 1.019854223 | 0.00021457 | 3.195098808 | 9.684821834 |
| 4235 | GLYMA14G09571 | NA | −1.007062495 | 0.001249681 | 2.925090458 | 0.868294371 |
| 4236 | GLYMA14G32430 | GO:0009414, GO, response to water deprivation | 1.002316095 | 1.01E−06 | 10.62032843 | 22.59067192 |
| 4237 | GLYMA14G39300 | GO:0010200, GO, response to chitin | −1.134859314 | 4.96E−09 | 71.15700599 | 29.02531205 |
| 4238 | GLYMA14G39950 | GO:0008150, GO, biological_process | −1.057047859 | 1.33E−08 | 19.72141739 | 7.553322821 |
| 4239 | GLYMA15G11140 | GO:0009651, GO, response to salt stress | −1.008285337 | 1.31E−05 | 28.83591029 | 14.15987744 |
| 4240 | GLYMA15G13510 | GO:0006979, GO, response to oxidative stress | −1.4392098 | 9.46E−11 | 19.88132077 | 5.543723171 |
| 4241 | GLYMA16G06520 | GO:0008150, GO, biological_process | −1.436684015 | 1.57E−08 | 5.625173959 | 0.988478119 |
| 4242 | GLYMA16G31401 | NA | −1.106530815 | 1.52E−05 | 9.270286684 | 3.118344284 |
| 4243 | GLYMA17G01530 | GO:0008150, GO, biological_process | −1.037614878 | 0.001129298 | 1.773032748 | 0.400751248 |
| 4244 | GLYMA17G03340 | GO:0006952, GO, defense response | −1.220260866 | 1.01E−10 | 372.1615091 | 135.9882569 |
| 4245 | GLYMA17G05240 | GO:0006355, GO, regulation of transcription, DNA-dependent | −1.407526282 | 2.79E−13 | 17.00305986 | 5.8108931 |
| 4246 | GLYMA17G11340 | GO:0008150, GO, biological_process | −1.27822077 | 1.25E−09 | 20.03527005 | 7.368655071 |
| 4247 | GLYMA17G11490 | GO:0008150, GO, biological_process | −1.298456505 | 3.81E−06 | 3.411272197 | 0.623668857 |
| 4248 | GLYMA17G35430 | GO:0006979, GO, response to oxidative stress | −1.083557924 | 1.71E−10 | 130.7740442 | 53.1082335 |
| 4249 | GLYMA18G03066 | NA | −1.022521386 | 2.16E−08 | 84.85539591 | 34.95618076 |
| 4250 | GLYMA18G04770 | GO:0010200, GO, response to chitin | −1.328972157 | 1.26E−22 | 78.45926054 | 28.58692238 |
| 4251 | GLYMA18G20470 | GO:0010193, GO, response to ozone | −1.03304461 | 0.000267522 | 6.875845522 | 2.137339991 |
| 4252 | GLYMA18G28830 | GO:0015995, GO, chlorophyll biosynthetic process | −1.360956021 | 6.62E−07 | 4.850402655 | 1.001878121 |
| 4253 | GLYMA18G44030 | GO:0006355, GO, regulation of transcription, DNA-dependent | −1.121912469 | 5.61E−06 | 14.60450909 | 5.682316251 |
| 4254 | GLYMA18G49158 | NA | −1.354034842 | 4.58E−07 | 4.635143342 | 0.801502497 |
| 4255 | GLYMA18G50691 | NA | −1.039325485 | 9.07E−05 | 6.715942138 | 2.40450749 |
| 4256 | GLYMA18G53250 | GO:0008150, GO, biological_process | 1.250925416 | 2.68E−08 | 2.878260916 | 9.255749663 |
| 4257 | GLYMA19G01440 | GO:0009408, GO, response to heat | 1.091071017 | 3.48E−13 | 33.43603401 | 78.48045279 |
| 4258 | GLYMA19G34490 | NA | −1.064397801 | 0.000164104 | 5.265162825 | 1.536213118 |
| 4259 | GLYMA19G35740 | GO:0006355, GO, regulation of transcription, DNA-dependent | −1.062085765 | 4.69E−05 | 7.225108449 | 2.516126122 |
| 4260 | GLYMA19G37161 | NA | −1.105970011 | 0.000101771 | 3.89098235 | 1.078339767 |
| 4261 | GLYMA19G38570 | GO:0010150, GO, leaf senescence | −1.11397824 | 4.23E−09 | 34.91223889 | 14.4677252 |
| 4262 | GLYMA19G38590 | GO:0010150, GO, leaf senescence | −1.295108361 | 8.98E−07 | 5.540727338 | 1.707371297 |
| 4263 | GLYMA19G41410 | GO:0005975, GO, carbohydrate metabolic process | 1.336821707 | 2.59E−06 | 0.132977456 | 2.003756241 |
| 4264 | GLYMA20G01170 | GO:0006499, GO, N-terminal protein myristoylation | −1.124709392 | 4.41E−06 | 6.715942138 | 2.156679533 |
| 4265 | GLYMA20G03850 | NA | −1.027846502 | 0.000691549 | 4.05012525 | 1.247337714 |
| 4266 | GLYMA20G25990 | GO:0006499, GO, N-terminal protein myristoylation | −1.110406177 | 1.18E−09 | 60.21186205 | 26.50918593 |
| 4267 | GLYMA20G26600 | GO:0006952, GO, defense response | −1.008944076 | 7.29E−07 | 46.74508933 | 17.03192805 |
| 4268 | GLYMA20G27020 | GO:0008150, GO, biological_process | −1.092005979 | 2.85E−10 | 42.46413432 | 18.10059805 |
| 4269 | GLYMA20G35180 | GO:0006355, GO, regulation of transcription, DNA-dependent | −1.034170042 | 9.83E−09 | 21.94128026 | 9.751613708 |
| 4270 | GLYMA03G37400 | GO:0042545, GO, cell wall modification | 1.646163821 | 2.88E−09 | 0.213204512 | 2.426264 |
| 4271 | GLYMA03G38840 | GO:0005975, GO, carbohydrate metabolic process | 2.018195916 | 1.64E−15 | 0.576235643 | 5.391699 |
| 4272 | GLYMA07G15380 | GO:0009693, GO, ethylene biosynthetic process | 1.14033694 | 9.07E−05 | 0.900027833 | 4.133636 |
| 4273 | GLYMA08G46450 | GO:0005975, GO, carbohydrate metabolic process | 2.028493959 | 7.27E−15 | 0.310280731 | 3.684328 |
| 4274 | GLYMA09G35840 | GO:0005975, GO, carbohydrate metabolic process | 3.395302467 | 6.40E−68 | 1.152471286 | 24.89168 |
| 4275 | GLYMA10G30340 | GO:0008150, GO, biological_process | −2.087505841 | 1.42E−27 | 35.23204566 | 5.032252 |
| 4276 | GLYMA11G02350 | GO:0005975, GO, carbohydrate metabolic process | 2.628824882 | 2.44E−30 | 1.012721434 | 13.47925 |
| 4277 | GLYMA12G01510 | GO:0005975, GO, carbohydrate metabolic process | 3.161170918 | 8.63E−48 | 0.5400167 | 13.1198 |
| 4278 | GLYMA13G30440 | GO:0008150, GO, biological_process | −2.347970113 | 7.37E−22 | 7.195652291 | 0.467543 |
| 4279 | GLYMA15G07700 | PF00264, PFAM, Common central domain of tyrosinase | 0.824086029 | 0.018602054 | 3.102807309 | 19.05067 |
| 4281 | GLYMA17G08400 | GO:0006032, GO, chitin catabolic process | −2.054291387 | 1.57E−22 | 16.26757546 | 2.066818 |
| 4283 | GLYMA17G14890 | GO:0006869, GO, lipid transport | 1.278386816 | 1.57E−08 | 25.8419523 | 62.159 |
| 4284 | GLYMA18G47390 | GO:0009611, GO, response to wounding | −2.306445262 | 6.24E−19 | 3.900672046 | 0.089862 |
| 4285 | GLYMA18G53440 | GO:0008150, GO, biological_process | 0.105360923 | 0.992007499 | 16.84315647 | 19.54162 |

The genes described in this table show significant (fdr adjusted p-value <=0.05) differences in expression in soybean seedlings treated with a *Acremonium zea* sp. with beneficial effects on soybean growth and soybean seedlings treated with a formulation ("Beneficial v Formulation"). "Median Exp. Beneficial" and "Median Exp. Formulation" represent the median expression value in cpm across biological replicates of soy seedlings treated with the beneficial *Acremonium* and formulation, respectively. "Log FC" represents the estimate of the log 2-fold-change of the contrast. "Adj. p-value" represents the false discovery rate (Benjamini & Hochberg, 1995) adjusted p-values.

This table describes soybean genes differentially expressed in soybean seedlings treated with an *Acremonium zea* sp. with neutral effects on soybean growth and soybean seedlings treated with an *Acremonium zea* sp. with beneficial effects on soybean growth. "Median Exp. Neutral" and "Median Exp. Beneficial" represent the median expression value in cpm across biological replicates of soy seedlings treated with the neutral *Acremonium* and beneficial *Acremonium*, respectively. "Log FC" represents the estimate of the log 2-fold-change of the contrast. "Adj. p-value" represents the false discovery rate (Benjamini & Hochberg, 1995) adjusted p-values.

TABLE 501

This table shows the genes that are up-regulated (positive log FC) or down-regulated (negative log FC) in soybean as a result of treatment with a beneficial endophyte, as compared to a soybean treated with a reference microorganism.

| SEQ ID | Gene | Annotation | log FC | Adj. p-value | Median Exp. Neutral | Median Exp. Beneficial |
|---|---|---|---|---|---|---|
| 4162 | GLYMA04G12600 | GO:0003824, GO, catalytic activity | 1.206357 | 9.85E−08 | 13.26698 | 40.34895 |
| 4201 | GLYMA09G41670 | GO:0006355, GO, regulation of transcription, DNA-dependent | 1.221864 | 1.58E−06 | 5.909453 | 17.21626 |
| 4153 | GLYMA03G36330 | GO:0009870, GO, defense response signaling pathway, resistance gene-dependent | 0.856536 | 0.000672 | 6.648135 | 14.35544 |
| 4253 | GLYMA18G44030 | GO:0006355, GO, regulation of transcription, DNA-dependent | 0.998764 | 0.001135 | 5.793248 | 14.60451 |
| 4181 | GLYMA06G45020 | NA | 0.657628 | 0.003708 | 31.22163 | 53.83414 |
| 4195 | GLYMA09G00720 | GO:0008150, GO, biological_process | 0.90306 | 0.003708 | 2.788204 | 6.023027 |
| 4206 | GLYMA10G44160 | GO:0006355, GO, regulation of transcription, DNA-dependent | 0.819527 | 0.009033 | 13.67119 | 28.4095 |
| 4269 | GLYMA20G35180 | GO:0006355, GO, regulation of transcription, DNA-dependent | 0.663267 | 0.009033 | 13.62622 | 21.94128 |
| 4167 | GLYMA04G40710 | GO:0008150, GO, biological_process | 0.829353 | 0.010992 | 12.55759 | 24.5565 |
| 4140 | GLYMA02G40990 | GO:0010200, GO, response to chitin | 0.795223 | 0.01505 | 17.04244 | 34.59243 |
| 4183 | GLYMA07G06320 | GO:0006355, GO, regulation of transcription, DNA-dependent | 0.748416 | 0.015784 | 18.20323 | 33.46599 |
| 4142 | GLYMA02G45420 | GO:0006508, GO, proteolysis | 0.894101 | 0.016107 | 21.73835 | 51.01902 |
| 4199 | GLYMA09G30250 | GO:0010200, GO, response to chitin | 0.819331 | 0.017054 | 15.30126 | 37.9504 |
| 4250 | GLYMA18G04770 | GO:0010200, GO, response to chitin | 0.787911 | 0.019874 | 39.88881 | 78.45926 |
| 4213 | GLYMA11G25670 | GO:0010193, GO, response to ozone | 0.897841 | 0.02031 | 3.00749 | 8.634783 |
| 4150 | GLYMA03G34780 | GO:0006979, GO, response to oxidative stress | −0.91553 | 0.022156 | 2.078494 | 0.576236 |
| 4222 | GLYMA12G12260 | NA | 0.730565 | 0.02231 | 26.27596 | 48.29082 |
| 4184 | GLYMA07G11960 | GO:0010200, GO, response to chitin | 0.881315 | 0.026957 | 16.19823 | 43.02133 |
| 4131 | GLYMA01G43420 | GO:0006355, GO, regulation of transcription, DNA-dependent | 0.792195 | 0.0384 | 11.50233 | 22.27987 |
| 4223 | GLYMA12G15620 | GO:0005975, GO, carbohydrate metabolic process | 0.802313 | 0.040823 | 13.75344 | 28.83591 |
| 4270 | GLYMA03G37400 | GO:0042545, GO, cell wall modification | 0.166032 | NA | 0.052762975 | 0.213204512 |
| 4271 | GLYMA03G38840 | GO:0005975, GO, carbohydrate metabolic process | −0.91714 | 0.022324 | 1.793941164 | 0.576235643 |
| 4272 | GLYMA07G15380 | GO:0009693, GO, ethylene biosynthetic process | 0.727432 | 0.132533 | 0.265339603 | 0.900027833 |
| 4273 | GLYMA08G46450 | GO:0005975, GO, carbohydrate metabolic process | −0.44339 | 0.684951 | 0.844207607 | 0.310280731 |
| 4274 | GLYMA09G35840 | GO:0005975, GO, carbohydrate metabolic process | −1.28626 | 1.70E−05 | 4.047392811 | 1.152471286 |
| 4275 | GLYMA10G30340 | GO:0008150, GO, biological_process | 0.531076 | 0.317217 | 17.04402084 | 35.23204566 |
| 4276 | GLYMA11G02350 | GO:0005975, GO, carbohydrate metabolic process | −0.39592 | 0.826706 | 1.636260886 | 1.012721434 |
| 4277 | GLYMA12G01510 | GO:0005975, GO, carbohydrate metabolic process | −0.84175 | 0.059336 | 1.503591084 | 0.5400167 |
| 4278 | GLYMA13G30440 | GO:0008150, GO, biological_process | 0.559495 | 0.472633 | 2.564949496 | 7.195652291 |
| 4279 | GLYMA15G07700 | PF00264, PFAM, Common central domain of tyrosinase | 0.458456 | 0.694846 | 1.618957124 | 3.102807309 |
| 4280 | GLYMA15G12600 | GO:0006869, GO, lipid transport | 0.833553 | 0.064382 | 3.165778525 | 12.27825178 |
| 4281 | GLYMA17G08400 | GO:0006032, GO, chitin catabolic process | 0.945666 | 0.000294 | 6.191257405 | 16.26757546 |
| 4282 | GLYMA17G14860 | GO:0006869, GO, lipid transport | 0.776484 | 0.105214 | 5.711320967 | 15.77999146 |
| 4283 | GLYMA17G14890 | GO:0006869, GO, lipid transport | 0.617561 | 0.305278 | 10.76364699 | 25.8419523 |
| 4284 | GLYMA18G47390 | GO:0009611, GO, response to wounding | 1.018065 | 0.000747 | 1.618957124 | 3.900672046 |
| 4285 | GLYMA18G53440 | GO:0008150, GO, biological_process | −2.04965 | 6.81E−35 | 91.12165855 | 16.84315647 |

TABLE 502

This table describes gene ontology terms which are significantly enriched or depleted in the set of genes differently expressed between soybean seedlings treated with an *Acremonium zea* sp. with neutral effects on soybean growth and soybean seedlings treated with a *Acremonium zea* sp. with beneficial effects on soybean growth.

| GO ID | GO Description | Gene ID | SEQ ID |
|---|---|---|---|
| GO: 0000014 | single-stranded DNA specific endodeoxyribonuclease activity | GLYMA15G07430, GLYMA15G07430 | 4286; 4286 |
| GO: 0003700 | sequence-specific DNA binding transcription factor activity | GLYMA03G34730, GLYMA03G41750, GLYMA05G32040, GLYMA06G11700, GLYMA08G16190, GLYMA09G41670, GLYMA13G21350, GLYMA19G37410, GLYMA19G40650, GLYMA0041S00350, GLYMA01G41520, GLYMA01G44230, GLYMA02G00290, GLYMA03G33070, GLYMA03G34730, GLYMA04G35380, GLYMA05G32040, GLYMA06G20400, GLYMA08G14320, GLYMA08G16190, GLYMA08G18470, GLYMA13G18400, GLYMA13G21350, GLYMA15G00570, GLYMA17G06610, GLYMA18G43580, GLYMA19G34740, GLYMA19G37410, GLYMA01G43420, GLYMA03G05220, GLYMA03G33070, GLYMA04G04760, GLYMA05G34760, GLYMA05G36970, GLYMA06G04840, GLYMA06G13090, GLYMA07G06320, GLYMA08G02580, GLYMA08G14320, GLYMA08G17140, GLYMA09G08330, GLYMA09G41670, GLYMA10G04190, GLYMA10G04210, GLYMA10G44160, GLYMA13G17250, GLYMA13G18400, GLYMA13G19560, GLYMA15G00570, GLYMA15G19910, GLYMA17G05240, GLYMA17G35430, GLYMA18G44030, GLYMA19G35740, GLYMA19G35770, GLYMA20G35180 | 4288; 4295; 4292; 4296; 4297; 4201; 4298; 4299; 4300; 4301; 4302; 4303; 4304; 4305; 4288; 4306; 4292; 4307; 4308; 4297; 4309; 4310; 4298; 4311; 4312; 4313; 4314; 4299; 4131; 4148; 4305; 4158; 4174; 4315; 4316; 4179; 4183; 4188; 4308; 4193; 4317; 4201; 4318; 4202; 4206; 4319; 4310; 4228; 4311; 4320; 4245; 4248; 4253; 4259; 4321; 4269 |
| GO: 0003950 | NAD+ ADP-ribosyltransferase activity | GLYMA04G35560 | 4289 |
| GO: 0004222 | metalloendopeptidase activity | GLYMA01G41750, GLYMA01G04350 | 4290; 4287 |
| GO: 0006308 | DNA catabolic process | GLYMA15G07430, GLYMA01G20900, GLYMA15G07430, GLYMA01G20900 | 4286; 4322; 4286; 4322 |
| GO: 0006879 | cellular iron ion homeostasis | GLYMA13G27300, GLYMA13G27300 | 4291; 4291 |
| GO: 0006970 | response to osmotic stress | GLYMA05G32040, GLYMA09G41670, GLYMA05G32040, GLYMA03G05220, GLYMA09G41670, GLYMA18G44030 | 4292; 4201; 4292; 4148; 4201; 4253 |
| GO: 0008237 | metallopeptidase activity | GLYMA01G41750, GLYMA01G04350 | 4290; 4287 |
| GO: 0008270 | zinc ion binding | GLYMA01G41750, GLYMA01G04350, GLYMA03G33070, GLYMA09G26100, GLYMA03G33070, GLYMA03G42390, GLYMA04G04760, GLYMA04G09110, GLYMA06G04840, GLYMA10G44160, GLYMA13G19560, GLYMA17G35430, GLYMA19G35740, GLYMA19G35770 | 4290; 4287; 4305; 4335; 4305; 4154; 4158; 4159; 4316; 4206; 4228; 4248; 4259; 4321 |
| GO: 0009611 | response to wounding | GLYMA06G45240, GLYMA06G45280, GLYMA06G45370, GLYMA06G45410, GLYMA12G32750, GLYMA13G37720, GLYMA13G37770, GLYMA18G47390, GLYMA01G41290, GLYMA06G45240, GLYMA06G45370, GLYMA06G45410, GLYMA12G32750, GLYMA13G23680, GLYMA13G35820, GLYMA13G35850, GLYMA13G37720, GLYMA13G37750, GLYMA13G37770, GLYMA15G00570, GLYMA18G06810, GLYMA18G47390, GLYMA04G04760, GLYMA06G04840, GLYMA09G38930, GLYMA12G09830, GLYMA15G00570, GLYMA17G35430, GLYMA18G47390 | 4293; 4323; 4324; 4325; 4326; 4327; 4328; 4284; 4329; 4293; 4324; 4325; 4326; 4330; 4331; 4332; 4327; 4333; 4328; 4311; 4334; 4284; 4158; 4316; 4200; 4221; 4311; 4248; 4284 |
| GO: 0010120 | camalexin biosynthetic process | GLYMA03G05220, GLYMA09G41670, GLYMA18G44030 | 4148; 4201; 4253 |
| GO: 0016891 | endoribonuclease activity, producing 5'-phosphomonoesters | GLYMA15G07430, GLYMA15G07430 | 4286; 4286 |
| GO: 0034605 | cellular response to heat | GLYMA03G05220, GLYMA09G41670, GLYMA18G44030 | 4148; 4201; 4253 |
| GO: 0043765 | T/G mismatch-specific endonuclease activity | GLYMA15G07430, GLYMA15G07430 | 4286; 4286 |
| GO: 0046592 | polyamine oxidase activity | GLYMA10G11700, GLYMA10G11700 | 4294; 4294 |
| GO: 0050660 | flavin adenine dinucleotide binding | GLYMA04G12600, GLYMA10G11700, GLYMA10G11700, GLYMA19G44870, GLYMA04G12600, GLYMA04G12610, GLYMA19G44870 | 4162; 4294; 4294; 4336; 4162; 4163; 4336 |
| GO: 0070370 | cellular heat acclimation | GLYMA03G05220, GLYMA09G41670, GLYMA18G44030 | 4148; 4201; 4253 |
| GO: 0071369 | cellular response to ethylene stimulus | GLYMA13G27300, GLYMA13G27300 | 4291; 4291 |
| GO: 0071732 | cellular response to nitric oxide | GLYMA13G27300, GLYMA13G27300 | 4291; 4291 |

TABLE 502-continued

This table describes gene ontology terms which are significantly enriched or depleted in the set of genes differently expressed between soybean seedlings treated with an *Acremonium zea* sp. with neutral effects on soybean growth and soybean seedlings treated with a *Acremonium zea* sp. with beneficial effects on soybean growth.

| GO ID | GO Description | Gene ID | SEQ ID |
|---|---|---|---|
| GO: 0072593 | reactive oxygen species metabolic process | GLYMA04G35560 | 4289 |

"Genome count" represents the number of genes associated with the GO term that were found in the soybean genome. "Observed DEG count" represents the number of genes associated with the GO term that were differentially expressed in the Neutral v Beneficial contrast. "Expected DEG count" represents the number of genes associated with the GO term that are expected to be found by chance in a random set selection of that number of genes. "Status" represents whether genes with the GO term are over or under-represented in the set of DEGs. "Adj. p-value" represents the false discovery rate (Benjamini & Hochberg, 1995) adjusted p-values.

Genes that are modulated in soybean in response to treatment with a beneficial endophyte include those involved in a variety of plant processes, such as plant defense (including responses to chitin and wounding), stress responses (including salt stress, water deprivation, cold, ozone, heat, osmotic), defense against oxidative stress (oxidation-reduction process, monooxygenase activity, oxidation-reduction process, ion binding, nitric oxide). For example, expression of genes involved in the following processes were modulated: cell wall modification, defense response, oxidation-reduction process, biological process, regulation of transcription, metabolic process, glucosinolate biosynthetic process, response to karrikin, protein phosphorylation, protein folding, response to chitin, proteolysis, response to auxin stimulus, DNA-dependent regulation of transcription, N-terminal protein myristoylation, response to oxidative stress, cellular component, leaf senescence, resistance gene-dependent defense response signaling pathway, zinc ion binding, response to cold, malate metabolic process, transport, catalytic activity, response to ozone, VQ motif, regulation of systemic acquired resistance, potassium ion transport, anaerobic respiration, multicellular organismal development, response to heat, methyltransferase activity, response to wounding, oxidation-reduction process, monooxygenase activity, oxidation-reduction process, carbohydrate metabolic process, exocytosis, nuclear-transcribed mRNA poly(A) tail shortening, sodium ion transport, glycerol metabolic process, response to water deprivation, response to salt stress, and chlorophyll biosynthetic process.

Example 6: Functional Characterization of Endophytes (Microbe RNA-SEQ Experiments)

This Example describes the ability of synthetic compositions comprising plant seeds and a single endophyte strain or a plurality of endophyte strains described herein, to confer beneficial traits to a host plant. Among other things, this Example provides exemplary characterization of modulations in a beneficial endophyte's transcriptome in response to host plant interactions, as compared to transcriptome changes in the transcriptome of a neutral (e.g., non-beneficial and non-pathogenic) microbe of the same genus.

RNA sequencing was used to explore differences in mRNA expression of genes common to the two strains of *Acremonium zeae*.

Among other things, this Example describe the ability of host plants (e.g., host plants described herein, e.g., dicots, e.g., soy, peanuts, and monocots, e.g., corn, soy, wheat, cotton, sorghum) to differentially modulate the transcriptome of a beneficial endophyte as compared to the transcriptome of a neutral microbe of the same genus. This Example describes surprising and unexpected modulations in the transcriptome of a beneficial endophyte in response to whole plant homogenate, compared to a neutral fungal strain of the same genus.

In particular, this Example describes an exemplary transcriptomic comparison between the functional capacity of a beneficial fungal endophyte genome and the genome of a neutral fungal microbe of the same genus. Briefly, each set of microbial predicted genes was annotated with pathway and orthologous group information from the KEGG database. Pathways and ortholog groups appearing in one genome but not the other were extracted and manually explored for biological relevance to the phenotype differences.

Fungal Biomass

Beneficial (SYM00577) and neutral (SYM00300) fungal strains of *Acremonium zeae* were initially streaked onto PD agar and incubated at room temperature until colony formation. Distinct plugs consisting of spores and mycelia were used to inoculate 125 mL PD broth and cultured for 5 days at room temperature with agitation (200 RPM). Each strain was grown in three biological replicates in duplicates totaling 12 flasks.

On day 5 of culture, 1 mL of total plant homogenate obtained from 6 day old soybean seedlings extracted with 50 mM Phosphate-buffered saline (PBS) at a ratio of 2 mL buffer/gram plant mass was added to the fungi. The plant homogenate solution was prepared in three replicates, and each replicate was applied to the corresponding beneficial and neutral fungal cultures. One mL of PBS solution was applied to each fungal biological replicate as the negative control.

Fungal biomass was harvested 24 hours after the addition of either the plant homogenate or PBS only solutions by centrifuging at 4500 RPM for 20 minutes in 50 mL Falcon tubes to allow culture separation prior to the removal of supernatant. Fungal tissues were stored immediately in −80° C. until total RNA isolation using standard extraction method using TriReagent (Sigma-Aldrich, St. Louis, Mo., USA) and purification with RNeasy Mini Kit (Qiagen, Hilden, Germany).

Fungal RNA-SEQ

Initial quality control was performed using Agilent Bioanalyzer and Tapestation.

rRNA Depletion

1 μg of total RNA was subjected to rRNA depletion using the RiboZero Yeast kit (Epicentre Biotechnologies, Illumina.com, catalog # MRZY1306). Manufacturer's instructions were strictly followed to perform rRNA depletion.

Stranded cDNA Preparation

After rRNA depletion, depletedRNA was used to generate 1-2 ug of cDNA using: Illumina TruSeq Stranded Total RNA LT kit (Illumina.com, catalog # RS-122-2201). Manufacturer's instructions were strictly followed to perform cDNA construction; and library construction.

RNA Sequencing

Sequencing was performed on an Illumina HiSeq 2500, using Rapid run v2.0 chemistry which generated paired-end reads of 106 nucleotides according to Illumina manufacturer's instructions. The initial data analysis was started directly on the HiSeq 2500 System during the run. The HiSeq Control Software 2.2.58 in combination with RTA 1.18.64 (real time analysis) performed the initial image analysis and base calling. In addition, bcl2fastq1.8.4 generated and reported run statistics. Data was analyzed using FASTQC (Babraham Institute, Cambridge, UK) comprising the sequence information which was used for all subsequent bioinformatics analyses. Sequences were de-multiplexed according to the 6 bp index code with 1 mismatch allowed.

Analysis

Expression levels for each gene were quantified as transcripts per million (TPM) using Cufflinks. The Blast Best Reciprocal Hits (BRH) method was used to define orthologous groups for similar gene pairs across species. Expression was mapped directly to BRH groups to create an expression matrix and the limma method was used to uncover genes (1) differentially expressed with vs without plant homogenate within each species, (2) differentially expressed across species within each plant homogenate condition, and (3) responding differently to plant homogenate in the different species. The false discovery rate method was used to adjust p-values for multiple testing. In each case, significance was defined as adjusted p-value less than 0.05 and absolute log 2 fold change greater than 2.

Functional and Comparative Genomics

Prior to applying differential expression analysis, the functional capabilities of a beneficial and neutral *Acremonium zeae*, i.e., SYM00577 (beneficial) and SYM00300 (neutral), were contrasted at the gene function (GO) and pathway level. A shared goal of both the genome comparison and the transcriptome analyses was the construction of orthologous groups. In the case of comparative genomics, annotations of these orthologs provided an overview of shared capabilities, while for RNA-seq they provided anchors for comparison of expression data; i.e. rows in the expression matrix.

Differential KEGG Orthology Groups

The unique and shared orthology group (OG) terms were counted for SYM00577 and SYM00300. Most KO terms were shared by both strains, with 62 terms found in SYM00300 only, and 207 terms found in SYM00577 only, with 2,676 KO terms overlapping between both strains. This process was repeated for KEGG Pathways, and the total and shared number of pathways was again similar, with 324 of the pathways shared between strains. Unique pathways in SYM00577 that were not present in SYM00300, include, but are not limited to, indole diterpene alkaloid biosynthesis, biosynthesis of 12-, 14- and 16-membered macrolides, peptidoglycan biosynthesis, glycosphingolipid biosynthesis—lacto and neolacto series, indole alkaloid biosynthesis, type I polyketide structures, biosynthesis of siderophore group nonribosomal peptides, beta-Lactam resistance, sphingolipid signaling pathway, *Vibrio cholera* pathogenic cycle, central carbon metabolism in cancer, choline metabolism in cancer, and nicotinate and nicotinamide metabolism. Exemplary KEGG Pathway differences for SYM00577 are illustrated below in Table 600.

TABLE 600

| Exemplary KEGG Pathways present in SYM0577, but absent in SYM0300 | | |
|---|---|---|
| KEGG Term | KEGG Term Description | Number of Genes |
| ko00403 | Indole diterpene alkaloid biosynthesis | 1 |
| ko00522 | Biosynthesis of 12-, 14- and 16-memebered macrolides | 1 |
| ko00550 | Peptidoglycan biosynthesis | 2 |
| ko00601 | Glycosphingolipid biosynthesis - lacto and neolacto series | 1 |
| ko00901 | Indole alkaloid biosynthesis | 1 |
| ko01052 | Type I polyketide structures | 1 |
| ko01053 | Biosynthesis of siderophore group nonribosomal peptides | 2 |
| ko01501 | Beta-Lactam resistance | 7 |
| ko04071 | Sphingolipid signaling pathway | 46 |
| ko05111 | Vibrio cholera pathogenic cycle | 1 |
| ko05230 | Central carbon metabolism in cancer | 29 |
| ko05231 | Choline metabolism in cancer | 30 |

In the above example, the Sphingolipid signaling pathway included 46 genes. To determine whether all of the genes (i.e., orthologous groups) in the pathway were unique to only SYM00577, a query was performed to determine which of the Sphingolipid pathway genes in SYM00577 do not share any KEGG OG terms with SYM00300 genes.

Interestingly, even though the Sphingolipid Signaling Pathway annotation is attached to 46 genes in SYM00577 but no genes in SYM00300, only one orthologous group from that pathway (sphingomyelin phosphodiesterase, annotating 4 genes) is not present in SYM300.

Unique pathways in SYM00300 that were not present in SYM00577, include, but are not limited to, beta-Lactam resistance, DDT degradation, Flavone and flavonol biosynthesis, and ECM-receptor interaction. Exemplary KEGG Pathway differences for SYM00300 are illustrated below in Table 700.

TABLE 601

| Exemplary KEGG Pathways present in SYM0300, but absent in SYM0577 | | |
|---|---|---|
| KEGG Term | KEGG Term Description | Number of Genes |
| ko00312 | Beta-Lactam resistance | 4 |
| ko00351 | DDT degradation | 3 |
| ko00944 | Flavone and flavonol biosynthesis | 1 |
| ko04512 | ECM-receptor interaction | 2 |

Blast Best Reciprocal Hits (BBRH)

The NCBI Blast+ software was installed and used to build blast databases from each set of amino acid sequences, then each transcriptome was blasted against the database created from the other. Best Reciprocal Hits (BRH) were calculated by filtering for high percent identity, gathering the best hits, and joining the targets from one output with the queries from the other. The result was a query-target-reciprocal trio, which was filtered for trios where the query was the same as its reciprocal. The e-value and bitscores from the two blast outputs were averaged (since they are asymmetric) for the BRH pairs, and an ortholog group identifier was created.

Calculation of in-Paralogs

In-paralogs are paralogs that are the result of speciation first, then duplication of the genes later. In-paralogs are more likely to retain the same function as the ortholog than out-paralogs, which represent duplication, followed by speciation. Considering the high proportion of SYM00300 genes that have BRH orthologs, along with the realization that SYM00577 has nearly twice as many transcripts, we considered the possibility of a major genome duplication event somewhere in the phylogenetic history of SYM00577, and extended the orthologous groups to include in-paralogs.

An important step after BRH is, for each orthologous pair, to include same-species genes more similar to each member of the pair than the cross-species ortholog similarity. This was accomplished using all-versus-all Blast within the same species, to expand our orthologous groups.

Another approach to building ortholog groups was to apply a threshold to the same-species hits for each member of the ortholog pairs. To find the best threshold, we explored the distribution of scores in these BRH/same-species tables described above, normalizing by the ortholog score.

RNA-SEQ Cross-Species Comparison

RNA-seq cufflinks FPKM values were generated for two species of fungus (*Acremonium zeae*), with three biological replicates each. An expression matrix was built using orthologouos groups, to explore the structure of the data, characterize data quality, and to elucidate pathway-level expression differences between SYM00577 and SYM00300.

TABLE 602

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 694 | g3058.t1 | 2499 | g1604.t1 | | 0 | 5.625962 | 5.651891 | 7.35527 | 14.19007 | 8.51E−06 |
| 695 | g3790.t1 | 2501 | g2628.t1 | K12486: SMAP | 0 | 6.121031 | 5.983809 | 6.039604 | 11.33524 | 1.91E−05 |
| 681 | g4581.t1 | 3296 | g4123.t1 | K00574: E2.1.1.79, cfa | 0.511902 | 7.31261 | 7.115847 | 5.836125 | 10.97939 | 2.24E−05 |
| 682 | g9772.t1 | 3297 | g936.t1 | K06874: K06874 | 1.832874 | 7.06298 | 5.150347 | 5.58339 | 10.56106 | 2.71E−05 |
| 1454 | g3066.t1 | 2510 | g11773.t1 | | 0 | 4.229364 | 4.33707 | 5.111231 | 9.840967 | 4.33E−05 |
| 1455 | g2768.t1 | 3298 | g9143.t1 | K03937: NDUFS4 | 0 | 3.159447 | 3.192054 | 5.100931 | 9.826062 | 4.35E−05 |
| 1456 | g21086.t1 | 2530 | g6575.t1 | | 6.213302 | 0 | −6.32587 | 4.86651 | −9.49529 | 5.53E−05 |
| 1457 | g13116.t1 | 2518 | g7771.t1 | | 0 | 4.229765 | 4.831879 | 4.862002 | 9.489083 | 5.54E−05 |
| 1458 | g900.t1 | 3299 | g9375.t1 | | 0 | 2.925165 | 2.991998 | 4.824313 | 9.437402 | 5.73E−05 |
| 693 | g2076.t1 | 2498 | g2520.t1 | | 3.957232 | 13.01167 | 9.729519 | 4.68583 | 9.250787 | 6.67E−05 |
| 1459 | g5141.t1 | 3300 | g3839.t1 | K06662: HRAD17, RAD24 | 1.158624 | 7.175348 | 6.392146 | 4.57545 | 9.105599 | 7.49E−05 |
| 1460 | g10898.t1 | 2515 | g5903.t1 | | 0 | 2.733166 | 2.603795 | 4.241238 | 8.683922 | 0.000107 |
| 1461 | g19933.t1 | 3301 | g3124.t1 | K10885: XRCC5, KU80, G22P2 | 0 | 2.454643 | 2.568635 | 4.162803 | 8.588628 | 0.000116 |
| 685 | g6380.t1 | 2492 | g764.t1 | K05857: PLCD | 3.201415 | 9.359327 | 5.628694 | 3.892588 | 8.270189 | 0.000152 |
| 689 | g849.t1 | 2496 | g9453.t1 | K06997: K06997 | 2.698993 | 7.96329 | 5.067599 | 3.750578 | 8.108628 | 0.000171 |
| 1462 | g156.t1 | 3302 | g5221.t1 | | 0 | 2.981748 | 2.98057 | 3.513183 | 7.846843 | 0.000215 |
| 1463 | g10541.t1 | 3303 | g6687.t1 | K17862: PPOC | 0 | 2.880335 | 2.956642 | 3.496903 | 7.829254 | 0.000219 |
| 1464 | g15671.t1 | 3304 | g6482.t1 | K11771: SWI1, ADR6 | 0 | 2.123699 | 2.319853 | 3.367017 | 7.690534 | 0.000246 |
| 1465 | g5602.t1 | 2531 | g7524.t1 | K14774: UTP25, DEF | 0 | 4.214818 | 5.146089 | 3.215759 | 7.532472 | 0.000282 |
| 1466 | g4223.t1 | 3305 | g1757.t1 | | 2.289499 | 7.236816 | 5.448174 | 3.206971 | 7.523401 | 0.000284 |
| 684 | g2536.t1 | 3306 | g3569.t1 | | 9.671862 | 2.518007 | −7.85736 | 3.098463 | −7.41238 | 0.000316 |
| 1467 | g8228.t1 | 3307 | g10052.t1 | K01674: cah | 5.638975 | 1.15932 | −4.58017 | 2.941341 | −7.25475 | 0.000366 |
| 1468 | g10616.t1 | 3308 | g4156.t1 | K15562: BUR1, SGV1 | 0 | 4.260933 | 4.233331 | 2.939239 | 7.252662 | 0.000366 |
| 1469 | g10359.t1 | 3309 | g7715.t1 | | 2.199706 | 9.30437 | 7.40778 | 2.907247 | 7.221016 | 0.000378 |
| 1470 | g12048.t1 | 3310 | g810.t1 | | 0.205106 | 6.22836 | 5.696498 | 2.79987 | 7.11586 | 0.000412 |
| 1471 | g7057.t1 | 3311 | g6310.t1 | K05610: UCHL5, UCH37 | 2.367427 | 6.390825 | 4.178102 | 2.772937 | 7.089735 | 0.000422 |
| 680 | g1340.t1 | 2553 | g523.t1 | | 0 | 5.30819 | 5.122003 | 2.739527 | 7.057466 | 0.000434 |
| 1472 | g5411.t1 | 3312 | g8610.t1 | | 0 | 5.724304 | 5.482331 | 2.691237 | 7.011091 | 0.000454 |
| 1474 | g2755.t1 | 3314 | g9155.t1 | K13106: BUD13, CWC26 | 0 | 2.648734 | 2.611976 | 2.63723 | 6.959594 | 0.000475 |
| 1473 | g9212.t1 | 3313 | g11325.t1 | K03380: E1.14.13.7 | 0.695829 | 8.890455 | 7.737352 | 2.638623 | 6.960917 | 0.000475 |
| 1475 | g7541.t1 | 3315 | g7266.t1 | K01230: MAN1 | 0.593738 | 3.991249 | 3.523245 | 2.589692 | 6.914582 | 0.000494 |
| 1476 | g10543.t1 | 3316 | g6689.t1 | K11866: STAMBP, AMSH | 0 | 2.512821 | 2.348519 | 2.557397 | 6.88417 | 0.000506 |
| 1477 | g1098.t1 | 3317 | g4042.t1 | | 0 | 8.363912 | 7.407417 | 2.550651 | 6.877834 | 0.000509 |
| 1478 | g5757.t1 | 3318 | g5200.t1 | K16261: YAT | 2.629263 | 6.731656 | 4.004055 | 2.491406 | 6.822441 | 0.000533 |
| 1479 | g6616.t1 | 3319 | g11275.t1 | K00128: E1.2.1.3 | 14.15644 | 4.764987 | −7.9496 | 2.391867 | −6.73036 | 0.000579 |
| 676 | g7741.t1 | 2557 | g7091.t1 | | 7.176506 | 3.981694 | −3.40286 | 2.312767 | −6.65805 | 0.000618 |
| 1480 | g3094.t1 | 3320 | g11797.t1 | K02155: ATPeV0C, ATP6L | 0.181741 | 4.905207 | 4.139345 | 2.177837 | 6.536419 | 0.000699 |
| 1481 | g4793.t1 | 3321 | g3693.t1 | | 0.802943 | 6.094219 | 5.125954 | 2.035034 | 6.409958 | 0.00079 |
| 1482 | g4553.t1 | 3322 | g4081.t1 | | 1.09266 | 4.629 | 3.630404 | 1.987031 | 6.367956 | 0.000827 |
| 1483 | g2790.t1 | 3323 | g5023.t1 | | 2.621767 | 6.913986 | 4.339207 | 1.945501 | 6.331819 | 0.000856 |
| 1484 | g12353.t1 | 3324 | g12077.t1 | | 7.044527 | 1.163008 | −6.15638 | 1.883313 | −6.27805 | 0.0009 |
| 1485 | g9391.t1 | 2535 | g3643.t1 | K12821: PRPF40, PRP40 | 3.337644 | 7.951706 | 4.079618 | 1.87347 | 6.269579 | 0.000908 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 1486 | g501.t1 | 2522 | g5516.t1 | K11713: PGTB1 | 0.17786 | 7.158208 | 5.970183 | 1.860221 | 6.25819 | 0.000918 |
| 1487 | g4315.t1 | 3325 | g1973.t1 | K00507: SCD, desC | 2.439884 | 8.285639 | 5.723788 | 1.809797 | 6.215014 | 0.000956 |
| 1488 | g9843.t1 | 3326 | g9771.t1 | K00799: GST, gst | 8.277156 | 1.535981 | −6.40337 | 1.808206 | −6.21366 | 0.000956 |
| 1489 | g11092.t1 | 3327 | g7982.t1 | | 2.025136 | 6.798845 | 4.871183 | 1.802892 | 6.209122 | 0.000958 |
| 1490 | g11703.t1 | 3328 | g6616.t1 | K01785: galM, GALM | 5.853172 | 0.587191 | −5.06599 | 1.752712 | −6.16645 | 0.001006 |
| 1491 | g11062.t1 | 3329 | g1580.t1 | | 0 | 8.467134 | 6.867295 | 1.691984 | 6.115148 | 0.001064 |
| 1492 | g13143.t1 | 3330 | g4290.t1 | K10878: SPO11 | 0 | 2.383986 | 2.169112 | 1.68932 | 6.112906 | 0.001065 |
| 1493 | g10366.t1 | 2548 | g5460.t1 | | 0 | 4.099839 | 3.972778 | 1.675269 | 6.101093 | 0.001078 |
| 1494 | g9622.t1 | 3331 | g7240.t1 | K01648: ACLY | 0 | 2.029549 | 2.402941 | 1.580259 | 6.02172 | 0.00118 |
| 677 | g13489.t1 | 2556 | g8733.t1 | | 4.049293 | 1.53096 | −2.39019 | 1.568038 | −6.01157 | 0.001191 |
| 1495 | g11681.t1 | 3332 | g10864.t1 | K01081: E3.1.3.5 | 2.030435 | 5.800198 | 3.546964 | 1.557877 | 6.003149 | 0.001197 |
| 1496 | g13112.t1 | 3333 | g7720.t1 | | 0 | 2.5721 | 2.197403 | 1.547012 | 5.99415 | 0.001208 |
| 1497 | g6237.t1 | 2500 | g7135.t1 | | 4.217621 | 11.98228 | 7.390343 | 1.524373 | 5.975438 | 0.00123 |
| 1498 | g5325.t1 | 2546 | g2235.t1 | K17794: TIM23 | 5.393638 | 9.737867 | 4.665515 | 1.490748 | 5.947736 | 0.001262 |
| 1499 | g7356.t1 | 3334 | g10411.t1 | | 5.363476 | 2.004245 | −4.00808 | 1.46351 | −5.92537 | 0.001296 |
| 1500 | g502.t1 | 2516 | g5517.t1 | | 6.13678 | 0.881592 | −5.04567 | 1.401059 | −5.87436 | 0.001355 |
| 1501 | g8003.t1 | 3335 | g3392.t1 | | 1.075006 | 6.028587 | 4.451645 | 1.395621 | 5.869934 | 0.001362 |
| 691 | g5563.t1 | 2493 | g7478.t1 | | 4.683265 | 9.926473 | 4.734657 | 1.388209 | 5.863907 | 0.00137 |
| 1502 | g973.t1 | 3336 | g8044.t1 | K12733: PPIL1 | 0 | 4.446627 | 4.444962 | 1.37841 | 5.855946 | 0.001379 |
| 1503 | g9616.t1 | 3337 | g7246.t1 | | 0 | 3.761644 | 3.227741 | 1.346391 | 5.829996 | 0.001416 |
| 1504 | g2349.t1 | 3338 | g9226.t1 | K10865: MRE11 | 5.092776 | 8.748668 | 3.95033 | 1.335801 | 5.821433 | 0.001427 |
| 1505 | g2683.t1 | 2507 | g4140.t1 | | 5.881648 | 1.482684 | −3.92467 | 1.322012 | −5.8103 | 0.001445 |
| 1506 | g3045.t1 | 2533 | g1615.t1 | | 3.526626 | 10.01023 | 6.461973 | 1.267461 | 5.766418 | 0.00152 |
| 1507 | g2056.t1 | 3339 | g2541.t1 | | 0 | 2.16783 | 2.561107 | 1.216459 | 5.725628 | 0.001583 |
| 521 | g11059.t1 | 2317 | g2900.t1 | K01074: PPT | 0 | 3.417929 | 3.812645 | 1.160246 | 5.680931 | 0.001668 |
| 1508 | g7593.t1 | 3340 | g7644.t1 | K10577: UBE2I, UBC9 | 5.000466 | 0 | −4.49434 | 1.150461 | −5.67318 | 0.001683 |
| 1509 | g1121.t1 | 3341 | g220.t1 | | 0.238182 | 9.960466 | 8.035072 | 1.140622 | 5.665391 | 0.00169 |
| 1510 | g13554.t1 | 3342 | g4591.t1 | | 0 | 7.155818 | 7.18618 | 1.13793 | 5.663262 | 0.001694 |
| 1511 | g10068.t1 | 3343 | g4260.t1 | | 3.254602 | 6.373357 | 2.860288 | 1.096613 | 5.630659 | 0.001757 |
| 1512 | g3061.t1 | 3344 | g11768.t1 | | 0 | 2.736145 | 2.449758 | 1.082316 | 5.619411 | 0.001776 |
| 1513 | g7120.t1 | 3345 | g5585.t1 | K01537: E3.6.3.8 | 6.177509 | 2.088352 | −4.42526 | 1.079268 | −5.61702 | 0.001776 |
| 1514 | g1980.t1 | 3346 | g6240.t1 | | 4.780929 | 1.696677 | −3.47296 | 1.055478 | −5.59834 | 0.001816 |
| 1515 | g15450.t1 | 3347 | g6505.t1 | | 0 | 3.663174 | 4.662175 | 1.041385 | 5.587303 | 0.001837 |
| 1516 | g10937.t1 | 3348 | g9861.t1 | | 3.34381 | 8.292693 | 5.149782 | 1.007277 | 5.560652 | 0.001901 |
| 1517 | g2104.t1 | 3349 | g2481.t1 | | 0 | 8.858449 | 6.876201 | 0.947423 | 5.514113 | 0.00201 |
| 1518 | g1101.t1 | 3350 | g4046.t1 | | 0 | 4.4026 | 5.770884 | 0.936128 | 5.505363 | 0.002025 |
| 678 | g2539.t1 | 2558 | g3572.t1 | | 2.326788 | 6.873537 | 4.818842 | 0.882431 | 5.463904 | 0.002121 |
| 1519 | g3140.t1 | 3351 | g5042.t1 | | 0 | 2.321166 | 2.269216 | 0.871446 | 5.45545 | 0.002145 |
| 1520 | g5369.t1 | 3352 | g9557.t1 | | 3.908588 | 6.910264 | 3.013639 | 0.855938 | 5.443533 | 0.002178 |
| 1521 | g12261.t1 | 3353 | g7374.t1 | K00480: E1.14.13.1 | 0 | 8.154209 | 8.090694 | 0.846077 | 5.435964 | 0.002195 |
| 1522 | g9519.t1 | 3354 | g6593.t1 | K03126: TAF12 | 0 | 9.766076 | 7.663496 | 0.828036 | 5.422137 | 0.002231 |
| 686 | g857.t1 | 2491 | g9451.t1 | K01950: E6.3.5.1, NADSYN1, QNS1, nadE | 3.88692 | 0.53345 | −3.15682 | 0.77121 | −5.37875 | 0.002339 |
| 1523 | g8434.t1 | 2550 | g10211.t1 | | 0 | 5.304746 | 5.464585 | 0.750938 | 5.363328 | 0.002378 |
| 1524 | g6597.t1 | 3355 | g10126.t1 | | 0 | 4.518563 | 5.208532 | 0.74287 | 5.3572 | 0.002397 |
| 1525 | g5093.t1 | 3356 | g2950.t1 | K14688: SLC30A1, ZNT1 | 0 | 2.409393 | 2.458919 | 0.737239 | 5.352927 | 0.0024 |
| 1526 | g823.t1 | 3357 | g8190.t1 | | 3.431051 | 7.673807 | 3.935357 | 0.734868 | 5.351128 | 0.002404 |
| 1527 | g839.t1 | 3358 | g9466.t1 | | 0 | 4.219241 | 4.683516 | 0.682084 | 5.311188 | 0.002522 |
| 1528 | g13121.t1 | 3359 | g11183.t1 | | 0 | 6.54144 | 6.317655 | 0.656359 | 5.291798 | 0.002581 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 1529 | g847.t1 | 3360 | g9458.t1 | | 8.023071 | 3.66916 | −3.61918 | 0.631424 | −5.27305 | 0.002636 |
| 1530 | g4627.t1 | 3361 | g6024.t1 | | 0.792826 | 6.42714 | 5.759738 | 0.630803 | 5.272583 | 0.002636 |
| 1531 | g10595.t1 | 3362 | g10624.t1 | K17987: NBR1 | 0 | 2.09236 | 2.123128 | 0.620131 | 5.264574 | 0.00266 |
| 1532 | g12318.t1 | 3363 | g7423.t1 | K00166: BCKDHA, bkdA1 | 0 | 2.598413 | 2.602354 | 0.593035 | 5.244275 | 0.002723 |
| 1533 | g12695.t1 | 3364 | g8902.t1 | K10842: MNAT1 | 0 | 3.108472 | 2.951239 | 0.560072 | 5.219651 | 0.002803 |
| 1534 | g14294.t1 | 3365 | g4038.t1 | K02980: RP-S29e, RPS29 | 5.882987 | 3.465017 | −2.42606 | 0.543504 | −5.2073 | 0.002847 |
| 1535 | g7862.t1 | 3366 | g10519.t1 | K13690: CMT1 | 4.585103 | 6.930322 | 2.588027 | 0.531605 | 5.198448 | 0.002873 |
| 1536 | g2863.t1 | 3367 | g11267.t1 | | 0.167864 | 4.829719 | 5.552288 | 0.513015 | 5.184633 | 0.002917 |
| 1537 | g1455.t1 | 2542 | g6968.t1 | | 4.374836 | 10.80524 | 6.455862 | 0.511076 | 5.183194 | 0.00292 |
| 1538 | g2438.t1 | 3368 | g6704.t1 | | 9.091153 | 1.287615 | −7.87656 | 0.465153 | −5.14918 | 0.003038 |
| 1539 | g667.t1 | 3369 | g2708.t1 | K10256: FAD2 | 0.327373 | 4.952806 | 4.589933 | 0.444695 | 5.134069 | 0.003073 |
| 1540 | g4890.t1 | 3370 | g4524.t1 | K01530: E3.6.3.1 | 5.691668 | 0.913041 | −4.25594 | 0.443497 | −5.13319 | 0.003074 |
| 1542 | g2756.t1 | 3372 | g9154.t1 | | 0 | 2.205609 | 2.199562 | 0.441939 | 5.132036 | 0.003074 |
| 1541 | g20204.t1 | 3371 | g9206.t1 | K00274: MAO, aofH | 0 | 6.517404 | 6.487337 | 0.442311 | 5.132311 | 0.003074 |
| 1543 | g2398.t1 | 3373 | g9298.t1 | | 0 | 5.749657 | 5.429453 | 0.437917 | 5.12907 | 0.003085 |
| 1544 | g9984.t1 | 3374 | g9679.t1 | | 0 | 7.061175 | 7.03614 | 0.33213 | 5.051456 | 0.003396 |
| 1545 | g15304.t1 | 3375 | g10452.t1 | | 1.631174 | 5.484335 | 3.961905 | 0.302009 | 5.029495 | 0.00348 |
| 1547 | g1470.t1 | 3377 | g6945.t1 | | 6.211143 | 0.601353 | −6.20846 | 0.295485 | −5.02475 | 0.003494 |
| 1546 | g11003.t1 | 3376 | g1982.t1 | | 0 | 6.436399 | 5.197988 | 0.296732 | 5.025654 | 0.003494 |
| 1548 | g142.t1 | 3378 | g5823.t1 | K09051: SKO1, ATF1, PCR1 | 2.033429 | 6.991069 | 5.119512 | 0.271682 | 5.007443 | 0.003566 |
| 1549 | g39.t1 | 3379 | g2832.t1 | K04450: ATF2, CREBP1 | 2.082302 | 6.377889 | 3.852174 | 0.21306 | 4.964987 | 0.003764 |
| 1550 | g8675.t1 | 3380 | g10949.t1 | | 4.582792 | 1.158136 | −3.14557 | 0.202072 | −4.95705 | 0.003807 |
| 1551 | g1012.t1 | 3381 | g8081.t1 | K01027: OXCT | 5.414227 | 8.052451 | 2.663064 | 0.177006 | 4.938984 | 0.003878 |
| 1552 | g2399.t1 | 3382 | g9299.t1 | | 1.458025 | 7.000976 | 4.992111 | 0.176335 | 4.938501 | 0.003878 |
| 1553 | g6515.t1 | 3383 | g2075.t1 | K02950: RP-S12, MRPS12, rpsL | 1.845883 | 4.922544 | 2.936732 | 0.153955 | 4.922403 | 0.003952 |
| 1554 | g6586.t1 | 2539 | g10115.t1 | | 5.631067 | 0.472025 | −4.60323 | 0.143733 | −4.91506 | 0.003983 |
| 1555 | g8523.t1 | 3384 | g6295.t1 | | 0 | 7.66857 | 6.377663 | 0.128487 | 4.904122 | 0.004038 |
| 1556 | g6667.t1 | 3385 | g2221.t1 | | 2.68424 | 6.205712 | 2.966025 | 0.118613 | 4.897045 | 0.00407 |
| 1557 | g12827.t1 | 3386 | g7851.t1 | | 0 | 4.848962 | 3.8249 | 0.081084 | 4.870203 | 0.004213 |
| 1558 | g5681.t1 | 3387 | g2305.t1 | | 0 | 5.574437 | 5.607999 | 0.076246 | 4.866749 | 0.004223 |
| 1559 | g8598.t1 | 3388 | g11593.t1 | | 3.906492 | 6.364882 | 2.414039 | 0.063154 | 4.857409 | 0.004267 |
| 1560 | g14604.t1 | 3389 | g6507.t1 | | 0.987454 | 5.421424 | 4.548644 | 0.028742 | 4.83291 | 0.004395 |
| 1561 | g3926.t1 | 2519 | g3966.t1 | | 5.357872 | 3.212704 | −2.19688 | −0.01172 | −4.8042 | 0.00456 |
| 1562 | g3438.t1 | 3390 | g4707.t1 | | 1.724857 | 6.502863 | 4.96045 | −0.02749 | 4.793029 | 0.004613 |
| 1563 | g1922.t1 | 3391 | g6158.t1 | K08334: BECN1, VPS30, ATG6 | 0.398499 | 5.785388 | 4.960056 | −0.03595 | 4.787047 | 0.004637 |
| 1564 | g3435.t1 | 3392 | g4711.t1 | | 0 | 8.300404 | 6.565756 | −0.04588 | 4.780026 | 0.004676 |
| 1565 | g11568.t1 | 3393 | g4160.t1 | K11322: EPC | 2.908649 | 5.395163 | 2.502674 | −0.05175 | 4.775878 | 0.004698 |
| 1566 | g4022.t1 | 3394 | g3195.t1 | | 6.571337 | 1.444687 | −5.93348 | −0.05319 | −4.77486 | 0.004702 |
| 1567 | g1119.t1 | 3395 | g218.t1 | K15161: CCNC, SSN8 | 0 | 4.698233 | 4.08668 | −0.05414 | 4.774192 | 0.004703 |
| 1568 | g5372.t1 | 3396 | g9560.t1 | | 5.009004 | 0.930924 | −4.29137 | −0.05628 | −4.77268 | 0.00471 |
| 1569 | g8513.t1 | 3397 | g6303.t1 | K01417: E3.4.24.— | 2.66779 | 6.304272 | 3.371495 | −0.06746 | 4.764793 | 0.004752 |
| 1570 | g10723.t1 | 3398 | g4265.t1 | K15078: SLX1 | 6.249677 | 1.09824 | −5.32732 | −0.07338 | −4.76062 | 0.004767 |
| 1571 | g7955.t1 | 3399 | g10265.t1 | | 7.449289 | 0.568709 | −6.91497 | −0.08661 | −4.7513 | 0.004818 |
| 1572 | g8436.t1 | 3400 | g7726.t1 | K08257: E3.2.1.101 | 0 | 5.100303 | 5.10056 | −0.1098 | 4.73499 | 0.004903 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 1573 | g1465.t1 | 3401 | g6950.t1 | | 4.476144 | 0.61942 | −4.17994 | −0.11145 | −4.73383 | 0.004908 |
| 1574 | g2407.t1 | 3402 | g9484.t1 | K13127: RNF113A, CWC24 | 7.768564 | 2.987939 | −3.79401 | −0.11976 | −4.728 | 0.00494 |
| 1575 | g2487.t1 | 3403 | g3514.t1 | K15192: BTAF1, MOT1 | 3.532261 | 7.801782 | 4.747107 | −0.1259 | 4.723684 | 0.00496 |
| 1576 | g6309.t1 | 3404 | g3004.t1 | | 2.982283 | 6.81987 | 3.754204 | −0.13074 | 4.720289 | 0.004976 |
| 1577 | g1705.t1 | 3405 | g4639.t1 | | 1.748524 | 7.933591 | 6.241738 | −0.13773 | 4.715388 | 0.005007 |
| 1578 | g6321.t1 | 3406 | g3017.t1 | | 9.8442 | 5.01489 | −4.79374 | −0.14476 | −4.71045 | 0.005035 |
| 1579 | g4284.t1 | 3407 | g1936.t1 | K18174: COA2 | 1.986154 | 6.571374 | 4.216021 | −0.15159 | 4.705676 | 0.005055 |
| 1580 | g20937.t1 | 3408 | g7417.t1 | K01266: dmpA | 1.071718 | 4.362008 | 3.114427 | −0.16727 | 4.694696 | 0.005126 |
| 1581 | g6962.t1 | 3409 | g6429.t1 | | 5.332152 | 0.25936 | −5.40138 | −0.16906 | −4.69345 | 0.005132 |
| 1582 | g18713.t1 | 3410 | g4630.t1 | K03083: GSK3B | 1.333651 | 4.783178 | 4.745248 | −0.17254 | 4.69101 | 0.005148 |
| 1583 | g8296.t1 | 3411 | g5088.t1 | | 5.102827 | 0.74787 | −5.06033 | −0.17731 | −4.68768 | 0.005171 |
| 1584 | g1028.t1 | 3412 | g8097.t1 | K10352: MYH | 0 | 5.91366 | 5.909517 | −0.18093 | 4.685146 | 0.005187 |
| 1585 | g7984.t1 | 3413 | g10232.t1 | | 4.17451 | 0 | −3.96717 | −0.18723 | −4.68075 | 0.005215 |
| 1586 | g2260.t1 | 3414 | g10672.t1 | | 0 | 11.59719 | 8.078404 | −0.20485 | 4.668452 | 0.005296 |
| 1587 | g2057.t1 | 3415 | g2540.t1 | | 0 | 3.495725 | 2.912854 | −0.21761 | 4.659559 | 0.005358 |
| 1265 | g16176.t1 | 2509 | g5232.t1 | | 4.464184 | 8.046322 | 3.412183 | −0.22053 | 4.657525 | 0.005368 |
| 1588 | g710.t1 | 3416 | g9945.t1 | | 3.004512 | 5.305027 | 3.457727 | −0.26143 | 4.629086 | 0.005573 |
| 1589 | g11909.t1 | 3417 | g11960.t1 | K00967: PCYT2 | 4.581714 | 0.355634 | −4.34247 | −0.2642 | −4.62716 | 0.005582 |
| 1590 | g133.t1 | 3418 | g5828.t1 | | 0 | 6.458979 | 5.351051 | −0.2661 | 4.625846 | 0.005584 |
| 1591 | g16811.t1 | 3419 | g6747.t1 | | 5.812564 | 0.429992 | −4.86386 | −0.27492 | −4.61972 | 0.005629 |
| 1592 | g1007.t1 | 3420 | g8077.t1 | | 8.250805 | 2.385735 | −4.65062 | −0.27955 | −4.61651 | 0.005649 |
| 1593 | g2691.t1 | 3421 | g3101.t1 | | 6.59247 | 0.374474 | −6.18721 | −0.28128 | −4.61531 | 0.005656 |
| 1594 | g941.t1 | 3422 | g9318.t1 | K01067: E3.1.2.1, ACH1 | 1.499245 | 7.499861 | 6.073538 | −0.318 | 4.5899 | 0.005824 |
| 1595 | g4067.t1 | 3423 | g3251.t1 | | 3.814933 | 6.244839 | 2.600899 | −0.32454 | 4.585383 | 0.005862 |
| 1596 | g7999.t1 | 3424 | g3379.t1 | | 3.95884 | 1.293984 | −3.01927 | −0.36383 | −4.55828 | 0.006086 |
| 1597 | g6280.t1 | 3425 | g12254.t1 | K13719: OTU1, YOD1 | 10.87548 | 3.850161 | −7.09783 | −0.38264 | −4.54533 | 0.006175 |
| 1598 | g2441.t1 | 3426 | g6710.t1 | | 7.528783 | 1.563904 | −5.0227 | −0.39468 | −4.53706 | 0.006224 |
| 1599 | g6940.t1 | 3427 | g6448.t1 | | 0 | 6.016039 | 5.937675 | −0.41441 | 4.523508 | 0.006341 |
| 1601 | g5186.t1 | 3429 | g3777.t1 | K02934: RP-L6e, RPL6 | 4.28578 | 0 | −4.72311 | −0.41768 | −4.52127 | 0.006349 |
| 1600 | g3254.t1 | 3428 | g8225.t1 | | 0 | 5.869262 | 5.544325 | −0.41746 | 4.521417 | 0.006349 |
| 1602 | g2757.t1 | 3430 | g9153.t1 | K15053: CHMP7 | 0 | 2.528581 | 2.167777 | −0.42072 | 4.519182 | 0.006365 |
| 1603 | g8191.t1 | 3431 | g9716.t1 | | 2.640244 | 5.393849 | 2.932616 | −0.42423 | 4.51677 | 0.006385 |
| 1604 | g41.t1 | 2544 | g2830.t1 | K10740: RPA3 | 5.456896 | 1.684193 | −3.50612 | −0.43149 | −4.5118 | 0.006426 |
| 1605 | g7930.t1 | 3432 | g2853.t1 | K01077: E3.1.3.1, phoA, phoB | 5.436852 | 2.710109 | −4.15755 | −0.43376 | −4.51024 | 0.006432 |
| 1606 | g9899.t1 | 3433 | g3476.t1 | | 0 | 5.790708 | 5.501572 | −0.43434 | 4.509842 | 0.006432 |
| 1607 | g6747.t1 | 3434 | g4361.t1 | K08793: STK32, YANK | 1.640577 | 7.804707 | 6.025167 | −0.43912 | 4.506569 | 0.006449 |
| 1609 | g3450.t1 | 3436 | g4695.t1 | K11319: ING3 | 7.793056 | 1.832762 | −5.3581 | −0.44607 | −4.50182 | 0.006476 |
| 1608 | g13903.t1 | 3435 | g687.t1 | K01426: E3.5.1.4, amiE | 2.308161 | 5.757553 | 3.146851 | −0.44596 | 4.501889 | 0.006476 |
| 1610 | g4174.t1 | 3437 | g1802.t1 | K03164: TOP2 | 0 | 4.461914 | 4.257824 | −0.44926 | 4.499626 | 0.006485 |
| 1611 | g1817.t1 | 3438 | g1704.t1 | K13941: folKP | 1.569971 | 6.747653 | 4.234672 | −0.45137 | 4.498183 | 0.00649 |
| 1612 | g16037.t1 | 3439 | g4108.t1 | K01744: aspA | 4.664569 | 6.76341 | 2.175875 | −0.45455 | 4.496007 | 0.006508 |
| 1613 | g10914.t1 | 3440 | g5925.t1 | | 1.756741 | 4.535424 | 3.244364 | −0.46789 | 4.486892 | 0.006589 |
| 1614 | g138.t1 | 3441 | g3729.t1 | | 4.847226 | 0.925828 | −5.03041 | −0.47101 | −4.48476 | 0.006598 |
| 1615 | g2936.t1 | 3442 | g5964.t1 | | 8.044894 | 0.248534 | −6.73944 | −0.47284 | −4.4835 | 0.006601 |
| 1616 | g8866.t1 | 3443 | g2108.t1 | K13339: PEX6, PXAAA1 | 11.8966 | 2.107495 | −8.86497 | −0.48781 | −4.47329 | 0.006671 |
| 1617 | g4740.t1 | 3444 | g2014.t1 | K02606: ORC4 | 4.269663 | 1.432791 | −2.74295 | −0.48799 | −4.47317 | 0.006671 |
| 1618 | g17490.t1 | 3445 | g10534.t1 | K10777: LIG4, DNL4 | 1.37437 | 7.556488 | 5.810689 | −0.48948 | 4.472145 | 0.006674 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 1619 | g6095.t1 | 3446 | g7353.t1 | | 10.01399 | 0.524763 | −9.03171 | −0.51858 | −4.45231 | 0.006833 |
| 1620 | g1092.t1 | 3447 | g4035.t1 | | 1.619955 | 5.721483 | 3.640435 | −0.53362 | 4.442078 | 0.006907 |
| 1621 | g12252.t1 | 3448 | g235.t1 | | 0.132439 | 3.243255 | 3.821541 | −0.53381 | 4.441948 | 0.006907 |
| 1622 | g6796.t1 | 3449 | g4421.t1 | K03680: EIF2B4 | 5.126406 | 0.843849 | −4.22061 | −0.54287 | −4.43579 | 0.006966 |
| 1623 | g797.t1 | 3450 | g8161.t1 | | 0 | 3.053206 | 2.866046 | −0.55063 | 4.430521 | 0.007005 |
| 1624 | g5647.t1 | 3451 | g1105.t1 | | 5.271321 | 0.695521 | −5.99485 | −0.556 | −4.42687 | 0.007028 |
| 1625 | g15866.t1 | 3452 | g9844.t1 | | 2.040941 | 8.117785 | 5.437517 | −0.57127 | 4.416512 | 0.007114 |
| 1626 | g6617.t1 | 3453 | g11274.t1 | K13953: adhP | 9.164416 | 5.669006 | −3.74273 | −0.57468 | −4.41419 | 0.007135 |
| 1628 | g6780.t1 | 3455 | g4396.t1 | | 4.325036 | 1.1994 | −3.75976 | −0.57681 | −4.41275 | 0.007142 |
| 1627 | g5153.t1 | 3454 | g3822.t1 | | 1.244336 | 5.595008 | 3.814632 | −0.57638 | 4.413043 | 0.007142 |
| 1629 | g5834.t1 | 3456 | g1171.t1 | K04393: CDC42 | 5.842709 | 0.801203 | −4.48638 | −0.5775 | −4.41229 | 0.007142 |
| 1630 | g5375.t1 | 3457 | g9563.t1 | | 6.246832 | 2.775505 | −3.21809 | −0.59214 | −4.40237 | 0.007231 |
| 1631 | g10368.t1 | 3458 | g5462.t1 | K00826: E2.6.1.42, ilvE | 0.323199 | 4.887494 | 4.532182 | −0.59353 | 4.401421 | 0.007232 |
| 1632 | g2826.t1 | 3459 | g9093.t1 | | 5.715948 | 1.969325 | −4.3438 | −0.60813 | −4.39154 | 0.007312 |
| 1633 | g8263.t1 | 3460 | g10014.t1 | K09540: SEC63 | 1.178199 | 4.647047 | 3.105882 | −0.60945 | 4.390652 | 0.007317 |
| 1634 | g1996.t1 | 3461 | g6244.t1 | | 0 | 2.161944 | 2.537016 | −0.61338 | 4.387995 | 0.007343 |
| 1636 | g565.t1 | 3463 | g3893.t1 | | 7.212095 | 4.016141 | −3.8261 | −0.62616 | −4.37935 | 0.007416 |
| 1635 | g10532.t1 | 3462 | g6657.t1 | | 0 | 6.423209 | 4.950366 | −0.62535 | 4.379902 | 0.007416 |
| 1637 | g9223.t1 | 3464 | g6550.t1 | K14402: CPSF2, CFT2 | 4.757601 | 1.422654 | −3.02304 | −0.63182 | −4.37553 | 0.007456 |
| 1638 | g4375.t1 | 3465 | g2132.t1 | K17777: TIM9 | 6.581887 | 2.288969 | −5.04428 | −0.64088 | −4.36942 | 0.007514 |
| 1639 | g3924.t1 | 3466 | g3968.t1 | K03854: KTR | 4.507947 | 8.80016 | 3.527047 | −0.64187 | 4.368744 | 0.007517 |
| 1640 | g5877.t1 | 3467 | g10964.t1 | | 1.237514 | 5.716716 | 4.577402 | −0.65497 | 4.359912 | 0.007609 |
| 1641 | g7244.t1 | 3468 | g10768.t1 | | 1.270272 | 6.454926 | 4.671181 | −0.66639 | 4.35221 | 0.007694 |
| 1642 | g3215.t1 | 3469 | g6111.t1 | | 6.28213 | 1.918338 | −4.18097 | −0.67385 | −4.34719 | 0.007746 |
| 1643 | g2744.t1 | 3470 | g8873.t1 | | 12.4437 | 4.004642 | −6.34323 | −0.67665 | −4.3453 | 0.007764 |
| 1644 | g10172.t1 | 3471 | g8453.t1 | | 1.719814 | 6.975262 | 4.867858 | −0.67848 | 4.34407 | 0.007769 |
| 1646 | g11998.t1 | 3473 | g2455.t1 | K01792: E5.1.3.15 | 4.113876 | 1.68217 | −2.91764 | −0.68435 | −4.34012 | 0.007808 |
| 1645 | g9935.t1 | 3472 | g6028.t1 | | 0 | 5.001669 | 5.050202 | −0.68376 | 4.340518 | 0.007808 |
| 1647 | g9810.t1 | 3474 | g10828.t1 | | 6.142355 | 2.944412 | −3.12615 | −0.68611 | −4.33894 | 0.007817 |
| 1648 | g2585.t1 | 3475 | g1533.t1 | | 1.186682 | 5.314928 | 4.416457 | −0.70324 | 4.327418 | 0.007953 |
| 1649 | g5812.t1 | 3476 | g7683.t1 | | 0.086084 | 5.755875 | 5.49766 | −0.70639 | 4.3253 | 0.00797 |
| 1650 | g7613.t1 | 3477 | g7623.t1 | K12177: COPS3, CSN3 | 6.832706 | 1.20583 | −6.6405 | −0.71007 | −4.32283 | 0.007995 |
| 1651 | g21752.t1 | 3478 | g11785.t1 | | 9.138517 | 2.10622 | −5.18056 | −0.71052 | −4.32253 | 0.007995 |
| 1652 | g8125.t1 | 3479 | g7937.t1 | K14829: IPI3 | 5.635984 | 8.165687 | 3.420929 | −0.71501 | 4.319512 | 0.008023 |
| 1653 | g1265.t1 | 3480 | g446.t1 | | 0 | 2.255216 | 2.515104 | −0.72389 | 4.313556 | 0.008084 |
| 1654 | g1851.t1 | 3481 | g1893.t1 | K14806: DDX31, DBP7 | 4.180789 | 6.833176 | 3.613285 | −0.72476 | 4.312968 | 0.008086 |
| 1655 | g5970.t1 | 3482 | g7911.t1 | | 0.787727 | 4.745143 | 3.037594 | −0.72641 | 4.311862 | 0.00809 |
| 1656 | g9210.t1 | 3483 | g432.t1 | | 0 | 5.395553 | 4.999741 | −0.72979 | 4.309594 | 0.008103 |
| 1657 | g4885.t1 | 3484 | g5284.t1 | K00451: HGD, hmgA | 2.711021 | 9.250394 | 4.936597 | −0.75813 | 4.290601 | 0.008322 |
| 1658 | g9727.t1 | 3485 | g1208.t1 | | 0 | 2.707059 | 2.656284 | −0.77155 | 4.281622 | 0.008405 |
| 1659 | g1852.t1 | 3486 | g1892.t1 | | 9.129284 | 5.622142 | −2.9499 | −0.77281 | −4.28078 | 0.008408 |
| 1661 | g4708.t1 | 3488 | g2052.t1 | | 5.134526 | 2.604627 | −2.75857 | −0.77636 | −4.27841 | 0.008419 |
| 1662 | g1264.t1 | 3489 | g447.t1 | K07975: K07975 | 0 | 3.433264 | 3.424199 | −0.77691 | 4.27804 | 0.008419 |
| 1660 | g9176.t1 | 3487 | g6513.t1 | | 1.38307 | 7.023037 | 5.604965 | −0.77564 | 4.27889 | 0.008419 |
| 1663 | g10978.t1 | 3490 | g5642.t1 | | 0 | 9.109111 | 6.49256 | −0.77811 | 4.277239 | 0.00842 |
| 1664 | g7775.t1 | 3491 | g849.t1 | | 5.558934 | 1.67851 | −5.74356 | −0.78625 | −4.2718 | 0.008488 |
| 1665 | g10472.t1 | 3492 | g2156.t1 | | 1.835908 | 10.72995 | 8.679924 | −0.80576 | 4.258766 | 0.008642 |
| 1666 | g11361.t1 | 3493 | g11673.t1 | K01613: psd, PISD | 5.614261 | 0.835332 | −3.65067 | −0.81024 | −4.25578 | 0.008666 |
| 1667 | g5499.t1 | 3494 | g4955.t1 | | 4.580901 | 7.497146 | 2.894342 | −0.81895 | 4.249973 | 0.008726 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 1668 | g8184.t1 | 3495 | g5029.t1 | K05607: AUH | 3.031275 | 0 | −3.53658 | −0.84752 | −4.23094 | 0.008935 |
| 1669 | g9878.t1 | 3496 | g11628.t1 | K05755: ARPC4 | 0 | 8.072633 | 7.232249 | −0.84945 | 4.229652 | 0.008948 |
| 1670 | g10675.t1 | 3497 | g8521.t1 | K00688: E2.4.1.1, glgP, PYG | 0.169628 | 5.781937 | 5.478988 | −0.85152 | 4.228278 | 0.008956 |
| 1671 | g9232.t1 | 3498 | g3432.t1 | K00545: COMT | 7.296935 | 0.411124 | −6.22613 | −0.8545 | −4.2263 | 0.00898 |
| 1672 | g9988.t1 | 3499 | g9675.t1 | K00130: betB, gbsA | 0 | 2.553591 | 3.110324 | −0.86233 | 4.221089 | 0.009044 |
| 1673 | g1414.t1 | 3500 | g6284.t1 | | 2.311758 | 6.717528 | 4.69322 | −0.86385 | 4.220079 | 0.009053 |
| 1674 | g6733.t1 | 3501 | g4345.t1 | K09043: AP1F | 0 | 5.001212 | 4.248888 | −0.86816 | 4.217209 | 0.00909 |
| 1675 | g7043.t1 | 3502 | g6332.t1 | | 5.859345 | 10.2543 | 4.890605 | −0.88033 | 4.209124 | 0.009187 |
| 1676 | g2705.t1 | 3503 | g8367.t1 | K00528: E1.18.1.2, fpr | 7.551805 | 3.162022 | −5.08662 | −0.88328 | −4.20717 | 0.009204 |
| 1677 | g10342.t1 | 3504 | g51.t1 | | 0 | 5.678545 | 5.567869 | −0.88506 | 4.205988 | 0.00921 |
| 1678 | g5928.t1 | 3505 | g11021.t1 | K09885: AQPF | 5.755454 | 0.419682 | −5.37723 | −0.89503 | −4.19937 | 0.009274 |
| 1679 | g8175.t1 | 3506 | g7987.t1 | | 1.51165 | 7.320745 | 5.975986 | −0.89646 | 4.198423 | 0.009275 |
| 1680 | g8032.t1 | 3507 | g4282.t1 | | 0 | 4.127275 | 3.299567 | −0.91209 | 4.188055 | 0.009398 |
| 1681 | g9814.t1 | 3508 | g10824.t1 | K03062: PSMC1, RPT2 | 1.362902 | 5.056672 | 3.336585 | −0.91516 | 4.186022 | 0.009415 |
| 1682 | g11969.t1 | 3509 | g7462.t1 | | 0.489568 | 5.568038 | 4.427228 | −0.91543 | 4.185844 | 0.009415 |
| 1683 | g10790.t1 | 3510 | g10663.t1 | | 0.828146 | 4.846815 | 3.562604 | −0.92472 | 4.179692 | 0.009497 |
| 1684 | g4805.t1 | 3511 | g1632.t1 | | 8.950015 | 5.163246 | −3.59682 | −0.93185 | −4.17497 | 0.009558 |
| 1685 | g6554.t1 | 3512 | g10090.t1 | K15565: CTK3 | 5.222663 | 0.144855 | −4.83662 | −0.93476 | −4.17304 | 0.009576 |
| 1686 | g1116.t1 | 3513 | g4063.t1 | | 1.005429 | 5.625694 | 3.855418 | −0.94482 | 4.16639 | 0.009663 |
| 1687 | g8449.t1 | 3514 | g2682.t1 | K05954: FNTB | 0 | 5.399599 | 4.115948 | −0.95049 | 4.162638 | 0.009697 |
| 1689 | g6525.t1 | 3516 | g2064.t1 | K09493: CCT1, TCP1 | 9.538137 | 1.667123 | −6.73424 | −0.95515 | −4.15956 | 0.009725 |
| 1690 | g5857.t1 | 3517 | g1146.t1 | K02320: POLA1 | 3.021693 | 6.891883 | 4.04023 | −0.95542 | 4.159376 | 0.009725 |
| 1688 | g1274.t1 | 3515 | g460.t1 | | 0 | 6.05494 | 9.515249 | −0.95514 | 4.159568 | 0.009725 |
| 1691 | g12431.t1 | 3518 | g10686.t1 | K07127: uraH, pucM, hiuH | 0 | 5.825339 | 4.833292 | −0.95677 | 4.158489 | 0.009733 |
| 1692 | g5322.t1 | 3519 | g2238.t1 | K03426: E3.6.1.22, NUDT12, nudC | 5.48509 | 2.765673 | −3.98262 | −0.95893 | −4.15706 | 0.009743 |
| 1693 | g10361.t1 | 3520 | g7713.t1 | | 2.118062 | 5.477606 | 3.633039 | −0.96411 | 4.153638 | 0.009765 |
| 1694 | g2712.t1 | 3521 | g8360.t1 | | 6.902933 | 0.496994 | −4.89563 | −0.97385 | −4.1472 | 0.009833 |
| 1695 | g6927.t1 | 3522 | g6460.t1 | K00485: FMO | 9.696666 | 1.489752 | −6.7401 | −0.98605 | −4.13915 | 0.009945 |
| 1696 | g6520.t1 | 3523 | g2069.t1 | | 7.419005 | 0.788997 | −5.06498 | −0.98929 | −4.13702 | 0.009974 |
| 1697 | g15004.t1 | 3524 | g3115.t1 | | 4.410253 | 0.439607 | −3.37848 | −0.99169 | −4.13543 | 0.009991 |
| 1698 | g13717.t1 | 3525 | g9904.t1 | K01426: E3.5.1.4, amiE | 2.122753 | 4.721599 | 2.459777 | −0.99262 | 4.134823 | 0.009991 |
| 1699 | g11731.t1 | 3526 | g5851.t1 | K00804: GGPS1 | 0.641201 | 8.014106 | 6.275604 | −0.99873 | 4.130792 | 0.010032 |
| 1700 | g12319.t1 | 3527 | g7427.t1 | K06127: COQ5 | 0 | 3.18054 | 4.279183 | −1.0114 | 4.122445 | 0.010158 |
| 1037 | g11120.t1 | 2520 | g739.t1 | K11309: RTT109, KAT11 | 4.245031 | 0.362852 | −4.44703 | −1.02232 | −4.11525 | 0.010262 |
| 1701 | g10208.t1 | 3528 | g11172.t1 | K08737: MSH6 | 5.231935 | 0.620193 | −4.43745 | −1.02255 | −4.11511 | 0.010262 |
| 1702 | g4510.t1 | 3529 | g10815.t1 | | 0.110413 | 4.81464 | 3.815621 | −1.03144 | 4.109255 | 0.010342 |
| 1703 | g10697.t1 | 3530 | g8542.t1 | K01702: LEU1 | 0.263634 | 7.912518 | 6.023521 | −1.04447 | 4.100686 | 0.010463 |
| 1704 | g15805.t1 | 3531 | g2331.t1 | K02154: ATPeV0A, ATP6N | 0 | 2.888609 | 4.034147 | −1.04529 | 4.100149 | 0.010465 |
| 1705 | g5031.t1 | 3532 | g9002.t1 | K02830: HRAD1, RAD17 | 3.089916 | 5.598348 | 2.991585 | −1.04815 | 4.098268 | 0.010485 |
| 1706 | g5436.t1 | 3533 | g3139.t1 | K16261: YAT | 5.060429 | 1.262422 | −4.0977 | −1.04901 | −4.0977 | 0.010485 |
| 1707 | g4238.t1 | 3534 | g1742.t1 | | 1.066099 | 4.155929 | 2.917914 | −1.053 | 4.09508 | 0.010521 |
| 1708 | g10868.t1 | 3535 | g125.t1 | | 0 | 3.653087 | 3.440687 | −1.05442 | 4.094146 | 0.01053 |
| 1709 | g6783.t1 | 3536 | g4399.t1 | | 6.220556 | 1.013936 | −4.77542 | −1.0556 | −4.09337 | 0.010537 |
| 1710 | g3062.t1 | 3537 | g11769.t1 | | 0 | 2.560725 | 2.204735 | −1.06092 | 4.089879 | 0.010585 |
| 1711 | g10221.t1 | 3538 | g11208.t1 | | 6.889613 | 0.40438 | −7.11534 | −1.06965 | −4.08415 | 0.010672 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 1712 | g1829.t1 | 3539 | g1715.t1 | | 5.791735 | 1.495617 | −4.17043 | −1.08999 | −4.07081 | 0.010861 |
| 1713 | g8326.t1 | 3540 | g5128.t1 | K00505: TYR | 3.610494 | 6.260581 | 3.534926 | −1.09636 | 4.066632 | 0.010911 |
| 1714 | g3155.t1 | 3541 | g4991.t1 | | 3.59858 | 7.647083 | 3.797219 | −1.11173 | 4.056562 | 0.011074 |
| 1715 | g2222.t1 | 3542 | g11603.t1 | | 0.225549 | 4.813511 | 4.351037 | −1.12206 | 4.049805 | 0.011164 |
| 1716 | g11759.t1 | 3543 | g10216.t1 | | 3.685926 | 0 | −4.53515 | −1.12292 | −4.04924 | 0.011168 |
| 1717 | g8206.t1 | 3544 | g8502.t1 | | 3.420719 | 10.03021 | 6.493771 | −1.1248 | 4.048012 | 0.011183 |
| 679 | g4287.t1 | 2759 | g1939.t1 | K00275: pdxH, PNPO | 0.807563 | 3.090838 | 2.176492 | −1.13595 | 4.040719 | 0.011299 |
| 690 | g7926.t1 | 2497 | g8597.t1 | | 6.166677 | 8.61834 | 2.778981 | −1.13847 | 4.039073 | 0.011322 |
| 1718 | g4064.t1 | 3545 | g3254.t1 | K00002: AKR1A1, adh | 6.100438 | 1.079083 | −4.91125 | −1.15384 | −4.02903 | 0.01147 |
| 1720 | g5795.t1 | 3547 | g4862.t1 | K00451: HGD, hmgA | 3.591089 | 6.8767 | 2.956306 | −1.15712 | 4.026889 | 0.011485 |
| 1719 | g5609.t1 | 3546 | g7533.t1 | | 0.882686 | 5.320606 | 3.796705 | −1.15678 | 4.027112 | 0.011485 |
| 1721 | g19766.t1 | 3548 | g11689.t1 | K08272: CAB39, MO25 | 4.724331 | 1.509326 | −3.78959 | −1.16405 | −4.02236 | 0.011549 |
| 1722 | g7985.t1 | 3549 | g10231.t1 | | 0 | 4.06043 | 3.846952 | −1.16466 | 4.021964 | 0.01155 |
| 1723 | g4377.t1 | 3550 | g2134.t1 | | 14.14762 | 6.168036 | −7.54239 | −1.1682 | −4.01966 | 0.01158 |
| 1724 | g10842.t1 | 3551 | g9831.t1 | K15283: SLC35E1 | 3.417746 | 7.907833 | 4.552081 | −1.17777 | 4.013415 | 0.011665 |
| 1725 | g3810.t1 | 3552 | g5153.t1 | K01539: ATP1A | 5.831954 | 9.975934 | 4.809042 | −1.1815 | 4.010981 | 0.011698 |
| 1726 | g4351.t1 | 3553 | g2123.t1 | | 2.978188 | 5.643247 | 2.777696 | −1.19302 | 4.003473 | 0.011817 |
| 1727 | g12887.t1 | 3554 | g7811.t1 | K03868: RBX1, ROC1 | 0 | 6.027624 | 4.370298 | −1.19414 | 4.002739 | 0.011824 |
| 1728 | g13707.t1 | 3555 | g7796.t1 | K04706: PIAS1 | 6.517298 | 4.766243 | −2.04941 | −1.20773 | −3.99389 | 0.011956 |
| 1729 | g16831.t1 | 3556 | g10344.t1 | | 6.338633 | 1.444662 | −4.08292 | −1.20964 | −3.99265 | 0.011974 |
| 1731 | g3916.t1 | 3558 | g3976.t1 | | 4.817018 | 0.75673 | −4.65895 | −1.22292 | −3.98401 | 0.012097 |
| 1730 | g5660.t1 | 3557 | g1082.t1 | | 0 | 4.671882 | 3.638252 | −1.22213 | 3.984518 | 0.012097 |
| 1732 | g9151.t1 | 3559 | g6484.t1 | | 6.278283 | 0.8931 | −5.76977 | −1.23184 | −3.9782 | 0.012199 |
| 1733 | g12202.t1 | 3560 | g9295.t1 | | 0.672484 | 4.169208 | 2.907439 | −1.23665 | 3.975077 | 0.012241 |
| 1734 | g5282.t1 | 3561 | g2288.t1 | | 4.202468 | 0.654126 | −3.30483 | −1.23744 | −3.97457 | 0.012244 |
| 1735 | g7572.t1 | 3562 | g7669.t1 | | 3.978653 | 7.606234 | 3.70123 | −1.2385 | 3.973875 | 0.012244 |
| 1736 | g3235.t1 | 3563 | g8210.t1 | | 4.470468 | 8.184527 | 5.15127 | −1.24494 | 3.969692 | 0.012307 |
| 697 | g852.t1 | 2502 | g9454.t1 | K11824: AP2A | 4.880882 | 7.286171 | 2.290375 | −1.24576 | 3.969158 | 0.012307 |
| 1737 | g6716.t1 | 3564 | g4321.t1 | | 9.948221 | 2.821953 | −6.95531 | −1.25354 | −3.9641 | 0.012386 |
| 1738 | g2067.t1 | 3565 | g2530.t1 | | 7.69826 | 4.922109 | −3.56419 | −1.26788 | −3.95479 | 0.012535 |
| 1739 | g7743.t1 | 3566 | g7093.t1 | | 2.175372 | 4.617996 | 2.642137 | −1.27196 | 3.95215 | 0.0125706 |
| 1740 | g5491.t1 | 3567 | g9819.t1 | | 9.301085 | 2.365816 | −5.52656 | −1.27566 | −3.94974 | 0.012619 |
| 1741 | g10936.t1 | 3568 | g2319.t1 | | 8.259645 | 1.32013 | −5.22157 | −1.27719 | −3.94876 | 0.012632 |
| 939 | g4598.t1 | 2528 | g6014.t1 | | 4.80428 | 1.524453 | −3.6354 | −1.2848 | −3.94382 | 0.012715 |
| 1742 | g10549.t1 | 3569 | g6695.t1 | | 0 | 1.785939 | 2.000492 | −1.29585 | 3.936658 | 0.012829 |
| 527 | g4985.t1 | 2324 | g8953.t1 | | 0.777528 | 7.11879 | 6.4966 | −1.30752 | 3.929102 | 0.012948 |
| 578 | g8174.t1 | 2376 | g7986.t1 | | 1.469754 | 6.185503 | 4.308101 | −1.31185 | 3.926293 | 0.012985 |
| 1743 | g2143.t1 | 3570 | g11929.t1 | K00772: E2.4.2.28, mtaP | 4.8374 | 0.969878 | −3.56778 | −1.3345 | −3.91164 | 0.013284 |
| 1744 | g9848.t1 | 3571 | g9777.t1 | K06970: rlmF | 9.547112 | 5.371618 | −3.97134 | −1.34065 | −3.90767 | 0.013349 |
| 1745 | g12220.t1 | 3572 | g11110.t1 | K07870: RHOT1, ARHT1 | 3.884302 | 6.478847 | 3.518086 | −1.34423 | 3.905351 | 0.013393 |
| 1746 | g2291.t1 | 3573 | g10709.t1 | | 5.385805 | 9.526471 | 4.775916 | −1.34937 | 3.902029 | 0.013444 |
| 1747 | g2147.t1 | 3574 | g11880.t1 | K14789: NOP6 | 6.507448 | 1.977499 | −4.68012 | −1.35307 | −3.89964 | 0.013467 |
| 1748 | g6355.t1 | 3575 | g794.t1 | K00236: SDHC, SDH3 | 0.536878 | 6.254053 | 4.787495 | −1.36034 | 3.894946 | 0.013558 |
| 1749 | g2869.t1 | 3576 | g11261.t1 | | 0.327373 | 6.340001 | 4.80532 | −1.36591 | 3.891347 | 0.013632 |
| 1750 | g2360.t1 | 3577 | g9254.t1 | K12200: PDCD6IP, ALIX, RIM20 | 3.801939 | 1.686361 | −2.17748 | −1.36819 | −3.88988 | 0.013658 |
| 1751 | g3560.t1 | 3578 | g3325.t1 | | 6.818439 | 0.789095 | −4.92675 | −1.37135 | −3.88784 | 0.013689 |
| 1752 | g10589.t1 | 3579 | g7032.t1 | | 0 | 2.526539 | 3.338928 | −1.37427 | 3.885952 | 0.013716 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 1753 | g16530.t1 | 3580 | g8785.t1 | | 4.610888 | 0.254363 | −4.08665 | −1.38154 | −3.88126 | 0.013816 |
| 1754 | g5177.t1 | 3581 | g3786.t1 | K03321: TC.SULP | 4.026352 | 0.667334 | −3.40117 | −1.38727 | −3.87757 | 0.013878 |
| 1755 | g9386.t1 | 3582 | g3647.t1 | K01082: E3.1.3.7, cysQ, MET22, BPNT1 | 7.430096 | 4.382531 | −3.00795 | −1.38737 | −3.8775 | 0.013878 |
| 1756 | g6130.t1 | 3583 | g7316.t1 | K08657: TASP1 | 0.095949 | 5.575509 | 5.53383 | −1.38749 | 3.87743 | 0.013878 |
| 1757 | g8530.t1 | 3584 | g6289.t1 | K05532: MNN11 | 0 | 5.816826 | 4.892278 | −1.38966 | 3.876025 | 0.013899 |
| 1758 | g21699.t1 | 3585 | g5541.t1 | K03448: FEN2, LIZ1 | 0.735044 | 3.625342 | 2.870907 | −1.39176 | 3.874673 | 0.013906 |
| 1759 | g9934.t1 | 3586 | g6029.t1 | K16575: ACTR1, ARP1 | 0 | 5.832405 | 5.597162 | −1.39893 | 3.870056 | 0.013978 |
| 1760 | g4777.t1 | 3587 | g3680.t1 | | 3.32587 | 5.729749 | 2.411959 | −1.4021 | 3.868009 | 0.014015 |
| 1761 | g11542.t1 | 3588 | g4184.t1 | | 7.517977 | 2.707186 | −4.47011 | −1.41398 | −3.86036 | 0.014171 |
| 1762 | g2157.t1 | 3589 | g11896.t1 | | 3.702226 | 7.226007 | 3.353898 | −1.41467 | 3.859914 | 0.014174 |
| 1763 | g16189.t1 | 3590 | g1458.t1 | K14454: GOT1 | 10.63207 | 6.499538 | −6.07526 | −1.41542 | −3.85943 | 0.014178 |
| 1764 | g8348.t1 | 3591 | g5159.t1 | | 4.264457 | 6.507615 | 2.242904 | −1.41809 | 3.857714 | 0.014202 |
| 1765 | g1259.t1 | 3592 | g452.t1 | | 2.440869 | 6.057593 | 3.423879 | −1.42343 | 3.854274 | 0.01426 |
| 1766 | g2764.t1 | 3593 | g9147.t1 | K10745: RNASEH2C | 0 | 2.695204 | 3.586065 | −1.42688 | 3.852056 | 0.014297 |
| 1767 | g7927.t1 | 3594 | g8596.t1 | | 4.918651 | 7.912131 | 3.059833 | −1.4292 | 3.850562 | 0.014312 |
| 1768 | g2676.t1 | 3595 | g4133.t1 | K00294: E1.2.1.88 | 0.612742 | 5.41036 | 4.447987 | −1.4294 | 3.850434 | 0.014312 |
| 1769 | g7548.t1 | 3596 | g7259.t1 | | 0.649867 | 5.412471 | 4.266032 | −1.43441 | 3.847211 | 0.014366 |
| 1771 | g5182.t1 | 3598 | g3781.t1 | | 9.026587 | 2.801517 | −6.79697 | −1.43708 | −3.84549 | 0.014391 |
| 1770 | g7942.t1 | 3597 | g9703.t1 | | 2.085423 | 7.573442 | 5.338061 | −1.43698 | 3.845559 | 0.014391 |
| 1772 | g4091.t1 | 3599 | g3293.t1 | K01687: ilvD | 6.303323 | 0.815929 | −5.63696 | −1.43932 | −3.84405 | 0.014418 |
| 1773 | g12310.t1 | 3600 | g7399.t1 | | 0 | 7.275303 | 5.468252 | −1.44443 | 3.840765 | 0.014489 |
| 1774 | g3831.t1 | 3601 | g2596.t1 | K07005: K07005 | 0 | 4.871672 | 3.653881 | −1.4486 | 3.838085 | 0.014546 |
| 1776 | g3521.t1 | 3603 | g2212.t1 | K10666: RNF5 | 4.087847 | 5.915388 | 2.294451 | −1.45392 | 3.834664 | 0.014606 |
| 1775 | g22438.t1 | 3602 | g4987.t1 | | 5.797361 | 8.454162 | 3.989287 | −1.45372 | 3.834797 | 0.014606 |
| 1777 | g4129.t1 | 3604 | g1851.t1 | | 3.118092 | 5.15901 | 2.22408 | −1.45469 | 3.834169 | 0.01461 |
| 1778 | g12080.t1 | 3605 | g7812.t1 | | 5.157342 | 0.417205 | −5.18316 | −1.4566 | −3.83294 | 0.014632 |
| 1779 | g18095.t1 | 3606 | g931.t1 | | 5.760364 | 1.160199 | −6.11966 | −1.45925 | −3.83124 | 0.014666 |
| 1780 | g2261.t1 | 3607 | g10673.t1 | | 4.246251 | 8.170102 | 5.158696 | −1.46304 | 3.828806 | 0.014718 |
| 1781 | g2951.t1 | 3608 | g5953.t1 | K11129: NHP2, NOLA2 | 4.43109 | 0.997175 | −3.38379 | −1.46821 | −3.82548 | 0.014759 |
| 1782 | g2355.t1 | 3609 | g9249.t1 | K07192: FLOT | 6.819585 | 1.646734 | −5.57734 | −1.47687 | −3.81992 | 0.014873 |
| 1783 | g3075.t1 | 3610 | g11781.t1 | | 0 | 4.238844 | 3.140408 | −1.48663 | 3.813664 | 0.014988 |
| 1784 | g9642.t1 | 3611 | g6905.t1 | | 0 | 4.384934 | 5.279139 | −1.48909 | 3.812083 | 0.015012 |
| 1786 | g7748.t1 | 3613 | g7098.t1 | K12815: DHX38, PRP16 | 1.598146 | 5.454032 | 3.568819 | −1.49259 | 3.809836 | 0.015052 |
| 1785 | g10300.t1 | 3612 | g22.t1 | | 0 | 4.950892 | 4.957814 | −1.49227 | 3.810047 | 0.015052 |
| 1787 | g1381.t1 | 3614 | g8684.t1 | | 6.537476 | 0 | −5.14045 | −1.49524 | −3.80814 | 0.01508 |
| 1788 | g3923.t1 | 3615 | g3970.t1 | | 5.651846 | 0.874231 | −4.49336 | −1.49537 | −3.80806 | 0.01508 |
| 1789 | g2286.t1 | 3616 | g10703.t1 | K11362: HFI1, ADA1 | 1.780691 | 5.389549 | 3.610777 | −1.50303 | 3.803144 | 0.015181 |
| 692 | g5169.t1 | 2506 | g3798.t1 | | 4.28203 | 6.198144 | 2.254081 | −1.50534 | 3.801665 | 0.01521 |
| 1790 | g5917.t1 | 3617 | g11006.t1 | | 0.479676 | 3.343978 | 2.923854 | −1.5088 | 3.799443 | 0.01525 |
| 1791 | g6287.t1 | 3618 | g8349.t1 | K11366: USP22_27_51, UBP8 | 7.027226 | 0 | −6.44608 | −1.51412 | −3.79604 | 0.01533 |
| 1792 | g6643.t1 | 3619 | g10197.t1 | | 5.091815 | 1.733439 | −3.47331 | −1.51828 | −3.79337 | 0.01539 |
| 1793 | g12218.t1 | 3620 | g11102.t1 | | 2.315098 | 5.094179 | 2.505163 | −1.52401 | 3.789702 | 0.015468 |
| 1794 | g7936.t1 | 3621 | g11228.t1 | K00232: E1.3.3.6, ACOX1, ACOX3 | 4.459893 | 9.555022 | 5.227644 | −1.52659 | 3.788048 | 0.015503 |
| 1795 | g5748.t1 | 3622 | g5250.t1 | | 1.632799 | 4.080474 | 2.918063 | −1.52796 | 3.787172 | 0.015518 |
| 1796 | g9069.t1 | 3623 | g8579.t1 | | 0 | 6.161139 | 6.446955 | −1.53152 | 3.784889 | 0.01556 |
| 1797 | g6312.t1 | 3624 | g3007.t1 | K05236: COPA | 5.253098 | 7.43545 | 2.144029 | −1.54263 | 3.77778 | 0.0157 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 1799 | g8177.t1 | 3626 | g7989.t1 | | 9.520565 | 3.609284 | −4.61836 | −1.54631 | −3.77543 | 0.015742 |
| 1798 | g14196.t1 | 3625 | g5807.t1 | K01754: E4.3.1.19, ilvA, tdcB | 5.027436 | 7.101036 | 2.225321 | −1.54586 | 3.775716 | 0.015742 |
| 1800 | g6471.t1 | 3627 | g5309.t1 | K11237: BEM1 | 8.657428 | 1.580264 | −5.3132 | −1.54781 | −3.77447 | 0.015759 |
| 1801 | g8179.t1 | 3628 | g7991.t1 | K15450: TYW3 | 1.394748 | 4.160609 | 2.833287 | −1.55061 | 3.772678 | 0.015798 |
| 1802 | g6447.t1 | 3629 | g5339.t1 | | 0.745984 | 4.49131 | 3.550615 | −1.55175 | 3.771949 | 0.015808 |
| 1803 | g4305.t1 | 3630 | g1960.t1 | K07179: RIOK2 | 2.332881 | 9.808031 | 7.49955 | −1.56836 | 3.761323 | 0.016051 |
| 1804 | g10921.t1 | 3631 | g2051.t1 | | 3.554471 | 15.34968 | 12.40633 | −1.5698 | 3.760406 | 0.016067 |
| 1805 | g7453.t1 | 3632 | g6882.t1 | K11230: SSK2 | 6.592207 | 0.47792 | −6.24926 | −1.57242 | −3.75873 | 0.016095 |
| 1806 | g4994.t1 | 3633 | g8965.t1 | | 4.95489 | 0.379021 | −5.0321 | −1.57389 | −3.75779 | 0.016103 |
| 1807 | g13512.t1 | 3634 | g8777.t1 | K07047: K07047 | 0 | 1.953187 | 2.809714 | −1.57688 | 3.75588 | 0.016146 |
| 1808 | g13145.t1 | 3635 | g4288.t1 | K12795: SUGT1, SGT1 | 0 | 3.863111 | 4.262765 | −1.57792 | 3.755218 | 0.016156 |
| 1809 | g2403.t1 | 3636 | g9304.t1 | | 3.466706 | 5.880267 | 2.766617 | −1.58819 | 3.748658 | 0.0163 |
| 1810 | g11546.t1 | 3637 | g4179.t1 | | 2.95634 | 4.859952 | 2.334894 | −1.59077 | 3.747012 | 0.016337 |
| 1811 | g6245.t1 | 2545 | g7144.t1 | | 3.519044 | 0.986255 | −2.56971 | −1.59307 | −3.74554 | 0.016351 |
| 1812 | g20527.t1 | 3638 | g9499.t1 | | 0 | 2.423781 | 3.298103 | −1.5938 | 3.745074 | 0.016355 |
| 1814 | g485.t1 | 3640 | g5481.t1 | | 3.211934 | 0.513195 | −3.05545 | −1.59982 | −3.74123 | 0.016427 |
| 1813 | g9589.t1 | 3639 | g6640.t1 | K14564: NOP56 | 0 | 4.752235 | 3.463157 | −1.59979 | 3.741252 | 0.016427 |
| 1815 | g17338.t1 | 3641 | g4825.t1 | | 3.253347 | 11.98725 | 6.42899 | −1.60143 | 3.74021 | 0.016446 |
| 1816 | g5556.t1 | 3642 | g7468.t1 | | 0.321853 | 8.712554 | 6.936626 | −1.60594 | 3.737329 | 0.0165 |
| 683 | g9852.t1 | 3089 | g9791.t1 | | 0.93993 | 4.257415 | 3.235897 | −1.61117 | 3.733993 | 0.016567 |
| 1817 | g9592.t1 | 3643 | g6324.t1 | | 0 | 3.24119 | 4.466041 | −1.61236 | 3.733234 | 0.01657 |
| 1818 | g9909.t1 | 3644 | g3464.t1 | | 4.899061 | 0.389899 | −4.4519 | −1.61774 | −3.7298 | 0.016649 |
| 1819 | g347.t1 | 3645 | g8852.t1 | K01619: deoC, DERA | 5.001834 | 2.638493 | −2.09583 | −1.61831 | −3.72944 | 0.01665 |
| 1820 | g3024.t1 | 3646 | g8280.t1 | K15183: ELL | 4.940617 | 6.802739 | 2.356057 | −1.62092 | 3.727777 | 0.016675 |
| 1821 | g3400.t1 | 3647 | g10340.t1 | | 4.574834 | 8.898182 | 4.895081 | −1.62268 | 3.726654 | 0.016684 |
| 1822 | g5059.t1 | 3648 | g8329.t1 | K15544: SSU72 | 3.885616 | 1.04666 | −3.67463 | −1.62812 | −3.72318 | 0.016767 |
| 1823 | g13701.t1 | 3649 | g7800.t1 | K00227: SC5DL, ERG3 | 3.52458 | 8.32101 | 6.721913 | −1.62826 | 3.723097 | 0.016767 |
| 1824 | g7883.t1 | 3650 | g8666.t1 | K17871: ndh1 | 8.978821 | 4.745077 | −4.2343 | −1.62992 | −3.72204 | 0.016789 |
| 1825 | g9357.t1 | 3651 | g4026.t1 | | 1.461054 | 4.608619 | 3.269834 | −1.64365 | 3.713291 | 0.017021 |
| 1826 | g6504.t1 | 3652 | g10649.t1 | K01487: E3.5.4.3, guaD | 3.115047 | 5.480797 | 3.226369 | −1.64905 | 3.709853 | 0.017102 |
| 1827 | g996.t1 | 3653 | g8065.t1 | K03859: PIGC, GPI2 | 0 | 5.164011 | 5.152798 | −1.65445 | 3.70641 | 0.017175 |
| 1828 | g12072.t1 | 3654 | g7819.t1 | | 7.465114 | 4.358481 | −4.43566 | −1.66028 | −3.7027 | 0.017256 |
| 1829 | g8430.t1 | 3655 | g6112.t1 | | 0 | 3.595832 | 4.134153 | −1.664 | 3.700333 | 0.017293 |
| 1830 | g1011.t1 | 3656 | g8080.t1 | | 1.836426 | 5.321783 | 3.474028 | −1.66832 | 3.697583 | 0.01736 |
| 1831 | g7418.t1 | 2549 | g7203.t1 | K17497: PMM | 4.250746 | 0.725203 | −3.91923 | −1.6743 | −3.69378 | 0.017427 |
| 1832 | g9496.t1 | 3657 | g5757.t1 | | 0.783088 | 6.487481 | 4.380159 | −1.67836 | 3.691201 | 0.017484 |
| 1833 | g9186.t1 | 3658 | g6518.t1 | | 4.151632 | 10.48721 | 6.043581 | −1.68184 | 3.688985 | 0.017532 |
| 1834 | g7004.t1 | 3659 | g6378.t1 | K11229: BCK1 | 0 | 2.324218 | 2.253785 | −1.68839 | 3.684823 | 0.017638 |
| 1836 | g8143.t1 | 3661 | g7948.t1 | | 4.054206 | 0.695466 | −3.66885 | −1.6899 | −3.68386 | 0.017639 |
| 1835 | g11752.t1 | 3660 | g9854.t1 | K11086: SNRPB, SMB | 5.274986 | 2.280814 | −3.12018 | −1.6896 | −3.68405 | 0.017639 |
| 1837 | g17537.t1 | 3662 | g9665.t1 | | 4.57235 | 8.898002 | 4.283534 | −1.69297 | 3.681912 | 0.017688 |
| 1838 | g5667.t1 | 3663 | g1075.t1 | | 4.489128 | 2.536094 | −2.39358 | −1.70341 | −3.67528 | 0.017868 |
| 1839 | g6664.t1 | 3664 | g2224.t1 | K13525: VCP, CDC48 | 2.105221 | 5.652047 | 4.78303 | −1.70384 | 3.675005 | 0.017868 |
| 1840 | g2801.t1 | 3665 | g9129.t1 | | 7.466543 | 0.556432 | −6.6491 | −1.70804 | −3.67233 | 0.017928 |
| 1841 | g4812.t1 | 3666 | g9598.t1 | | 4.049291 | 6.42879 | 2.167629 | −1.70915 | 3.671628 | 0.017928 |
| 1843 | g2466.t1 | 3668 | g6718.t1 | | 5.98403 | 0 | −5.16123 | −1.7182 | −3.66588 | 0.018067 |
| 1842 | g249.t1 | 3667 | g11056.t1 | K00276: AOC3, AOC2, tynA | 5.423135 | 1.39377 | −3.95337 | −1.71813 | −3.66593 | 0.018067 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 1844 | g13312.t1 | 3669 | g4520.t1 | K018GO: maiA, GSTZ1 | 0 | 2:734484 | 3.220496 | −1.71843 | 3.665736 | 0.018067 |
| 1845 | g9893.t1 | 3670 | g3483.t1 | | 0 | 6.706192 | 4.9767S9 | −1.71907 | 3.665331 | 0.01807 |
| 1846 | g17202.t1 | 3671 | g3078.t1 | | 5.68592 | 2.231786 | −3.83595 | −1.72034 | −3.66452 | 0.018076 |
| 1847 | g5069.t1 | 3672 | g8336.t1 | K14521: NAT10, KRE33 | 0 | 3.583017 | 3.343135 | −1.72847 | 3.659364 | 0.018188 |
| 1848 | g7275.t1 | 3673 | g11843.t1 | | 0.251195 | 5.321335 | 4.264195 | −1.7299 | 3.658459 | 0.018207 |
| 1849 | g4877.t1 | 3674 | g4496.t1 | | 0.134441 | 10.17863 | 6.723251 | −1.73151 | 3.657431 | 0.018229 |
| 1850 | g12737.t1 | 3675 | g5715.t1 | | 0 | 3.366893 | 5.496972 | −1.7331 | 3.656428 | 0.018251 |
| 1851 | g3173.t1 | 3676 | g11661.t1 | | 3.672536 | 1.077381 | −2.65537 | −1.73393 | −3.6559 | 0.018258 |
| 1852 | g4631.t1 | 3677 | g2422.t1 | | 2.311883 | 4.745023 | 2.541357 | −1.73959 | 3.652307 | 0.018351 |
| 1853 | g601.t1 | 3678 | g3857.t1 | | 0 | 4.551928 | 4.659305 | −1.74334 | 3.649928 | 0.018406 |
| 1854 | g4634.t1 | 3679 | g2419.t1 | | 5.63215 | 7.748538 | 2.895179 | −1.74706 | 3.647572 | 0.018445 |
| 1855 | g13170.t1 | 3680 | g1290.t1 | K01620: ItaE | 0 | 1.960601 | 3.162229 | −1.74722 | 3.647467 | 0.018445 |
| 1856 | g3136.t1 | 3681 | g5050.t1 | | 0 | 2.474936 | 2.012582 | −1.75162 | 3.644677 | 0.018519 |
| 1857 | g14953.t1 | 3682 | g1391.t1 | | 3.334724 | 6.021478 | 2.572465 | −1.75216 | 3.644334 | 0.018519 |
| 1858 | g11237.t1 | 3683 | g1362.t1 | | 2.76252 | 5.104646 | 2.123089 | −1.76267 | 3.637676 | 0.018659 |
| 1859 | g1833.t1 | 3684 | g1913.t1 | K03248: EIF3G | 0 | 3.706133 | 3.037564 | −1.76489 | 3.636266 | 0.018694 |
| 1860 | g6040.t1 | 3685 | g11728.t1 | K16368: DGK1 | 9.681271 | 2.587529 | −5.33304 | −1.7661 | −3.6355 | 0.018707 |
| 1861 | g11936.t1 | 3686 | g10365.t1 | | 4.454058 | 0.327662 | −3.42743 | −1.76646 | −3.63527 | 0.018707 |
| 1862 | g4010.t1 | 3687 | g8176.t1 | K15427: SIT4, PPH1 | 5.918167 | 1.131513 | −3.97297 | −1.77022 | −3.63289 | 0.018745 |
| 1864 | g3458.t1 | 3689 | g4687.t1 | | 2.234014 | 5.975139 | 2.819321 | −1.77233 | 3.631552 | 0.018756 |
| 1865 | g4936.t1 | 3690 | g4576.t1 | | 0.924146 | 3.716899 | 3.064721 | −1.77306 | 3.631089 | 0.018756 |
| 1866 | g1815.t1 | 3691 | g1702.t1 | | 2.685797 | 6.479459 | 3.431879 | −1.77314 | 3.63104 | 0.018756 |
| 1863 | g7697.t1 | 3688 | g11510.t1 | | 1.950115 | 6.128154 | 4.639048 | −1.77179 | 3.631893 | 0.018756 |
| 1867 | g1592.t1 | 3692 | g12245.t1 | | 0 | 4.518156 | 4.414945 | −1.7816 | 3.62568 | 0.01888 |
| 1868 | g9431.t1 | 3693 | g10302.t1 | | 5.228093 | 0.705484 | −5.82699 | −1.78382 | −3.62428 | 0.018915 |
| 1869 | g10761.t1 | 3694 | g12006.t1 | K15082: RAD7 | 3.567408 | 6.390408 | 2.846424 | −1.7985 | 3.614981 | 0.01914 |
| 1870 | g6898.t1 | 3695 | g1355.t1 | | 2.604143 | 5.101685 | 2.991821 | −1.80118 | 3.613286 | 0.019185 |
| 1871 | g13109.t1 | 3696 | g9757.t1 | K01620: ItaE | 0 | 2.071355 | 2.163561 | −1.80694 | 3.609643 | 0.019256 |
| 1872 | g1060.t1 | 3697 | g8133.t1 | | 4.616756 | 0.514584 | −3.57327 | −1.81051 | −3.60738 | 0.019301 |
| 1873 | g7618.t1 | 3698 | g7618.t1 | | 2.193329 | 5.285081 | 3.154401 | −1.81683 | 3.603386 | 0.019394 |
| 1874 | g1395.t1 | 3699 | g6218.t1 | | 3.913913 | 7.425386 | 3.628307 | −1.82293 | 3.599533 | 0.019503 |
| 1875 | g1934.t1 | 3700 | g10921.t1 | | 6.270225 | 2.041068 | −5.92102 | −1.82531 | −3.59803 | 0.01953 |
| 1876 | g10864.t1 | 3701 | g114.t1 | | 1.463031 | 4.938665 | 3.973683 | −1.82564 | 3.59782 | 0.01953 |
| 1877 | g10895.t1 | 3702 | g5900.t1 | | 0 | 4.186104 | 3.125415 | −1.8289 | 3.595755 | 0.019562 |
| 1878 | g5532.t1 | 3703 | g11340.t1 | | 1.931855 | 7.130479 | 5.020293 | −1.83514 | 3.591812 | 0.019672 |
| 1879 | g7251.t1 | 3704 | g10776.t1 | | 4.989318 | 0.254069 | −3.57371 | −1.85053 | −3.58209 | 0.019932 |
| 1880 | g3894.t1 | 3705 | g3998.t1 | K00846: KHK | 2.877684 | 5.230358 | 3.413778 | −1.86007 | 3.576066 | 0.020088 |
| 1881 | g819.t1 | 3706 | g8183.t1 | | 3.722054 | 7.412978 | 4.05158 | −1.86516 | 3.572854 | 0.020168 |
| 1882 | g5100.t1 | 3707 | g2942.t1 | K06688: UBE2C, UBC11 | 0 | 1.914572 | 2.214387 | −1.86814 | 3.570972 | 0.020216 |
| 1883 | g5175.t1 | 3708 | g3792.t1 | K11498: CENPE | 3.281173 | 0.222331 | −4.74201 | −1.88553 | −3.56 | 0.020535 |
| 1884 | g6483.t1 | 3709 | g5291.t1 | K13728: MAD2L2 | 1.918177 | 10.9648 | 7.40681 | −1.89484 | 3.554125 | 0.020681 |
| 1885 | g8029.t1 | 3710 | g4279.t1 | K01464: DPYS, dht, hydA | 3.138026 | 5.812027 | 3.152124 | −1.89915 | 3.551408 | 0.020756 |
| 1888 | g1840.t1 | 3713 | g1902.t1 | | 4.350369 | 6.555403 | 3.614501 | −1.90291 | 3.549042 | 0.020781 |
| 1886 | g5081.t1 | 3711 | g8569.t1 | K00505: TYR | 0 | 4.71171 | 4.573953 | −1.9019 | 3.549673 | 0.020781 |
| 1887 | g1692.t1 | 3712 | g4651.t1 | | 1.082713 | 6.142533 | 4.604924 | −1.90263 | 3.549214 | 0.020781 |
| 1889 | g11007.t1 | 3714 | g8699.t1 | | 0 | 1.587767 | 2.088946 | −1.90951 | 3.544881 | 0.020897 |
| 1890 | g1760.t1 | 3715 | g1200.t1 | | 0 | 3.246854 | 2.445799 | −1.91563 | 3.541022 | 0.021005 |
| 1891 | g10371.t1 | 3716 | g10538.t1 | | 0 | 4.965362 | 5.078563 | −1.91874 | 3.539065 | 0.021065 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 1892 | g7221.t1 | 3717 | g5890.t1 | | 5.661483 | 1.072226 | −3.76681 | −1.93127 | −3.53117 | 0.021281 |
| 1893 | g6375.t1 | 3718 | g771.t1 | | 8.208151 | 3.648937 | −4.25444 | −1.93282 | −3.53019 | 0.021294 |
| 1896 | g2909.t1 | 3721 | g6002.t1 | | 1.238494 | 4.449583 | 3.244239 | −1.93586 | 3.52828 | 0.021322 |
| 1894 | g5154.t1 | 3719 | g3823.t1 | K17095: ANXA7_11 | 3.505958 | 9.283634 | 4.528734 | −1.93535 | 3.528604 | 0.021322 |
| 1895 | g20345.t1 | 3720 | g7516.t1 | | 0 | 4.951177 | 4.852188 | −1.93559 | 3.528453 | 0.021322 |
| 1897 | g12606.t1 | 3722 | g1144.t1 | | 0 | 2.337207 | 2.424768 | −1.94189 | 3.524487 | 0.02143 |
| 1898 | g7465.t1 | 3723 | g6869.t1 | | 3.054874 | 8.104242 | 4.242867 | −1.94419 | 3.52304 | 0.021452 |
| 1899 | g5267.t1 | 3724 | g9694.t1 | | 1.826832 | 5.783242 | 3.837809 | −1.9491 | 3.519947 | 0.021535 |
| 1900 | g4664.t1 | 3725 | g2382.t1 | | 5.504862 | 1.603502 | −4.21381 | −1.95339 | −3.51725 | 0.021593 |
| 1901 | g17749.t1 | 2523 | g12099.t1 | | 7.598291 | 9.839638 | 2.512479 | −1.95532 | 3.516031 | 0.021628 |
| 1902 | g6418.t1 | 3726 | g5371.t1 | K03778: ldhA | 2.853999 | 4.669676 | 2.946243 | −1.95976 | 3.513237 | 0.021721 |
| 1903 | g10763.t1 | 3727 | g12010.t1 | K01209: E3.2.1.55, abfA | 2.945033 | 0 | −3.29535 | −1.96318 | −3.51109 | 0.02177 |
| 1904 | g666.t1 | 3728 | g9881.t1 | | 4.362664 | 0.664419 | −3.76077 | −1.96699 | −3.50869 | 0.021838 |
| 1906 | g1908.t1 | 3730 | g8731.t1 | | 2.211455 | 0 | −3.68585 | −1.97784 | −3.50187 | 0.022044 |
| 1907 | g3413.t1 | 3731 | g4733.t1 | K06902: UMF1 | 2.141863 | 7.189473 | 4.094946 | −1.97792 | 3.501818 | 0.022044 |
| 1905 | g9155.t1 | 3729 | g6487.t1 | K02324: POLE1 | 4.234902 | 8.900666 | 4.422793 | −1.97738 | 3.502159 | 0.022044 |
| 1908 | g10394.t1 | 3732 | g10563.t1 | | 0 | 5.322562 | 4.509387 | −1.9801 | 3.50045 | 0.022075 |
| 1909 | g7696.t1 | 3733 | g11509.t1 | | 0.601935 | 3.107555 | 2.748423 | −1.98765 | 3.495705 | 0.022202 |
| 1910 | g2535.t1 | 3734 | g3567.t1 | K05758: ARPC2 | 11.15766 | 3.882187 | −7.40548 | −1.99331 | −3.49215 | 0.022306 |
| 1911 | g8186.t1 | 3735 | g7993.t1 | K01079: serB, PSPH | 4.063757 | 0.499721 | −4.16492 | −1.99443 | −3.49144 | 0.022322 |
| 1912 | g4471.t1 | 3736 | g6834.t1 | | 0.878562 | 4.743026 | 3.759323 | −1.99869 | 3.488764 | 0.022414 |
| 1913 | g8237.t1 | 3737 | g10043.t1 | | 3.086194 | 5.293821 | 2.302039 | −1.99973 | 3.488113 | 0.022418 |
| 1914 | g9619.t1 | 3738 | g7243.t1 | K11339: MORF4L1, MRG15, EAF3 | 0 | 2.363574 | 3.497394 | −2.00042 | 3.487675 | 0.022424 |
| 1915 | g1911.t1 | 3739 | g6147.t1 | K08334: BECN1, VPS30, ATG6 | 4.443069 | 1.325402 | −4.48934 | −2.0025 | −3.48637 | 0.022458 |
| 1916 | g7540.t1 | 3740 | g7267.t1 | K01179: E3.2.1.4 | 3.106323 | 7.044516 | 4.718377 | −2.0027 | 3.486247 | 0.022458 |
| 1917 | g2857.t1 | 3741 | g9061.t1 | | 4.958463 | 1.63825 | −3.2435 | −2.00585 | −3.48427 | 0.022502 |
| 1918 | g5306.t1 | 3742 | g2255.t1 | | 5.053243 | 1.769587 | −3.06328 | −2.00736 | −3.48332 | 0.022507 |
| 1919 | g4916.t1 | 3743 | g4552.t1 | K13950: pabAB | 0 | 4.100904 | 3.309752 | −2.00896 | 3.482311 | 0.022524 |
| 1920 | g7255.t1 | 3744 | g10781.t1 | | 1.044041 | 5.343757 | 3.456906 | −2.0128 | 3.479902 | 0.022607 |
| 1921 | g5468.t1 | 3745 | g8430.t1 | | 4.014859 | 1.728033 | −2.2011 | −2.02184 | −3.47423 | 0.022807 |
| 1922 | g10379.t1 | 3746 | g10546.t1 | K03507: DPB11 | 0 | 2.887983 | 2.329258 | −2.02243 | 3.473857 | 0.02281 |
| 1923 | g2332.t1 | 3747 | g9197.t1 | K09484: QUIB, qa-3 | 0.359609 | 4.730422 | 6.455702 | −2.04055 | 3.462484 | 0.023216 |
| 640 | g12554.t1 | 2440 | g3576.t1 | K02953: RP-S13e, RPS13 | 6.593986 | 3.286592 | −3.5936 | −2.0451 | −3.45963 | 0.023319 |
| 1924 | g134.t1 | 3748 | g5827.t1 | | 6.48267 | 2.73113 | −3.87561 | −2.04641 | −3.4588 | 0.023339 |
| 1925 | g6562.t1 | 3749 | g10098.t1 | K04627: STE3 | 6.840025 | 3.508287 | −3.0943 | −2.04677 | −3.45858 | 0.023339 |
| 1926 | g835.t1 | 3750 | g8204.t1 | | 5.9061 | 3.739419 | −2.89332 | −2.05738 | −3.45193 | 0.023574 |
| 1927 | g3961.t1 | 3751 | g3929.t1 | K15631: ABA3 | 4.682251 | 0.610791 | −4.20667 | −2.05917 | −3.4508 | 0.023606 |
| 1928 | g9090.t1 | 3752 | g8544.t1 | | 9.042656 | 3.394564 | −4.42541 | −2.06054 | −3.44994 | 0.023622 |
| 1929 | g8220.t1 | 3753 | g10063.t1 | K11380: NTO1 | 0.981794 | 5.762532 | 4.770402 | −2.06314 | 3.448316 | 0.023659 |
| 1930 | g1688.t1 | 3754 | g4655.t1 | | 3.67154 | 6.41277 | 3.431308 | −2.06707 | 3.445853 | 0.02371 |
| 1931 | g10593.t1 | 3755 | g7036.t1 | | 0 | 1.637191 | 2.310481 | −2.06843 | 3.444999 | 0.023734 |
| 1932 | g7454.t1 | 3756 | g6881.t1 | K13237: DECR2 | 7.244054 | 3.351771 | −4.66071 | −2.07246 | −3.44247 | 0.023826 |
| 1933 | g1006.t1 | 3757 | g8076.t1 | | 5.641821 | 1.01679 | −5.33245 | −2.07757 | −3.43927 | 0.023924 |
| 1934 | g558.t1 | 3758 | g6454.t1 | | 5.468701 | 2.998081 | −3.81423 | −2.07899 | −3.43838 | 0.02395 |
| 1935 | g8492.t1 | 3759 | g3364.t1 | | 2.17787 | 5.143839 | 3.198935 | −2.08565 | 3.434206 | 0.024077 |
| 1936 | g3284.t1 | 3760 | g8263.t1 | K04567: KARS, lysS | 0 | 3.096837 | 2.750146 | −2.09247 | 3.429933 | 0.024176 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 1937 | g10375.t1 | 3761 | g10542.t1 | K18163: NDUFAF6 | 0 | 3.09048 | 3.372823 | −2.09383 | 3.429081 | 0.024189 |
| 1938 | g9651.t1 | 3762 | g6914.t1 | | 8.216351 | 3.957187 | −3.97535 | −2.09941 | −3.42558 | 0.02429 |
| 1939 | g6236.t1 | 3763 | g7134.t1 | | 1.92867 | 9.554801 | 7.372855 | −2.10264 | 3.423559 | 0.024364 |
| 1940 | g5143.t1 | 3764 | g3836.t1 | | 2.580565 | 8.674743 | 4.091749 | −2.1038 | 3.422838 | 0.024383 |
| 1941 | g11455.t1 | 3765 | g7021.t1 | | 0.596448 | 5.043975 | 4.462447 | −2.10687 | 3.420916 | 0.024452 |
| 1942 | g5389.t1 | 3766 | g2429.t1 | | 4.873893 | 0 | −5.94573 | −2.11075 | −3.41849 | 0.024543 |
| 1943 | g6232.t1 | 3767 | g7130.t1 | | 6.918168 | 0.488136 | −5.39134 | −2.11243 | −3.41743 | 0.024569 |
| 1944 | g13866.t1 | 3768 | g4613.t1 | K15115: SLC25A32, MFT | 0.791928 | 5.833256 | 4.134026 | −2.11257 | 3.417341 | 0.024569 |
| 1945 | g7546.t1 | 3769 | g7261.t1 | K06113: abnA_B | 1.693461 | 6.005734 | 3.98049 | −2.11746 | 3.414282 | 0.024676 |
| 1946 | g10144.t1 | 3770 | g8474.t1 | K17086: TM9SF2_4 | 6.358648 | 2.274685 | −5.01733 | −2.12573 | −3.40911 | 0.024862 |
| 1947 | g8973.t1 | 3771 | g11361.t1 | K08496: GOSR2, BOS1 | 0 | 3.168015 | 2.664668 | −2.12811 | 3.407616 | 0.024915 |
| 1948 | g5708.t1 | 3772 | g2670.t1 | | 3.903218 | 6.617966 | 3.389449 | −2.13389 | 3.403997 | 0.025048 |
| 1950 | g6963.t1 | 3774 | g6427.t1 | K14408: CSTF3, RNA14 | 6.941008 | 0 | −5.14398 | −2.13547 | −3.40301 | 0.025067 |
| 1949 | g15819.t1 | 3773 | g6469.t1 | | 6.143278 | 2.028742 | −3.66691 | −2.13542 | −3.40304 | 0.025067 |
| 1951 | g9667.t1 | 3775 | g4881.t1 | K18757: LARP1 | 1.474494 | 5.026138 | 3.073674 | −2.13624 | 3.40253 | 0.025072 |
| 1952 | g12694.t1 | 3776 | g8901.t1 | | 0 | 4.059599 | 3.514485 | −2.13747 | 3.401759 | 0.025087 |
| 1953 | g3429.t1 | 3777 | g4716.t1 | K10755: RFC2_4 | 6.366861 | 3.029398 | −4.00095 | −2.13997 | −3.4002 | 0.02512 |
| 1954 | g4582.t1 | 3778 | g4118.t1 | | 1.381451 | 5.626283 | 4.430383 | −2.14063 | 3.399781 | 0.025126 |
| 1955 | g3157.t1 | 3779 | g4989.t1 | | 3.100887 | 8.957858 | 6.174002 | −2.15214 | 3.392585 | 0.025381 |
| 1956 | g82.t1 | 3780 | g2764.t1 | K17422: MRPL41 | 0 | 6.458967 | 4.487087 | −2.15351 | 3.391728 | 0.025396 |
| 1957 | g624.t1 | 3781 | g11304.t1 | | 0.779024 | 4.503237 | 2.584446 | −2.15576 | 3.390322 | 0.025427 |
| 1958 | g1143.t1 | 3782 | g253.t1 | | 0 | 4.407125 | 4.086029 | −2.16257 | 3.38606 | 0.025587 |
| 1959 | g6371.t1 | 3783 | g780.t1 | K08287: E2.7.12.1 | 2.726445 | 7.392615 | 5.376711 | −2.17655 | 3.377322 | 0.025905 |
| 1960 | g1751.t1 | 3784 | g9723.t1 | | 2.795334 | 5.572355 | 3.187095 | −2.17894 | 3.375831 | 0.025959 |
| 1961 | g4236.t1 | 3785 | g1745.t1 | | 4.004311 | 6.248441 | 2.562026 | −2.18036 | 3.374942 | 0.025987 |
| 1962 | g8695.t1 | 3786 | g11550.t1 | | 4.911201 | 1.458168 | −3.1977 | −2.18135 | −3.37432 | 0.026004 |
| 859 | g490.t1 | 2536 | g5492.t1 | K01230: MAN1 | 3.341994 | 5.830489 | 2.819683 | −2.18329 | 3.37311 | 0.026046 |
| 1963 | g5421.t1 | 3787 | g5085.t1 | | 8.070442 | 0.46074 | −5.99862 | −2.18759 | −3.37042 | 0.026135 |
| 1964 | g2502.t1 | 3788 | g3530.t1 | K13288: orn, REX2, REXO2 | 0 | 4.539539 | 4.217905 | −2.18823 | 3.370025 | 0.026138 |
| 1965 | g2567.t1 | 3789 | g5735.t1 | | 4.150469 | 7.075168 | 2.267847 | −2.19188 | 3.367744 | 0.026205 |
| 1966 | g4811.t1 | 3790 | g9600.t1 | | 3.984392 | 2.169587 | −2.35064 | −2.19298 | −3.36706 | 0.026224 |
| 1967 | g6775.t1 | 3791 | g4391.t1 | K18748: SSD1 | 7.196236 | 1.868572 | −5.15477 | −2.20272 | −3.36098 | 0.026429 |
| 1969 | g10391.t1 | 3793 | g10558.t1 | | 0 | 5.449561 | 5.122671 | −2.21155 | 3.35546 | 0.026586 |
| 1968 | g1041.t1 | 3792 | g8112.t1 | K11227: PBS2 | 0 | 5.802497 | 5.568864 | −2.2107 | 3.355987 | 0.026586 |
| 1971 | g11559.t1 | 3795 | g4170.t1 | | 5.952815 | 2.501869 | −3.41726 | −2.21296 | −3.35458 | 0.026603 |
| 1970 | g13704.t1 | 3794 | g11109.t1 | | 1.780391 | 5.388679 | 3.682525 | −2.21285 | 3.354646 | 0.026603 |
| 1972 | g3779.t1 | 3796 | g2656.t1 | | 0 | 2.29459 | 3.055708 | −2.21449 | 3.353624 | 0.026623 |
| 1973 | g2737.t1 | 3797 | g9165.t1 | | 8.111867 | 3.708757 | −3.11076 | −2.21608 | −3.35263 | 0.026657 |
| 1974 | g6644.t1 | 3798 | g10196.t1 | | 0.529024 | 4.052835 | 2.69518 | −2.21902 | 3.350793 | 0.026706 |
| 1975 | g9251.t1 | 3799 | g10432.t1 | | 6.615159 | 0.815708 | −4.57198 | −2.2196 | −3.35043 | 0.02671 |
| 1977 | g5146.t1 | 3801 | g3831.t1 | | 1.613274 | 5.642097 | 3.424626 | −2.22255 | 3.348593 | 0.026759 |
| 1976 | g7543.t1 | 3800 | g7264.t1 | | 1.778839 | 6.311218 | 3.7799 | −2.22228 | 3.348757 | 0.026759 |
| 1978 | g7853.t1 | 3802 | g10510.t1 | K15306: RANBP1 | 0 | 1.987939 | 2.649547 | −2.22545 | 3.34678 | 0.026819 |
| 1979 | g7747.t1 | 3803 | g7097.t1 | K14791: PWP1 | 1.814601 | 4.202941 | 2.631876 | −2.22599 | 3.346441 | 0.026823 |
| 1980 | g3283.t1 | 3804 | g8262.t1 | K11400: ARP4 | 0 | 2.989351 | 3.88489 | −2.22752 | 3.345492 | 0.026855 |
| 1981 | g3579.t1 | 3805 | g3304.t1 | K00472: E1.14.11.2 | 3.489594 | 9.820105 | 6.138885 | −2.22818 | 3.345078 | 0.026862 |
| 1982 | g4997.t1 | 3806 | g8967.t1 | | 1.989279 | 5.409008 | 3.503902 | −2.2339 | 3.341506 | 0.026993 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 1983 | g466.t1 | 3807 | g8012.t1 | | 4.101739 | 6.505153 | 2.812413 | −2.23476 | 3.34097 | 0.027006 |
| 1984 | g3042.t1 | 3808 | g1617.t1 | K01638: E2.3.3.9, aceB, glcB | 4.286461 | 1.427891 | −2.69449 | −2.23709 | −3.33952 | 0.027061 |
| 1985 | g2105.t1 | 3809 | g2480.t1 | K12189: VPS25, EAP20 | 5.392127 | 1.688441 | −3.98468 | −2.24246 | −3.33617 | 0.027171 |
| 1986 | g10030.t1 | 3810 | g3456.t1 | K03952: NDUFA8 | 4.085114 | 0.317024 | −3.2909 | −2.24726 | −3.33317 | 0.027263 |
| 1987 | g10020.t1 | 3811 | g10918.t1 | K01238: E3.2.1.— | 0 | 2.377597 | 3.865002 | −2.24806 | 3.332671 | 0.027274 |
| 1988 | g6440.t1 | 3812 | g9393.t1 | | 1.856577 | 5.779447 | 3.68737 | −2.25497 | 3.328362 | 0.027454 |
| 1989 | g10867.t1 | 3813 | g124.t1 | | 0 | 4.39728 | 4.400864 | −2.25581 | 3.32784 | 0.027467 |
| 1990 | g3799.t1 | 3814 | g863.t1 | | 5.870835 | 2.857198 | −2.27046 | −2.25914 | −3.32576 | 0.027534 |
| 1991 | g10346.t1 | 3815 | g44.t1 | K18328: DBR1 | 0 | 2.241769 | 3.604053 | −2.25968 | 3.325424 | 0.027534 |
| 1992 | g9896.t1 | 3816 | g3480.t1 | | 0 | 5.417973 | 5.231502 | −2.25972 | 3.325396 | 0.027534 |
| 1993 | g7695.t1 | 3817 | g11508.t1 | K01640: E4.1.3.4, HMGCL, hmgL | 0.184849 | 4.606471 | 4.094707 | −2.26451 | 3.322414 | 0.02764 |
| 1994 | g851.t1 | 3818 | g9450.t1 | | 7.233882 | 2.603782 | −3.98752 | −2.26621 | −3.32135 | 0.027678 |
| 1995 | g13873.t1 | 3819 | g4607.t1 | K14845: RAH, DOM3Z | 1.75337 | 5.060998 | 3.620071 | −2.27209 | 3.317686 | 0.027818 |
| 1996 | g5244.t1 | 3820 | g2347.t1 | K02877: RP-L15e, RPL15 | 4.414688 | 11.84847 | 5.818625 | −2.27366 | 3.316708 | 0.027853 |
| 1997 | g13106.t1 | 3821 | g9753.t1 | K01892: HARS, hisS | 0 | 2.209128 | 2.453035 | −2.27519 | 3.315751 | 0.027886 |
| 1998 | g11726.t1 | 3822 | g5854.t1 | | 5.938268 | 0.538037 | −5.1103 | −2.27837 | −3.31377 | 0.02796 |
| 1999 | g2723.t1 | 3823 | g9178.t1 | | 4.416635 | 0.748978 | −3.32728 | −2.28414 | −3.31017 | 0.028107 |
| 2000 | g5988.t1 | 3824 | g11687.t1 | | 6.638403 | 4.410083 | −2.22473 | −2.28525 | −3.30948 | 0.028129 |
| 2001 | g6939.t1 | 3825 | g6449.t1 | K01560: E3.8.1.2 | 1.458794 | 5.793547 | 4.011947 | −2.29299 | 3.304659 | 0.028315 |
| 2003 | g13415.t1 | 3827 | g8381.t1 | K00618: E2.3.1.1 | 5.219776 | 7.979734 | 3.470781 | −2.29519 | 3.303285 | 0.028357 |
| 2002 | g37.t1 | 3826 | g2834.t1 | K02926: RP-L4, MRPL4, rplD | 1.828605 | 4.71647 | 4.723031 | −2.29519 | 3.303285 | 0.028357 |
| 2004 | g3662.t1 | 3828 | g651.t1 | | 0.872427 | 6.371311 | 4.041603 | −2.29616 | 3.302681 | 0.028362 |
| 2005 | g9235.t1 | 3829 | g3428.t1 | | 0 | 3.972927 | 4.57957 | −2.29616 | 3.302679 | 0.028362 |
| 2006 | g7674.t1 | 3830 | g7572.t1 | | 5.466518 | 2.783883 | −4.32184 | −2.29711 | −3.30209 | 0.028368 |
| 2007 | g4036.t1 | 3831 | g3210.t1 | | 4.501248 | 0.83444 | −3.4584 | −2.29717 | −3.30205 | 0.028368 |
| 2008 | g5276.t1 | 3832 | g2295.t1 | | 4.938586 | 0.923903 | −3.91412 | −2.30002 | −3.30028 | 0.028406 |
| 2009 | g11802.t1 | 3833 | g12042.t1 | | 3.076257 | 6.471818 | 3.398775 | −2.30107 | 3.299622 | 0.028426 |
| 2010 | g9414.t1 | 3834 | g3612.t1 | | 6.623875 | 3.522539 | −4.17633 | −2.30173 | −3.29921 | 0.028434 |
| 656 | g16181.t1 | 2457 | g12075.t1 | K08257: E3.2.1.101 | 5.57367 | 2.794291 | −3.13674 | −2.30477 | −3.29731 | 0.028477 |
| 2012 | g10897.t1 | 3836 | g5902.t1 | | 0 | 2.586402 | 2.018878 | −2.30447 | 3.297501 | 0.028477 |
| 2011 | g7210.t1 | 3835 | g5874.t1 | K09780: K09780 | 1.114388 | 3.993513 | 3.261747 | −2.30435 | 3.297579 | 0.028477 |
| 2013 | g4453.t1 | 3837 | g6809.t1 | | 5.118903 | 0.695521 | −6.34745 | −2.31256 | −3.29247 | 0.028643 |
| 2014 | g606.t1 | 3838 | g3853.t1 | K16261: YAT | 3.858126 | 5.880152 | 2.075602 | −2.32021 | 3.287698 | 0.028843 |
| 2015 | g4470.t1 | 3839 | g6833.t1 | | 1.147637 | 5.898161 | 3.859584 | −2.3248 | 3.284838 | 0.028961 |
| 2016 | g6738.t1 | 3840 | g7868.t1 | | 5.417721 | 3.126867 | −3.45553 | −2.32976 | −3.28175 | 0.029069 |
| 2017 | g9769.t1 | 3841 | g939.t1 | K15326: TSEN54 | 2.152088 | 5.841014 | 4.075185 | −2.33059 | 3.281231 | 0.029079 |
| 2018 | g8609.t1 | 3842 | g3035.t1 | K11684: BDF1 | 5.659852 | 2.072019 | −3.03129 | −2.33159 | −3.28061 | 0.029098 |
| 2019 | g7209.t1 | 3843 | g5873.t1 | | 1.535387 | 3.753918 | 2.595474 | −2.33355 | 3.279388 | 0.029145 |
| 2020 | g9079.t1 | 3844 | g7839.t1 | | 3.237265 | 5.083271 | 2.50233 | −2.33749 | 3.276937 | 0.029238 |
| 2021 | g488.t1 | 3845 | g5490.t1 | | 5.069028 | 0.661124 | −3.94585 | −2.33858 | −3.27626 | 0.02924 |
| 2022 | g11121.t1 | 3846 | g740.t1 | | 1.095174 | 5.476241 | 3.763338 | −2.33866 | 3.276212 | 0.02924 |
| 2023 | g7270.t1 | 3847 | g11833.t1 | K01649: leuA | 0.794723 | 4.590596 | 3.756172 | −2.34295 | 3.27354 | 0.029292 |
| 2024 | g8493.t1 | 3848 | g3365.t1 | | 3.869494 | 6.395043 | 2.369665 | −2.35653 | 3.265084 | 0.029712 |
| 2025 | g9798.t1 | 3849 | g10841.t1 | K04564: SOD2 | 6.169922 | 3.581629 | −3.17615 | −2.35997 | −3.26294 | 0.029809 |
| 2026 | g4827.t1 | 3850 | g711.t1 | | 3.138123 | 5.609277 | 2.266361 | −2.36209 | 3.261622 | 0.029865 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 2027 | g7690.t1 | 3851 | g7594.t1 | K09705: K09705 | 6.512504 | 2.963367 | −3.48703 | −2.3645 | −3.26012 | 0.029917 |
| 2028 | g6785.t1 | 3852 | g4403.t1 | K06111: EXOC4, SEC8L1 | 7.141887 | 3.434524 | −3.10329 | −2.36545 | −3.25954 | 0.029935 |
| 2029 | g11719.t1 | 3853 | g2321.t1 | | 4.122011 | 2.09891 | −3.55772 | −2.36866 | −3.25754 | 0.030026 |
| 2030 | g4828.t1 | 3854 | g712.t1 | | 5.692735 | 2.652303 | −3.51649 | −2.37281 | −3.25496 | 0.030122 |
| 2031 | g942.t1 | 3855 | g9313.t1 | K09241: GAL4 | 1.854413 | 3.96608 | 2.304511 | −2.37691 | 3.252404 | 0.030229 |
| 2032 | g11848.t1 | 3856 | g8790.t1 | | 2.601552 | 0.409353 | −2.22171 | −2.37796 | −3.25175 | 0.030251 |
| 2033 | g21824.t1 | 3857 | g7394.t1 | | 0 | 5.23534 | 3.655249 | −2.38527 | 3.247202 | 0.030464 |
| 2034 | g2821.t1 | 3858 | g11279.t1 | | 5.756117 | 3.458502 | −2.0711 | −2.3872 | −3.24601 | 0.030515 |
| 2035 | g6696.t1 | 3859 | g11145.t1 | K09704: K09704 | 7.789281 | 2.074215 | −5.24082 | −2.38775 | −3.24566 | 0.03052 |
| 2036 | g4155.t1 | 3860 | g1823.t1 | K18551: SDT1 | 5.022148 | 1.693257 | −2.97251 | −2.38832 | −3.2453 | 0.030526 |
| 2037 | g9766.t1 | 3861 | g942.t1 | | 3.212965 | 8.164358 | 4.327837 | −2.39337 | 3.242162 | 0.030679 |
| 2039 | g13908.t1 | 3863 | g8736.t1 | | 3.218518 | 0.78025 | −2.44992 | −2.39434 | −3.24156 | 0.030685 |
| 2038 | g9809.t1 | 3862 | g10829.t1 | | 3.118004 | 5.544287 | 2.518375 | −2.39418 | 3.24166 | 0.030685 |
| 2040 | g6787.t1 | 3864 | g4405.t1 | | 1.161527 | 5.099231 | 3.21425 | −2.39714 | 3.239817 | 0.030752 |
| 2041 | g9405.t1 | 3865 | g3622.t1 | | 3.567627 | 5.477382 | 2.497615 | −2.40468 | 3.23513 | 0.030977 |
| 2042 | g2509.t1 | 3866 | g3539.t1 | K11874: UBP16 | 1.872531 | 5.493777 | 3.650258 | −2.4068 | 3.233811 | 0.031035 |
| 2043 | g5355.t1 | 3867 | g9.t1 | | 2.290026 | 0.356189 | −2.03022 | −2.40761 | −3.23331 | 0.031049 |
| 2044 | g4497.t1 | 3868 | g10803.t1 | | 4.996184 | 7.333602 | 3.047979 | −2.4116 | 3.230832 | 0.031143 |
| 2045 | g8224.t1 | 3869 | g10058.t1 | | 3.041354 | 5.822561 | 3.713464 | −2.41714 | 3.227386 | 0.031264 |
| 2046 | g4940.t1 | 3870 | g4580.t1 | | 2.195152 | 8.603997 | 5.13217 | −2.41716 | 3.227371 | 0.031264 |
| 2047 | g3634.t1 | 3871 | g611.t1 | K08331: ATG13 | 3.988422 | 0.822981 | −3.37249 | −2.42114 | −3.2249 | 0.031385 |
| 2048 | g228.t1 | 3872 | g11036.t1 | K14833: NOC2 | 5.004033 | 8.298645 | 2.944132 | −2.43094 | 3.218805 | 0.031692 |
| 2049 | g48.t1 | 3873 | g2823.t1 | K01433: purU | 2.612144 | 5.741983 | 3.012018 | −2.43232 | 3.217947 | 0.031713 |
| 2050 | g281.t1 | 3874 | g11374.t1 | | 9.37879 | 4.604117 | −4.12735 | −2.43274 | −3.21769 | 0.031713 |
| 2051 | g12734.t1 | 3875 | g5711.t1 | K11662: ACTR6, ARP6 | 0 | 2.30116 | 2.840219 | −2.43365 | 3.217125 | 0.031718 |
| 2052 | g10764.t1 | 3876 | g12011.t1 | K01581: E4.1.1.17, ODC1, speC, speF | 5.248823 | 0.219074 | −4.66848 | −2.4346 | −3.21653 | 0.031737 |
| 2053 | g3828.t1 | 3877 | g2599.t1 | K00505: TYR | 0.869044 | 5.111409 | 3.294953 | −2.43787 | 3.214499 | 0.031836 |
| 2054 | g1137.t1 | 3878 | g246.t1 | | 5.271354 | 1.818388 | −3.65818 | −2.43939 | −3.21355 | 0.031875 |
| 2055 | g4066.t1 | 3879 | g3252.t1 | | 3.515498 | 1.112324 | −2.46994 | −2.44069 | −3.21275 | 0.031906 |
| 2056 | g10836.t1 | 3880 | g9834.t1 | | 0.621439 | 3.119334 | 2.691703 | −2.44409 | 3.210636 | 0.03201 |
| 2057 | g5068.t1 | 3881 | g8335.t1 | K14685: SLC40A1, FPN1 | 0 | 7.218235 | 6.29332 | −2.44716 | 3.208723 | 0.032062 |
| 2058 | g9620.t1 | 3882 | g7242.t1 | K01648: ACLY | 0 | 3.90929 | 3.533252 | −2.45537 | 3.203626 | 0.032253 |
| 2059 | g5229.t1 | 3883 | g2363.t1 | | 5.943001 | 0.548669 | −5.4291 | −2.46004 | −3.20072 | 0.032375 |
| 2060 | g8605.t1 | 3884 | g3038.t1 | | 4.532655 | 1.818868 | −2.9624 | −2.46055 | −3.20041 | 0.032379 |
| 2061 | g10730.t1 | 3885 | g2912.t1 | K01469: OPLAH, OXP1, oplAH | 0 | 2.379516 | 2.107655 | −2.46555 | 3.1973 | 0.032541 |
| 2062 | g4774.t1 | 3886 | g3677.t1 | K15631: ABA3 | 9.027659 | 4.836111 | −4.01499 | −2.46683 | −3.1965 | 0.032572 |
| 2063 | g4508.t1 | 3887 | g10813.t1 | | 0.165642 | 5.824528 | 5.711017 | −2.46786 | 3.195865 | 0.032595 |
| 2064 | g2571.t1 | 3888 | g5739.t1 | | 0.293052 | 8.085137 | 4.840508 | −2.46935 | 3.194939 | 0.03262 |
| 2065 | g5434.t1 | 3889 | g3137.t1 | | 5.143051 | 1.033474 | −3.99467 | −2.47101 | −3.19391 | 0.032665 |
| 2066 | g1199.t1 | 3890 | g353.t1 | K02895: RP-L24, MRPL24, rplX | 6.44631 | 2.830134 | −5.33548 | −2.4716 | −3.19354 | 0.032672 |
| 2067 | g7868.t1 | 3891 | g10526.t1 | K02915: RP-L34e, RPL34 | 5.849423 | 1.765368 | −4.55948 | −2.47674 | −3.19035 | 0.032826 |
| 2068 | g1161.t1 | 3892 | g269.t1 | | 5.46016 | 3.009009 | −2.38008 | −2.48667 | −3.18418 | 0.033056 |
| 2070 | g4445.t1 | 3894 | g6797.t1 | | 4.844189 | 2.596249 | −3.82423 | −2.48854 | −3.18302 | 0.033082 |
| 2069 | g10124.t1 | 3893 | g92.t1 | | 4.215995 | 9.33502 | 4.637226 | −2.48825 | 3.1832 | 0.033082 |
| 2071 | g3873.t1 | 3895 | g4021.t1 | | 2.22259 | 5.09223 | 2.889394 | −2.49175 | 3.181028 | 0.033179 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 2072 | g2508.t1 | 3896 | g3536.t1 | | 0 | 6.070724 | 4.543999 | −2.49201 | 3.18087 | 0.033179 |
| 2073 | g8450.t1 | 3897 | g2681.t1 | | 0 | 2.871722 | 2.959236 | −2.4972 | 3.177646 | 0.033351 |
| 2074 | g7865.t1 | 3898 | g10523.t1 | | 7.879406 | 5.602482 | −4.36688 | −2.51011 | −3.16963 | 0.033735 |
| 2075 | g6937.t1 | 3899 | g6455.t1 | K13108: SNIP1 | 0.333353 | 7.112752 | 4.778096 | −2.51256 | 3.168111 | 0.033811 |
| 2076 | g4596.t1 | 3900 | g6012.t1 | K12855: PRPF6, PRP6 | 1.297068 | 7.636161 | 5.013494 | −2.51413 | 3.167137 | 0.033854 |
| 2077 | g16131.t1 | 3901 | g11950.t1 | K00616: E2.2.1.2, talA, talB | 4.139806 | 0.380959 | −2.80605 | −2.51525 | −3.16644 | 0.033861 |
| 2078 | g465.t1 | 3902 | g8013.t1 | K14325: RNPS1 | 0.1118 | 6.347517 | 6.203301 | −2.51547 | 3.166303 | 0.033861 |
| 2079 | g1164.t1 | 3903 | g270.t1 | | 0.318216 | 3.991449 | 5.225959 | −2.51682 | 3.165462 | 0.033883 |
| 2080 | g2408.t1 | 3904 | g9480.t1 | K18550: ISN1 | 5.538089 | 8.86782 | 4.347478 | −2.51899 | 3.164117 | 0.033935 |
| 2082 | g16130.t1 | 3906 | g7073.t1 | | 4.225688 | 6.146706 | 2.4124 | −2.52079 | 3.163002 | 0.033945 |
| 937 | g8077.t1 | 2540 | g7846.t1 | | 6.655406 | 8.379386 | 2.917067 | −2.52044 | 3.163218 | 0.033945 |
| 2081 | g5524.t1 | 3905 | g1651.t1 | | 1.597727 | 5.655543 | 3.534574 | −2.5205 | 3.163177 | 0.033945 |
| 2083 | g13129.t1 | 3907 | g7779.t1 | | 3.365795 | 1.169273 | −2.39087 | −2.52343 | −3.16136 | 0.034028 |
| 2084 | g10991.t1 | 3908 | g5657.t1 | K12627: LSM8 | 0 | 2.170848 | 3.541712 | −2.52601 | 3.159761 | 0.034109 |
| 2085 | g1929.t1 | 3909 | g6163.t1 | K01930: FPGS | 2.613598 | 6.785311 | 3.342673 | −2.52742 | 3.158884 | 0.034147 |
| 523 | g10740.t1 | 2319 | g11987.t1 | | 0 | 2.813231 | 2.132602 | −2.52798 | 3.15854 | 0.034153 |
| 2086 | g11974.t1 | 3910 | g12283.t1 | K01537: E3.6.3.8 | 4.46077 | 8.720128 | 4.497107 | −2.52922 | 3.15777 | 0.034185 |
| 2087 | g2386.t1 | 3911 | g9282.t1 | | 2.552078 | 5.80107 | 2.857308 | −2.52973 | 3.157452 | 0.03419 |
| 2088 | g11089.t1 | 3912 | g1541.t1 | | 2.958185 | 5.916026 | 3.473746 | −2.53269 | 3.155612 | 0.034271 |
| 549 | g6123.t1 | 2346 | g7324.t1 | | 9.721609 | 0 | −6.70978 | −2.53776 | −3.15247 | 0.034417 |
| 2089 | g2879.t1 | 3913 | g9507.t1 | | 1.588916 | 5.963453 | 4.232111 | −2.53843 | 3.152052 | 0.034428 |
| 2090 | g13476.t1 | 3914 | g8719.t1 | | 4.855623 | 0.713258 | −4.14789 | −2.54165 | −3.15005 | 0.034492 |
| 2091 | g10480.t1 | 3915 | g1680.t1 | | 5.35355 | 2.766663 | −3.30455 | −2.54237 | −3.1496 | 0.034504 |
| 2092 | g8013.t1 | 3916 | g3404.t1 | | 5.049113 | 0.484288 | −4.63964 | −2.54362 | −3.14883 | 0.034537 |
| 2093 | g4367.t1 | 3917 | g3791.t1 | K03448: FEN2, LIZ1 | 5.072018 | 0.779082 | −3.52579 | −2.54647 | −3.14707 | 0.034587 |
| 2094 | g6987.t1 | 3918 | g10858.t1 | | 0.511756 | 5.093495 | 4.425198 | −2.54912 | 3.145416 | 0.034644 |
| 2095 | g10431.t1 | 3919 | g8407.t1 | K14861: URB1 | 9.412961 | 2.402632 | −4.79559 | −2.55 | −3.14487 | 0.034663 |
| 2096 | g8248.t1 | 3920 | g10031.t1 | K17424: MRPL43 | 1.653332 | 7.208956 | 3.793246 | −2.55139 | 3.144009 | 0.034701 |
| 2097 | g9278.t1 | 3921 | g112.t1 | | 5.376359 | 0.900471 | −5.07129 | −2.5543 | −3.14221 | 0.034795 |
| 561 | g1198.t1 | 2358 | g352.t1 | K04513: RHOA | 2.185924 | 5.599431 | 3.115826 | −2.56335 | 3.136592 | 0.03508 |
| 2098 | g7656.t1 | 3922 | g7539.t1 | | 9.484291 | 3.272208 | −4.44358 | −2.56665 | −3.13455 | 0.035163 |
| 2099 | g9071.t1 | 3923 | g8570.t1 | | 0 | 4.308308 | 2.935063 | −2.5715 | 3.131534 | 0.035295 |
| 2100 | g2276.t1 | 3924 | g10693.t1 | K12761: SNF1 | 5.01028 | 6.964651 | 2.286462 | −2.57593 | 3.128788 | 0.035431 |
| 2101 | g14507.t1 | 3925 | g11494.t1 | K01187: malZ | 7.827356 | 5.131373 | −2.97808 | −2.5835 | −3.12409 | 0.03565 |
| 2102 | g4366.t1 | 3926 | g2127.t1 | | 3.108334 | 0.378977 | −3.23784 | −2.58635 | −3.12232 | 0.035746 |
| 2103 | g5569.t1 | 3927 | g7488.t1 | | 2.55743 | 5.105776 | 2.804623 | −2.58922 | 3.120544 | 0.035842 |
| 2104 | g12588.t1 | 3928 | g2936.t1 | | 5.341725 | 1.287142 | −4.50731 | −2.59295 | −3.11823 | 0.035935 |
| 2106 | g192.t1 | 3930 | g5819.t1 | | 0 | 4.078839 | 3.742625 | −2.5932 | 3.118072 | 0.035935 |
| 2105 | g935.t1 | 3929 | g9324.t1 | | 1.589025 | 6.970304 | 5.205593 | −2.59295 | 3.118226 | 0.035935 |
| 2107 | g7460.t1 | 3931 | g6874.t1 | K18176: COA3 | 0.679443 | 8.132716 | 6.326235 | −2.59401 | 3.117572 | 0.035941 |
| 2108 | g2807.t1 | 3932 | g3734.t1 | K01053: E3.1.1.17, gnl, RGN | 6.975277 | 3.879255 | −3.8776 | −2.59679 | −3.11585 | 0.036035 |
| 2109 | g4435.t1 | 3933 | g6774.t1 | | 3.295348 | 5.340307 | 2.156098 | −2.59927 | 3.114308 | 0.036117 |
| 2110 | g9401.t1 | 3934 | g3633.t1 | K12668: OST2, DAD1 | 5.100436 | 7.099716 | 3.045005 | −2.60147 | 3.112946 | 0.036176 |
| 2111 | g1263.t1 | 3935 | g448.t1 | K17421: MRPL40 | 0 | 5.570752 | 4.940149 | −2.60151 | 3.112921 | 0.036176 |
| 2112 | g3490.t1 | 3936 | g2182.t1 | K03350: APC3, CDC27 | 5.226216 | 7.504737 | 2.341709 | −2.60332 | 3.111795 | 0.036225 |
| 2113 | g10916.t1 | 3937 | g267.t1 | | 3.408478 | 5.633464 | 3.418244 | −2.60479 | 3.110889 | 0.036225 |
| 2114 | g921.t1 | 3938 | g9342.t1 | K18045: SIW14, OCA3 | 0 | 3.596272 | 3.808042 | −2.60499 | 3.11076 | 0.036225 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 2116 | g7478.t1 | 3940 | g6858.t1 | | 4.55802 | 0.837774 | −3.42667 | −2.61758 | −3.10295 | 0.036604 |
| 2115 | g1744.t1 | 3939 | g9730.t1 | K16261: YAT | 2.444031 | 4.709166 | 2.258978 | −2.61755 | 3.102974 | 0.036604 |
| 2117 | g10207.t1 | 3941 | g11173.t1 | K17866: DPH2 | 6.980775 | 0.764559 | −4.05418 | −2.62021 | −3.10133 | 0.036689 |
| 2118 | g11843.t1 | 3942 | g8773.t1 | K00993: EPT1 | 3.000341 | 0.893639 | −2.21354 | −2.62048 | −3.10116 | 0.036689 |
| 2119 | g3656.t1 | 3943 | g636.t1 | | 8.879204 | 5.164409 | −2.89019 | −2.62535 | −3.09814 | 0.03685 |
| 2120 | g4331.t1 | 3944 | g1983.t1 | | 4.236756 | 1.896176 | −3.14722 | −2.62618 | −3.09762 | 0.036854 |
| 2121 | g10256.t1 | 3945 | g7194.t1 | | 4.209344 | 0.708524 | −3.33023 | −2.62967 | −3.09546 | 0.036938 |
| 2122 | g9189.t1 | 3946 | g6521.t1 | K05663: ABC.ATM | 0.18774 | 5.583284 | 5.054504 | −2.63044 | 3.09498 | 0.036954 |
| 2123 | g9587.t1 | 3947 | g6638.t1 | K02976: RP-S26e, RPS26 | 0 | 3.89404 | 2.743634 | −2.63219 | 3.093898 | 0.037009 |
| 2124 | g3483.t1 | 3948 | g2152.t1 | K00472: E1.14.11.2 | 0 | 4.019165 | 3.218586 | −2.63269 | 3.093584 | 0.037015 |
| 2125 | g4515.t1 | 3949 | g10820.t1 | | 10.17358 | 3.683757 | −4.93347 | −2.6337 | −3.09296 | 0.03704 |
| 2126 | g5855.t1 | 3950 | g1148.t1 | K12874: AQR | 0 | 3.592743 | 3.462488 | −2.63616 | 3.091433 | 0.037124 |
| 2127 | g11080.t1 | 3951 | g1560.t1 | K13303: SGK2 | 3.663667 | 5.639852 | 2.488524 | −2.63746 | 3.090627 | 0.03716 |
| 2128 | g17161.t1 | 3952 | g9655.t1 | | 3.946776 | 6.251222 | 2.716762 | −2.63779 | 3.090423 | 0.03716 |
| 2129 | g913.t1 | 3953 | g9352.t1 | | 3.761447 | 1.842695 | −2.6974 | −2.64185 | −3.08791 | 0.037284 |
| 2131 | g4992.t1 | 3955 | g8962.t1 | | 5.568434 | 1.070393 | −4.64888 | −2.64356 | −3.08685 | 0.037304 |
| 2130 | g5921.t1 | 3954 | g11009.t1 | | 0.726064 | 3.654951 | 2.376852 | −2.64348 | 3.086896 | 0.037304 |
| 2132 | g10214.t1 | 3956 | g11973.t1 | | 4.391352 | 5.888419 | 2.232265 | −2.64574 | 3.085498 | 0.037377 |
| 2134 | g1192.t1 | 3958 | g2652.t1 | | 7.331953 | 0 | −4.76693 | −2.64809 | −3.08404 | 0.037428 |
| 2133 | g5409.t1 | 3957 | g8611.t1 | | 0.487121 | 6.397764 | 4.771873 | −2.64784 | 3.084192 | 0.037428 |
| 2135 | g6619.t1 | 3959 | g11272.t1 | K11159: K11159 | 10.02313 | 7.677217 | −2.84367 | −2.64911 | −3.08341 | 0.037454 |
| 2136 | g5978.t1 | 3960 | g11675.t1 | K01187: malZ | 4.632559 | 1.508608 | −2.55697 | −2.65074 | −3.0824 | 0.037506 |
| 2137 | g9539.t1 | 3961 | g6568.t1 | K05906: PCYOX1, FCLY | 0 | 3.166553 | 5.702237 | −2.6513 | 3.082052 | 0.037513 |
| 2138 | g13602.t1 | 3962 | g10129.t1 | K09579: PIN4 | 3.22586 | 7.700999 | 4.342095 | −2.65456 | 3.080031 | 0.037601 |
| 2139 | g10588.t1 | 3963 | g7031.t1 | | 0 | 5.84847 | 4.399222 | −2.65698 | 3.078527 | 0.03767 |
| 2140 | g8167.t1 | 3964 | g7975.t1 | | 4.268879 | 6.362638 | 3.264487 | −2.66061 | 3.076281 | 0.037775 |
| 2141 | g6658.t1 | 3965 | g10210.t1 | | 1.079636 | 5.470349 | 3.827162 | −2.66129 | 3.07586 | 0.037784 |
| 2142 | g1881.t1 | 3966 | g4234.t1 | K01725: cynS | 4.230103 | 2.82032 | −2.77283 | −2.66619 | −3.07282 | 0.037943 |
| 2143 | g11727.t1 | 3967 | g5855.t1 | | 3.728683 | 0.656698 | −2.85634 | −2.66698 | −3.07233 | 0.03796 |
| 2144 | g3432.t1 | 3968 | g4712.t1 | K00505: TYR | 0 | 3.109455 | 4.733726 | −2.67446 | 3.067691 | 0.038224 |
| 2145 | g20186.t1 | 3969 | g6363.t1 | | 5.012816 | 7.163425 | 2.999714 | −2.68527 | 3.060993 | 0.038598 |
| 2146 | g447.t1 | 3970 | g8029.t1 | K13431: SRPR | 4.802134 | 1.949645 | −2.92415 | −2.69849 | −3.0528 | 0.039107 |
| 2147 | g4444.t1 | 3971 | g6795.t1 | | 4.899102 | 2.093375 | −3.84401 | −2.69952 | −3.05216 | 0.039136 |
| 2148 | g18374.t1 | 3972 | g7684.t1 | K12856: PRPF8, PRP8 | 4.95726 | 1.392127 | −3.87785 | −2.70169 | −3.05082 | 0.039186 |
| 2149 | g8150.t1 | 3973 | g7956.t1 | K02959: RP-S16, MRPS16, rpsP | 5.17122 | 2.06327 | −3.42667 | −2.70179 | −3.05076 | 0.039186 |
| 2150 | g1210.t1 | 3974 | g364.t1 | | 5.549737 | 1.972661 | −3.45578 | −2.70577 | −3.04829 | 0.039324 |
| 2151 | g8164.t1 | 3975 | g7965.t1 | | 0.264932 | 6.326912 | 4.484822 | −2.71181 | 3.044544 | 0.039565 |
| 2153 | g8665.t1 | 3977 | g2654.t1 | | 4.448871 | 0 | −4.40278 | −2.71535 | −3.04235 | 0.039644 |
| 2154 | g6421.t1 | 3978 | g5368.t1 | | 3.418022 | 7.778884 | 4.446548 | −2.71542 | 3.04231 | 0.039644 |
| 2152 | g7000.t1 | 3976 | g6384.t1 | K15109: SLC25A20_29, CACT, CACL, CRC1 | 0 | 5.827294 | 5.75825 | −2.71486 | 3.042655 | 0.039644 |
| 2155 | g3832.t1 | 3979 | g2595.t1 | | 1.491655 | 5.211867 | 3.871807 | −2.71908 | 3.040044 | 0.039755 |
| 2156 | g10272.t1 | 3980 | g2373.t1 | | 6.233817 | 2.342297 | −5.51583 | −2.72027 | −3.03931 | 0.039778 |
| 2158 | g4169.t1 | 3982 | g1810.t1 | | 2.732171 | 7.333986 | 3.584184 | −2.72283 | 3.037719 | 0.039793 |
| 2157 | g10739.t1 | 3981 | g11986.t1 | | 0 | 3.441589 | 3.584342 | −2.72269 | 3.037804 | 0.039793 |
| 2159 | g5894.t1 | 3983 | g10982.t1 | K03030: PSMD14, RPN11, POH1 | 5.235811 | 0 | −4.2666 | −2.72651 | −3.03544 | 0.039906 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 2160 | g3017.t1 | 3984 | g8289.t1 | | 4.253797 | 2.232303 | −2.01665 | −2.72969 | −3.03347 | 0.040028 |
| 2161 | g2235.t1 | 3985 | g10642.t1 | | 0 | 8.944426 | 6.651699 | −2.73008 | 3.033226 | 0.040029 |
| 2162 | g444.t1 | 3986 | g8037.t1 | | 5.926244 | 1.755078 | −4.43879 | −2.73748 | −3.02864 | 0.040289 |
| 2163 | g8162.t1 | 3987 | g7962.t1 | | 2.242593 | 6.181948 | 2.975066 | −2.7414 | 3.026215 | 0.04044 |
| 2164 | g3781.t1 | 3988 | g2653.t1 | | 0 | 5.388341 | 4.391813 | −2.74166 | 3.026051 | 0.04044 |
| 2165 | g446.t1 | 3989 | g8030.t1 | | 1.248806 | 3.196143 | 2.232547 | −2.74479 | 3.024112 | 0.040546 |
| 2166 | g8813.t1 | 3990 | g11548.t1 | | 4.479092 | 1.564747 | −2.31147 | −2.75228 | −3.01947 | 0.040844 |
| 2168 | g484.t1 | 3992 | g5480.t1 | K01083: E3.1.3.8 | 6.104152 | 1.195312 | −3.75188 | −2.76953 | −3.00879 | 0.041524 |
| 2167 | g6382.t1 | 3991 | g762.t1 | K11578: ZW10 | 4.043617 | 7.246112 | 3.318946 | −2.76929 | 3.008933 | 0.041524 |
| 2169 | g13874.t1 | 3993 | g4606.t1 | | 2.192003 | 4.933315 | 3.081033 | −2.77099 | 3.007879 | 0.04156 |
| 2170 | g9768.t1 | 3994 | g940.t1 | | 1.599958 | 5.142409 | 3.111563 | −2.77117 | 3.00777 | 0.04156 |
| 2171 | g7100.t1 | 3995 | g5567.t1 | | 3.101236 | 4.623123 | 2.647789 | −2.77245 | 3.006974 | 0.041602 |
| 2172 | g7685.t1 | 3996 | g7577.t1 | | 4.579641 | 1.059627 | −4.79509 | −2.77348 | −3.00633 | 0.041632 |
| 2174 | g6166.t1 | 3998 | g9581.t1 | K10844: ERCC2, XPD | 3.612569 | 6.046916 | 2.409001 | −2.77444 | 3.005738 | 0.041644 |
| 2173 | g20840.t1 | 3997 | g5601.t1 | K09958: K09958 | 0 | 3.295785 | 3.355548 | −2.77424 | 3.005865 | 0.041644 |
| 2175 | g4928.t1 | 3999 | g4568.t1 | K10752: RBBP4, HAT2, CAF1, MIS16 | 0.721987 | 4.891137 | 3.366959 | −2.7761 | 3.004716 | 0.041686 |
| 2177 | g4731.t1 | 4001 | g2023.t1 | | 3.62063 | 8.542099 | 3.637606 | −2.78256 | 3.000712 | 0.041947 |
| 2176 | g13702.t1 | 4000 | g7799.t1 | | 1.507271 | 5.575516 | 5.445863 | −2.78244 | 3.000783 | 0.041947 |
| 2178 | g6999.t1 | 4002 | g6385.t1 | | 0 | 5.909998 | 6.710453 | −2.78479 | 2.999326 | 0.041984 |
| 2179 | g1200.t1 | 4003 | g354.t1 | K03189: ureG | 3.906083 | 6.287127 | 3.500283 | −2.78517 | 2.999091 | 0.041985 |
| 2180 | g894.t1 | 4004 | g9381.t1 | | 1.98344 | 3.689145 | 2.509227 | −2.78645 | 2.9983 | 0.042011 |
| 2181 | g4606.t1 | 4005 | g11246.t1 | | 6.888917 | 0.934867 | −4.17521 | −2.7892 | −2.9966 | 0.04212 |
| 2182 | g5836.t1 | 4006 | g1169.t1 | K01078: E3.1.3.2 | 4.897435 | 0.540874 | −3.08894 | −2.78981 | −2.99622 | 0.042132 |
| 2183 | g6795.t1 | 4007 | g4420.t1 | K00620: argJ | 1.412783 | 6.285553 | 3.554814 | −2.7905 | 2.995789 | 0.042148 |
| 2184 | g13700.t1 | 4008 | g7801.t1 | K06666: TUP1 | 4.676696 | 9.110953 | 5.842219 | −2.79358 | 2.993881 | 0.042237 |
| 2185 | g4127.t1 | 4009 | g1853.t1 | | 6.883091 | 3.151116 | −3.23591 | −2.79424 | −2.99347 | 0.042238 |
| 2186 | g3498.t1 | 4010 | g2189.t1 | K00888: PI4K | 4.387206 | 8.035595 | 3.806841 | −2.79735 | 2.991549 | 0.042365 |
| 2187 | g922.t1 | 4011 | g9339.t1 | | 0.335414 | 5.594 | 3.51525 | −2.80783 | 2.985057 | 0.042832 |
| 2188 | g2095.t1 | 4012 | g2498.t1 | | 2.312071 | 5.547566 | 3.491828 | −2.8095 | 2.984022 | 0.042893 |
| 2189 | g3886.t1 | 4013 | g4006.t1 | | 0.369905 | 5.31491 | 3.411646 | −2.81293 | 2.981892 | 0.04302 |
| 2191 | g2907.t1 | 4015 | g4478.t1 | K01361: E3.4.21.96 | 2.736066 | 5.91864 | 3.746675 | −2.81508 | 2.980564 | 0.043087 |
| 2190 | g4132.t1 | 4014 | g1848.t1 | | 3.459488 | 8.742363 | 3.852241 | −2.8149 | 2.980673 | 0.043087 |
| 2192 | g102.t1 | 4016 | g2922.t1 | K15628: PXA | 4.533487 | 1.423633 | −3.06092 | −2.81692 | −2.97942 | 0.043124 |
| 2193 | g22195.t1 | 4017 | g11335.t1 | | 5.038549 | 3.116899 | −3.18678 | −2.82113 | −2.97682 | 0.043256 |
| 2194 | g6067.t1 | 4018 | g11760.t1 | | 2.556856 | 5.057211 | 2.182582 | −2.82589 | 2.973866 | 0.043414 |
| 2195 | g7479.t1 | 4019 | g6857.t1 | | 6.476209 | 0.753273 | −5.14745 | −2.82832 | −2.97236 | 0.043492 |
| 2196 | g6849.t1 | 4020 | g1428.t1 | K14312: NUP155 | 5.863337 | 2.74764 | −3.23983 | −2.8286 | −2.97218 | 0.043492 |
| 2197 | g6740.t1 | 4021 | g4353.t1 | | 3.814661 | 6.39705 | 3.411605 | −2.83035 | 2.971099 | 0.043559 |
| 2198 | g1017.t1 | 4022 | g8086.t1 | | 1.006221 | 4.462038 | 2.793294 | −2.83106 | 2.970664 | 0.043575 |
| 2199 | g20453.t1 | 4023 | g7824.t1 | | 0 | 2.0793 | 2.784209 | −2.83156 | 2.970353 | 0.043583 |
| 2200 | g1014.t1 | 4024 | g8083.t1 | K13577: SLC25A10, DIC | 2.388955 | 4.532509 | 2.338145 | −2.83672 | 2.967153 | 0.04381 |
| 2201 | g3487.t1 | 4025 | g2179.t1 | | 0 | 3.411165 | 3.277123 | −2.83823 | 2.966219 | 0.04385 |
| 2202 | g3156.t1 | 4026 | g4990.t1 | | 3.806958 | 6.990748 | 5.291192 | −2.84227 | 2.963714 | 0.043975 |
| 2203 | g21845.t1 | 4027 | g8491.t1 | | 0 | 2.721806 | 3.270562 | −2.84342 | 2.963002 | 0.044014 |
| 2204 | g2266.t1 | 4028 | g10682.t1 | | 4.867023 | 3.323245 | −2.83067 | −2.84548 | −2.96173 | 0.044069 |
| 2205 | g11688.t1 | 4029 | g10852.t1 | | 3.032144 | 0.893416 | −2.19305 | −2.85456 | −2.9561 | 0.044448 |
| 2206 | g6381.t1 | 4030 | g763.t1 | | 5.116653 | 0.131962 | −3.22317 | −2.85525 | −2.95567 | 0.044464 |
| 2208 | g10499.t1 | 4032 | g1661.t1 | | 4.339082 | 6.042177 | 2.559442 | −2.85649 | 2.954904 | 0.044491 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| 2207 | g17551.t1 | 4031 | g8157.t1 | K00558: DNMT1, dcm | 2.888377 | 6.949835 | 3.089797 | −2.85616 | 2.955108 | 0.044491 |
| 2209 | g5340.t1 | 4033 | g9534.t1 | | 0.545456 | 7.258622 | 4.798642 | −2.85837 | 2.953743 | 0.044548 |
| 2210 | g5285.t1 | 4034 | g2285.t1 | | 2.96395 | 7.10547 | 3.24264 | −2.85885 | 2.953444 | 0.044555 |
| 2211 | g7357.t1 | 4035 | g10412.t1 | | 5.528929 | 0.619143 | −3.97539 | −2.86359 | −2.95051 | 0.044734 |
| 2213 | g726.t1 | 4037 | g10236.t1 | | 0.483715 | 2.68877 | 2.384127 | −2.86588 | 2.949088 | 0.044811 |
| 2212 | g3514.t1 | 4036 | g2206.t1 | K11397: EAF1, VID21 | 1.206815 | 6.642767 | 4.853325 | −2.86574 | 2.949177 | 0.044811 |
| 2214 | g7257.t1 | 4038 | g10783.t1 | | 1.642966 | 6.188124 | 2.989166 | −2.87117 | 2.945813 | 0.045035 |
| 2215 | g10215.t1 | 4039 | g11972.t1 | | 2.58645 | 7.403204 | 4.385523 | −2.87151 | 2.945602 | 0.045035 |
| 2216 | g12395.t1 | 4040 | g9538.t1 | | 5.861009 | 2.002652 | −3.8787 | −2.87539 | −2.9432 | 0.045174 |
| 2217 | g341.t1 | 4041 | g8842.t1 | | 5.788696 | 9.05636 | 2.247676 | −2.87854 | 2.941243 | 0.045312 |
| 2218 | g2488.t1 | 4042 | g3515.t1 | K06669: SMC3, CSPG6 | 1.945941 | 7.641363 | 3.740235 | −2.88255 | 2.938761 | 0.045473 |
| 2219 | g713.t1 | 4043 | g9934.t1 | | 5.331222 | 0.664695 | −4.38202 | −2.88525 | −2.93708 | 0.045565 |
| 2220 | g3763.t1 | 4044 | g2673.t1 | | 5.825851 | 3.254634 | −2.56829 | −2.88539 | −2.937 | 0.045565 |
| 2221 | g7424.t1 | 4045 | g7209.t1 | | 5.373092 | 9.386519 | 3.006451 | −2.88618 | 2.93651 | 0.04557 |
| 2222 | g5043.t1 | 4046 | g10906.t1 | K01426: E3.5.1.4, amiE | 2.242898 | 6.456313 | 3.847076 | −2.89168 | 2.933101 | 0.045808 |
| 2223 | g7402.t1 | 4047 | g7184.t1 | | 5.091428 | 2.484421 | −2.06938 | −2.89544 | −2.93077 | 0.045911 |
| 2224 | g6538.t1 | 4048 | g10076.t1 | K12830: SF3B3, SAP130, RSE1 | 0 | 3.092763 | 3.060265 | −2.90278 | 2.926225 | 0.046243 |
| 2225 | g10909.t1 | 4049 | g5917.t1 | | 2.072461 | 4.929452 | 2.681301 | −2.90454 | 2.92513 | 0.046314 |
| 2226 | g10722.t1 | 4050 | g4266.t1 | K12827: SF3A3, SAP61, PRP9 | 3.415338 | 6.31204 | 3.035059 | −2.90712 | 2.923532 | 0.046427 |
| 2227 | g4840.t1 | 4051 | g4450.t1 | | 3.23602 | 0.449458 | −3.90188 | −2.91106 | −2.92109 | 0.046537 |
| 2228 | g1066.t1 | 4052 | g8139.t1 | K01922: PPCS, coaB | 1.857534 | 4.106673 | 3.234378 | −2.91469 | 2.918841 | 0.046689 |
| 2229 | g6576.t1 | 4053 | g10109.t1 | | 3.964575 | 0 | −4.86543 | −2.91615 | −2.91794 | 0.046745 |
| 2230 | g107.t1 | 4054 | g2928.t1 | K03539: RPP1, RPP30 | 3.197967 | 0.803547 | −2.46999 | −2.92305 | −2.91366 | 0.047038 |
| 2231 | g3425.t1 | 4055 | g4720.t1 | K02605: ORC3 | 6.578091 | 4.722727 | −2.20212 | −2.92326 | −2.91353 | 0.047038 |
| 2232 | g1018.t1 | 4056 | g8087.t1 | K04565: SOD1 | 2.947764 | 8.680712 | 5.056988 | −2.92384 | 2.913169 | 0.04705 |
| 2234 | g5391.t1 | 4058 | g2427.t1 | | 3.793826 | 0.942173 | −4.97661 | −2.92597 | −2.91185 | 0.047091 |
| 2233 | g7764.t1 | 4057 | g879.t1 | | 3.456716 | 1.497029 | −2.42385 | −2.92569 | −2.91203 | 0.047091 |
| 506 | g8644.t1 | 2302 | g2276.t1 | K01166: E3.1.27.1 | 0 | 10.03085 | 6.401697 | −2.92547 | 2.91216 | 0.047091 |
| 2236 | g1094.t1 | 4060 | g4037.t1 | K02358: tuf, TUFM | 7.685682 | 5.149397 | −2.8793 | −2.93139 | −2.90849 | 0.047263 |
| 2235 | g712.t1 | 4059 | g9943.t1 | | 2.563775 | 7.171783 | 3.80414 | −2.93127 | 2.908563 | 0.047263 |
| 2237 | g2419.t1 | 4061 | g11542.t1 | | 0.666287 | 3.962309 | 2.387936 | −2.93259 | 2.907749 | 0.047307 |
| 2238 | g2608.t1 | 4062 | g9643.t1 | K00135: gabD | 1.638785 | 4.294982 | 3.144001 | −2.93448 | 2.906575 | 0.047387 |
| 2239 | g8147.t1 | 4063 | g7952.t1 | K11246: SHO1 | 6.066325 | 2.713104 | −3.95602 | −2.93607 | −2.90559 | 0.047433 |
| 2240 | g5705.t1 | 4064 | g10360.t1 | | 0.642825 | 4.418076 | 3.166773 | −2.93679 | 2.905146 | 0.047433 |
| 2241 | g1222.t1 | 4065 | g374.t1 | | 2.642618 | 5.883278 | 3.175464 | −2.93706 | 2.90498 | 0.047433 |
| 2242 | g8664.t1 | 4066 | g3812.t1 | | 7.432168 | 1.550855 | −4.57283 | −2.93851 | −2.90408 | 0.04749 |
| 2243 | g4764.t1 | 4067 | g1994.t1 | | 6.940047 | 1.130412 | −4.17201 | −2.93963 | −2.90338 | 0.047531 |
| 2244 | g6851.t1 | 4068 | g1427.t1 | | 2.284011 | 3.932777 | 2.957195 | −2.94037 | 2.902925 | 0.047551 |
| 2245 | g10946.t1 | 4069 | g5078.t1 | K11236: CDC24 | 4.982918 | 0.83865 | −3.5024 | −2.94195 | −2.90195 | 0.047598 |
| 2246 | g1752.t1 | 4070 | g9722.t1 | | 2.831268 | 5.535026 | 2.675068 | −2.94838 | 2.897963 | 0.047896 |
| 2247 | g566.t1 | 4071 | g3892.t1 | K14708: SLC26A11 | 0.609198 | 5.65481 | 3.423398 | −2.95146 | 2.896054 | 0.048021 |
| 2248 | g3553.t1 | 4072 | g3337.t1 | | 5.206188 | 1.970138 | −6.17884 | −2.95714 | −2.89253 | 0.048268 |
| 2249 | g383.t1 | 4073 | g7452.t1 | K03978: engB | 3.305487 | 5.192025 | 2.780869 | −2.95719 | 2.892499 | 0.048268 |
| 2250 | g7722.t1 | 4074 | g3091.t1 | K03014: RPB6, POLR2F | 0 | 4.540834 | 4.042193 | −2.96294 | 2.888936 | 0.048493 |
| 2251 | g5453.t1 | 4075 | g3167.t1 | | 4.7696 | 0.934559 | −3.55662 | −2.96747 | −2.88612 | 0.048686 |
| 2252 | g9542.t1 | 4076 | g6565.t1 | K01381: E3.4.23.25 | 0 | 3.886173 | 3.681133 | −2.969 | 2.885177 | 0.048749 |
| 2254 | g1347.t1 | 4078 | g3449.t1 | K01273: E3.4.13.19, | 4.946987 | 0.532441 | −3.43411 | −2.972 | −2.88332 | 0.048837 |

TABLE 602-continued

| SEQ ID SYM00577 | SYM577 gene | SEQ ID SYM00300 | SYM300 gene | Description | Median Exp. SYM00577 | Median Exp. SYM00300 | Log FC | B-statistic | t-statistic | Adj. p-value |
|---|---|---|---|---|---|---|---|---|---|---|
| | | | | DPEP1 | | | | | | |
| 2253 | g4317.t1 | 4077 | g1977.t1 | | 2.161002 | 7.174394 | 3.592405 | −2.97197 | 2.883339 | 0.048837 |
| 2255 | g5426.t1 | 4079 | g3123.t1 | K09539: DNAJC19 | 7.936931 | 3.022359 | −5.07555 | −2.97281 | −2.88282 | 0.048862 |
| 2256 | g22408.t1 | 4080 | g9317.t1 | K05351: E1.1.1.9 | 0 | 5.279355 | 4.074546 | −2.97436 | 2.881852 | 0.048927 |
| 2257 | g6391.t1 | 4081 | g5410.t1 | K00480: E1.14.13.1 | 10.39213 | 2.102041 | −5.87521 | −2.97645 | −2.88056 | 0.048977 |
| 2258 | g4848.t1 | 4082 | g4461.t1 | | 5.837897 | 1.338468 | −3.27267 | −2.97698 | −2.88023 | 0.048977 |
| 2259 | g5255.t1 | 4083 | g2333.t1 | | 5.719887 | 4.103219 | −2.31021 | −2.97885 | −2.87907 | 0.049041 |
| 2261 | g10716.t1 | 4085 | g11754.t1 | | 4.124991 | 1.869399 | −2.24701 | −2.98266 | −2.87671 | 0.049173 |
| 2260 | g5384.t1 | 4084 | g9571.t1 | K13099: CD2BP2, PPP1R59 | 0 | 5.725959 | 3.979521 | −2.98264 | 2.876724 | 0.049173 |
| 2262 | g2819.t1 | 4086 | g9111.t1 | K16066: ydfG | 5.823181 | 2.29085 | −5.24434 | −2.98895 | −2.87281 | 0.049421 |
| 2265 | g10820.t1 | 4089 | g5705.t1 | | 1.446801 | 4.641792 | 2.923813 | −2.99351 | 2.869978 | 0.049577 |
| 2263 | g10158.t1 | 4087 | g8462.t1 | | 0 | 2.396169 | 3.866683 | −2.9926 | 2.870543 | 0.049577 |
| 2264 | g844.t1 | 4088 | g9461.t1 | | 0 | 4.027461 | 4.070888 | −2.99313 | 2.870218 | 0.049577 |
| 2267 | g2834.t1 | 4091 | g9028.t1 | | 4.114412 | 0.517908 | −3.11219 | −2.99494 | −2.8691 | 0.0496 |
| 2266 | g10485.t1 | 4090 | g1675.t1 | | 0 | 4.900393 | 4.371976 | −2.99484 | 2.869153 | 0.0496 |
| 2268 | g11904.t1 | 4092 | g11956.t1 | K00681: ggt | 3.288998 | 0.166182 | −3.64625 | −2.99768 | −2.86739 | 0.049713 |
| 2269 | g21731.t1 | 4093 | g6097.t1 | | 2.691539 | 0.619933 | −4.08621 | −3.00053 | −2.86563 | 0.049849 |
| 2270 | g1202.t1 | 4094 | g356.t1 | K14768: UTP7, WDR46 | 1.026847 | 3.791611 | 2.583054 | −3.00301 | 2.864088 | 0.049957 |
| 2271 | g9859.t1 | 4095 | g11476.t1 | | 0 | 4.020067 | 4.04691 | −3.00328 | 2.863921 | 0.049957 |

This table describes orthologous genes of *Acremonium zea* sp. with beneficial and neutral effects on soybean growth, these genes show significant changes in expression between the two genotypes when grown in culture with soybean homogenate. "Median Exp. SYM00577" represents the median expression value in log 2 tpm across biological replicates of the beneficial *Acremonium* grown in media inoculated with soybean seedling homogenate extracted with 50 mM PBS. "Median Exp. SYM00300" represents the median expression value in log 2 tpm across biological replicates of the neutral *Acremonium* grown in media inoculated with soybean seedling homogenate extracted with 50 mM PBS. "Log FC" represents the estimate of the log 2-fold-change of the contrast. "B-statistic" represents the log-odds that the gene is differentially expressed. "t-statistic" represents the moderated t-statistic. "Adj. p-value" represents the false discovery rate (Benjamini & Hochberg, 1995) adjusted p-values.

TABLE 603

| SEQ ID SYM00577 | sym577 gene | SEQ ID SYM00300 | sym300 gene | Description | Median Exp. SYM00577 |
|---|---|---|---|---|---|
| 687 | g13072.t1 | 2494 | g9142.t1 | | 0 |
| 700 | g10575.t1 | 2526 | g10634.t1 | | 0 |
| 674 | g5345.t1 | 2555 | g9530.t1 | K03510: POLI | 5.845894518 |
| 688 | g68.t1 | 2495 | g909.t1 | K00106: XDH | 7.003820996 |
| 701 | g12045.t1 | 2524 | g804.t1 | K12393: AP1M | 6.653853259 |
| 702 | g1230.t1 | 2527 | g388.t1 | | 0 |
| 703 | g2767.t1 | 2559 | g9144.t1 | K02139: ATPeFF, ATP17 | 0 |
| 704 | g7900.t1 | 2560 | g8630.t1 | | 6.140021427 |
| 686 | g857.t1 | 2491 | g9451.t1 | K01950: E6.3.5.1, NADSYN1, QNS1, nadE | 3.802514601 |
| 675 | g5348.t1 | 2554 | g1.t1 | | 0 |
| 705 | g10859.t1 | 2552 | g120.t1 | K17842: carT, CAO-2 | 0 |
| 706 | g8300.t1 | 2561 | g5097.t1 | K15136: SRB5, MED18 | 7.025134642 |
| 707 | g2262.t1 | 2562 | g10678.t1 | K11205: GCLM | 0 |
| 708 | g8448.t1 | 2563 | g2683.t1 | K00966: GMPP | 0 |
| 709 | g10027.t1 | 2564 | g3454.t1 | | 0 |
| 517 | g13099.t1 | 2313 | g8761.t1 | | 0 |
| 710 | g1584.t1 | 2517 | g2859.t1 | | 7.332050712 |
| 690 | g7926.t1 | 2497 | g8597.t1 | | 6.853860482 |
| 711 | g9140.t1 | 2565 | g6474.t1 | K02434: gatB, PET112 | 7.89701243 |
| 558 | g9065.t1 | 2355 | g8585.t1 | K03234: EEF2 | 0 |
| 712 | g3334.t1 | 2566 | g4792.t1 | | 0 |
| 713 | g3376.t1 | 2567 | g10478.t1 | | 0 |
| 714 | g9.t1 | 2568 | g3899.t1 | | 0 |
| 692 | g5169.t1 | 2506 | g3798.t1 | | 4.865818268 |
| 685 | g6380.t1 | 2492 | g764.t1 | K05857: PLCD | 5.073855922 |
| 696 | g3920.t1 | 2508 | g3972.t1 | | 5.062011561 |
| 715 | g10569.t1 | 2569 | g8038.t1 | | 0 |
| 716 | g4884.t1 | 2570 | g5157.t1 | | 3.493672904 |
| 717 | g12587.t1 | 2571 | g2937.t1 | | 5.143110791 |
| 718 | g9196.t1 | 2572 | g6530.t1 | K01937: pyrG, CTPS | 2.877811039 |
| 719 | g5920.t1 | 2573 | g11008.t1 | K02894: RP-L23e, RPL23 | 2.351855506 |
| 720 | g5591.t1 | 2547 | g7515.t1 | | 5.584485038 |
| 721 | g7216.t1 | 2574 | g5885.t1 | | 4.657263756 |
| 722 | g4371.t1 | 2575 | g2128.t1 | | 5.510282495 |
| 698 | g657.t1 | 2503 | g9863.t1 | | 4.4628192 |
| 723 | g5419.t1 | 2576 | g5084.t1 | | 8.315874976 |
| 724 | g5712.t1 | 2577 | g1012.t1 | | 5.583909958 |
| 725 | g5938.t1 | 2578 | g8896.t1 | | 0 |
| 726 | g2504.t1 | 2579 | g3532.t1 | | 0 |
| 727 | g7969.t1 | 2580 | g10252.t1 | K03639: MOCS1, moaA | 4.758242645 |
| 728 | g1770.t1 | 2581 | g1188.t1 | | 6.058400928 |
| 729 | g815.t1 | 2582 | g8179.t1 | | 7.400064361 |
| 730 | g3624.t1 | 2583 | g600.t1 | K14297: NUP98, ADAR2 | 5.106519345 |
| 731 | g3218.t1 | 2584 | g6107.t1 | | 4.600691335 |
| 732 | g6563.t1 | 2585 | g10099.t1 | | 7.052996504 |
| 733 | g5058.t1 | 2586 | g8328.t1 | | 6.170884433 |
| 734 | g2063.t1 | 2587 | g2535.t1 | K01426: E3.5.1.4, amiE | 6.62697264 |
| 735 | g7620.t1 | 2588 | g9046.t1 | | 1.469790922 |
| 737 | g8108.t1 | 2590 | g7917.t1 | | 5.22299962 |
| 736 | g13149.t1 | 2589 | g4276.t1 | | 0 |
| 738 | g15293.t1 | 2591 | g6106.t1 | | 2.346160706 |
| 739 | g10986.t1 | 2592 | g5652.t1 | K02141: ATPeFH, ATP14 | 0 |
| 740 | g2758.t1 | 2593 | g9152.t1 | K10627: RAD18 | 0 |
| 741 | g4882.t1 | 2594 | g4502.t1 | | 6.687936705 |
| 742 | g1999.t1 | 2595 | g6250.t1 | | 0 |
| 743 | g3555.t1 | 2596 | g3333.t1 | K01624: FBA, fbaA | 4.536933474 |
| 744 | g4741.t1 | 2597 | g2013.t1 | K03237: EIF2S1 | 6.043892772 |
| 745 | g5254.t1 | 2598 | g2334.t1 | K02137: ATPeF0O, ATP5O, ATP5 | 5.144250658 |
| 746 | g5568.t1 | 2529 | g7485.t1 | | 2.950253937 |
| 747 | g19199.t1 | 2599 | g12080.t1 | K01102: PDP | 4.719048671 |
| 748 | g4710.t1 | 2600 | g6681.t1 | K03457: TC.NCS1 | 5.545619928 |
| 749 | g1003.t1 | 2601 | g8072.t1 | K03626: EGD2, NACA | 9.544725129 |
| 750 | g12699.t1 | 2602 | g8909.t1 | | 0 |

TABLE 603-continued

| | | | | | |
|---|---|---|---|---|---|
| 751 | g3631.t1 | 2603 | g607.t1 | | 5.634764008 |
| 752 | g10888.t1 | 2604 | g176.t1 | K00463: INDO | 0 |
| 697 | g852.t1 | 2502 | g9454.t1 | K11824: AP2A | 5.513795279 |
| 753 | g10211.t1 | 2605 | g11976.t1 | | 6.236601553 |
| 754 | g158.t1 | 2606 | g5219.t1 | | 0 |
| 755 | g6128.t1 | 2607 | g7318.t1 | K13953: adhP | 0.559800663 |
| 691 | g5563.t1 | 2493 | g7478.t1 | | 4.371792513 |
| 756 | g5223.t1 | 2608 | g3707.t1 | K03515: REV1 | 7.079279048 |
| 680 | g1340.t1 | 2553 | g523.t1 | | 5.657989905 |
| 757 | g6031.t1 | 2609 | g11529.t1 | K01885: EARS, gltX | 8.997952533 |
| 758 | g5074.t1 | 2610 | g2984.t1 | | 0 |
| 759 | g6741.t1 | 2611 | g4354.t1 | | 2.11282087 |
| 760 | g829.t1 | 2612 | g8197.t1 | K13577: SLC25A10, DIC | 0 |
| 761 | g7264.t1 | 2613 | g11828.t1 | | 5.499599524 |
| 762 | g2074.t1 | 2614 | g2522.t1 | | 4.591860791 |
| 763 | g9395.t1 | 2615 | g3638.t1 | K06116: GPP1 | 2.323291749 |
| 764 | g9849.t1 | 2616 | g9778.t1 | | 9.223686565 |
| 765 | g11803.t1 | 2617 | g12043.t1 | | 2.387616958 |
| 766 | g11916.t1 | 2618 | g661.t1 | | 7.715759124 |
| 767 | g1153.t1 | 2619 | g5028.t1 | | 4.692839925 |
| 768 | g5373.t1 | 2620 | g9561.t1 | | 5.888238765 |
| 769 | g7390.t1 | 2621 | g7172.t1 | | 7.350351967 |
| 770 | g10732.t1 | 2622 | g4256.t1 | | 0 |
| 771 | g10093.t1 | 2623 | g9511.t1 | | 4.296964996 |
| 772 | g10839.t1 | 2624 | g9837.t1 | | 6.8729034 |
| 773 | g10191.t1 | 2625 | g11148.t1 | | 6.023102414 |
| 774 | g3013.t1 | 2626 | g8294.t1 | | 5.470261921 |
| 775 | g7841.t1 | 2627 | g10495.t1 | | 4.614472875 |
| 776 | g21528.t1 | 2512 | g10587.t1 | K01885: EARS, gltX | 3.911232108 |
| 777 | g9138.t1 | 2628 | g6473.t1 | | 4.198675014 |
| 778 | g4873.t1 | 2629 | g4492.t1 | | 5.713341579 |
| 779 | g7446.t1 | 2630 | g6892.t1 | | 7.48417852 |
| 780 | g8021.t1 | 2631 | g8248.t1 | | 4.309793696 |
| 781 | g100.t1 | 2632 | g2920.t1 | | 0 |
| 782 | g1180.t1 | 2633 | g337.t1 | | 6.10473465 |
| 783 | g14694.t1 | 2634 | g6409.t1 | | 9.825681474 |
| 784 | g6706.t1 | 2521 | g4310.t1 | | 7.446014886 |
| 785 | g14790.t1 | 2635 | g5147.t1 | | 1.686007548 |
| 786 | g8676.t1 | 2636 | g10948.t1 | | 3.991647742 |
| 787 | g4402.t1 | 2637 | g2161.t1 | | 0 |
| 788 | g1963.t1 | 2638 | g6215.t1 | | 6.923009485 |
| 789 | g132.t1 | 2639 | g5829.t1 | | 0 |
| 790 | g11512.t1 | 2640 | g4219.t1 | | 6.309781587 |
| 791 | g10280.t1 | 2641 | g10638.t1 | | 0 |
| 792 | g796.t1 | 2642 | g8160.t1 | | 0.721237136 |
| 793 | g15000.t1 | 2643 | g3110.t1 | K09658: DPM2 | 5.469156461 |
| 794 | g7638.t1 | 2644 | g7605.t1 | | 0 |
| 795 | g11518.t1 | 2645 | g4213.t1 | | 5.935642711 |
| 796 | g85.t1 | 2646 | g2767.t1 | | 5.850559685 |
| 797 | g489.t1 | 2647 | g5491.t1 | K05857: PLCD | 5.789925493 |
| 798 | g8243.t1 | 2648 | g10036.t1 | | 4.646855045 |
| 800 | g4842.t1 | 2650 | g4453.t1 | K13120: FAM32A | 5.230120767 |
| 799 | g10374.t1 | 2649 | g10541.t1 | K15505: RAD5 | 0 |
| 801 | g10174.t1 | 2651 | g8450.t1 | K11557: SPC24 | 1.118361424 |
| 803 | g3427.t1 | 2653 | g4718.t1 | K12854: SNRNP200, BRR2 | 7.533706795 |
| 802 | g1849.t1 | 2652 | g1896.t1 | K00938: E2.7.4.2, mvaK2 | 8.103944385 |
| 804 | g19694.t1 | 2654 | g7947.t1 | K02142: ATPeFJ, ATP18 | 4.724478914 |
| 805 | g6500.t1 | 2655 | g2087.t1 | K11548: NUF2, CDCA1 | 4.167333488 |
| 808 | g11718.t1 | 2657 | g2320.t1 | | 6.955332876 |
| 807 | g2706.t1 | 2513 | g8366.t1 | K11649: SMARCC | 5.407509356 |
| 806 | g3663.t1 | 2656 | g656.t1 | K00632: E2.3.1.16, fadA | 6.107648999 |
| 809 | g4795.t1 | 2658 | g3691.t1 | | 2.814605061 |
| 810 | g9159.t1 | 2659 | g6490.t1 | | 12.37001214 |
| 812 | g7897.t1 | 2661 | g8633.t1 | K12191: CHMP2A | 6.149239272 |
| 811 | g4381.t1 | 2660 | g2138.t1 | K14846: RPF1 | 4.661983349 |
| 813 | g15305.t1 | 2662 | g10450.t1 | K01915: glnA, GLUL | 1.326818728 |
| 814 | g12732.t1 | 2663 | g5706.t1 | | 0 |
| 815 | g9791.t1 | 2664 | g893.t1 | | 4.682251788 |
| 816 | g14760.t1 | 2665 | g9241.t1 | | 2.816496891 |
| 817 | g5187.t1 | 2666 | g3776.t1 | K01277: E3.4.14.4, DPP3 | 5.729836476 |
| 818 | g7634.t1 | 2667 | g7610.t1 | K10773: NTH | 6.081778745 |
| 819 | g13477.t1 | 2668 | g8720.t1 | K10295: FBXO9 | 5.178686522 |
| 820 | g12592.t1 | 2669 | g2931.t1 | | 6.934534554 |
| 821 | g10987.t1 | 2670 | g5653.t1 | | 0 |
| 822 | g12590.t1 | 2671 | g2934.t1 | | 6.223414116 |
| 823 | g10222.t1 | 2672 | g11207.t1 | | 4.643453596 |
| 825 | g3983.t1 | 2674 | g7058.t1 | K01613: psd, PISD | 5.451665752 |
| 824 | g11510.t1 | 2673 | g4221.t1 | | 4.286646074 |

TABLE 603-continued

| | | | | | |
|---|---|---|---|---|---|
| 826 | g9393.t1 | 2675 | g3641.t1 | | 8.751164208 |
| 827 | g9881.t1 | 2676 | g11623.t1 | | 0 |
| 828 | g13221.t1 | 2677 | g672.t1 | | 0 |
| 829 | g3561.t1 | 2678 | g3326.t1 | | 4.733400818 |
| 830 | g8670.t1 | 2679 | g10955.t1 | | 4.749528223 |
| 831 | g708.t1 | 2680 | g9946.t1 | | 0.954625619 |
| 832 | g11009.t1 | 2681 | g5663.t1 | K11121: SIR2 | 0 |
| 833 | g7419.t1 | 2682 | g7204.t1 | K13754: SLC24A6, NCKX6 | 6.27610662 |
| 835 | g3224.t1 | 2684 | g6091.t1 | | 3.344134063 |
| 834 | g12947.t1 | 2683 | g9800.t1 | | 0 |
| 836 | g6094.t1 | 2685 | g7354.t1 | | 6.09853587 |
| 837 | g7427.t1 | 2686 | g7212.t1 | K01549: TIM11, ATP21 | 5.301910749 |
| 838 | g6135.t1 | 2687 | g7308.t1 | K03844: ALG11 | 4.695297001 |
| 839 | g5057.t1 | 2688 | g8325.t1 | K00326: E1.6.2.2 | 5.161405198 |
| 840 | g3875.t1 | 2689 | g4019.t1 | | 1.368553327 |
| 841 | g21658.t1 | 2690 | g4834.t1 | | 6.709472946 |
| 842 | g7438.t1 | 2691 | g7223.t1 | | 4.971359373 |
| 843 | g7605.t1 | 2692 | g7631.t1 | K06942: K06942 | 4.937065903 |
| 844 | g6721.t1 | 2693 | g4326.t1 | | 1.642040135 |
| 845 | g7857.t1 | 2694 | g10514.t1 | | 0 |
| 846 | g3614.t1 | 2695 | g588.t1 | K12604: CNOT1, NOT1 | 6.72026689 |
| 847 | g11968.t1 | 2696 | g7463.t1 | | 0 |
| 848 | g6429.t1 | 2697 | g5353.t1 | | 5.059361503 |
| 849 | g20508.t1 | 2698 | g3950.t1 | | 0 |
| 850 | g7165.t1 | 2699 | g555.t1 | | 3.895318144 |
| 851 | g4535.t1 | 2700 | g4065.t1 | | 8.36766264 |
| 852 | g20378.t1 | 2701 | g3507.t1 | | 0 |
| 853 | g8160.t1 | 2702 | g11151.t1 | | 7.072684453 |
| 854 | g6555.t1 | 2703 | g10091.t1 | K00286: E1.5.1.2, proC | 5.981191238 |
| 855 | g5572.t1 | 2704 | g7489.t1 | | 6.099888984 |
| 856 | g2329.t1 | 2543 | g9194.t1 | | 7.114801788 |
| 857 | g1250.t1 | 2705 | g434.t1 | | 5.533904052 |
| 858 | g11133.t1 | 2706 | g753.t1 | K06972: K06972 | 4.000597283 |
| 859 | g490.t1 | 2536 | g5492.t1 | K01230: MAN1 | 4.455711732 |
| 860 | g7575.t1 | 2707 | g7666.t1 | K11272: MRC1 | 7.443866007 |
| 861 | g6402.t1 | 2708 | g5392.t1 | | 0 |
| 519 | g31.t1 | 2315 | g2840.t1 | K02437: gcvH, GCSH | 7.667805418 |
| 862 | g11374.t1 | 2709 | g5061.t1 | K16803: CKAP5, XMAP215 | 0 |
| 863 | g6116.t1 | 2710 | g7333.t1 | K02258: COX11 | 0 |
| 864 | g7600.t1 | 2711 | g7636.t1 | K17768: TOM70 | 5.478745927 |
| 865 | g7609.t1 | 2712 | g7627.t1 | | 6.110778129 |
| 866 | g670.t1 | 2713 | g9895.t1 | | 5.389860972 |
| 867 | g3288.t1 | 2714 | g8848.t1 | | 0 |
| 868 | g1739.t1 | 2715 | g9739.t1 | K01918: panC | 1.723333708 |
| 869 | g2853.t1 | 2716 | g9055.t1 | | 3.661150117 |
| 870 | g11104.t1 | 2717 | g718.t1 | | 5.331556226 |
| 871 | g2178.t1 | 2718 | g11917.t1 | | 4.412098474 |
| 872 | g4449.t1 | 2719 | g6805.t1 | | 7.334855344 |
| 873 | g5221.t1 | 2720 | g3709.t1 | K01240: URH1 | 4.395333747 |
| 874 | g2815.t1 | 2721 | g9114.t1 | K01193: E3.2.1.26, sacA | 6.290191463 |
| 875 | g2269.t1 | 2722 | g10685.t1 | | 2.551428828 |
| 876 | g2163.t1 | 2723 | g11902.t1 | | 5.298538589 |
| 877 | g3515.t1 | 2724 | g2207.t1 | | 3.347586286 |
| 878 | g6074.t1 | 2725 | g3347.t1 | | 6.324042809 |
| 879 | g11929.t1 | 2726 | g2071.t1 | | 6.098181798 |
| 880 | g6915.t1 | 2727 | g1291.t1 | K00505: TYR | 6.540932521 |
| 881 | g1756.t1 | 2728 | g1207.t1 | K15201: GTP3C3, TFC4 | 6.731005978 |
| 882 | g6770.t1 | 2729 | g4386.t1 | | 5.731686881 |
| 883 | g10376.t1 | 2730 | g10544.t1 | K02990: RP-S6, MRPS6, rpsF | 0 |
| 884 | g9812.t1 | 2731 | g10826.t1 | K01899: LSC1 | 5.913334166 |
| 885 | g9618.t1 | 2732 | g7244.t1 | | 0 |
| 886 | g2442.t1 | 2733 | g6711.t1 | K10998: CSM3, SWI3 | 6.56163386 |
| 887 | g17691.t1 | 2734 | g559.t1 | | 5.586773168 |
| 889 | g10183.t1 | 2736 | g11138.t1 | K17878: NNT1 | 4.422235435 |
| 888 | g7714.t1 | 2735 | g3081.t1 | K01070: frmB, ESD, fghA | 4.789610997 |
| 890 | g2359.t1 | 2737 | g9253.t1 | | 8.893941672 |
| 891 | g4991.t1 | 2738 | g8961.t1 | K15901: CGI121, TPRKB | 5.458778357 |
| 892 | g106.t1 | 2739 | g2927.t1 | | 4.560793659 |
| 893 | g7472.t1 | 2740 | g6864.t1 | K10839: RAD23, HR23 | 6.506527453 |
| 894 | g4849.t1 | 2741 | g4462.t1 | | 6.018049911 |
| 895 | g4668.t1 | 2742 | g10566.t1 | K01312: PRSS | 9.271875621 |
| 896 | g9585.t1 | 2743 | g6636.t1 | K06675: SMC4 | 0 |
| 897 | g2963.t1 | 2744 | g5934.t1 | | 4.375328682 |
| 898 | g7232.t1 | 2745 | g10757.t1 | K09313: CUTL | 8.116353121 |
| 899 | g19769.t1 | 2746 | g11692.t1 | | 4.972241584 |
| 900 | g7022.t1 | 2747 | g6357.t1 | | 0 |
| 901 | g9259.t1 | 2748 | g10437.t1 | | 6.69953931 |

TABLE 603-continued

| | | | | | |
|---|---|---|---|---|---|
| 902 | g12328.t1 | 2749 | g7434.t1 | K01710: E4.2.1.46, rfbB, rffG | 3.685729613 |
| 903 | g2849.t1 | 2750 | g9051.t1 | | 7.214498977 |
| 904 | g17779.t1 | 2751 | g662.t1 | | 4.282054458 |
| 905 | g8550.t1 | 2752 | g5428.t1 | K08838: STK24__25__MST4 | 5.000505255 |
| 906 | g10940.t1 | 2753 | g1025.t1 | K00100: E1.1.1.— | 4.956194307 |
| 907 | g11117.t1 | 2754 | g735.t1 | | 5.648961974 |
| 562 | g1904.t1 | 2359 | g5010.t1 | K16261: YAT | 2.226821689 |
| 908 | g3804.t1 | 2755 | g8748.t1 | | 5.793251762 |
| 909 | g3244.t1 | 2756 | g8218.t1 | K02838: frr, MRRF, RRF | 0 |
| 910 | g11369.t1 | 2757 | g10756.t1 | | 5.176727673 |
| 611 | g7102.t1 | 2410 | g5569.t1 | | 4.138124976 |
| 911 | g677.t1 | 2758 | g9875.t1 | K07140: K07140 | 5.281680888 |
| 679 | g4287.t1 | 2759 | g1939.t1 | K00275: pdxH, PNPO | 4.95193285 |
| 912 | g7511.t1 | 2760 | g10316.t1 | K08286: E2.7.11.— | 6.009945831 |
| 913 | g1830.t1 | 2761 | g1716.t1 | | 7.072977042 |
| 914 | g6552.t1 | 2762 | g10088.t1 | K14572: MDN1, REA1 | 4.349948417 |
| 915 | g74.t1 | 2763 | g917.t1 | K00480: E1.14.13.1 | 5.955742918 |
| 916 | g5429.t1 | 2764 | g3125.t1 | | 4.987582363 |
| 917 | g8498.t1 | 2765 | g3370.t1 | | 5.820660636 |
| 918 | g7844.t1 | 2766 | g10497.t1 | | 5.848243945 |
| 919 | g5407.t1 | 2767 | g8613.t1 | | 0 |
| 921 | g4889.t1 | 2769 | g4523.t1 | K14209: SLC36A, PAT | 5.82364098 |
| 920 | g2118.t1 | 2768 | g2464.t1 | K01560: E3.8.1.2 | 3.940755827 |
| 922 | g4577.t1 | 2770 | g4105.t1 | | 2.560658097 |
| 923 | g6091.t1 | 2771 | g7357.t1 | K12193: VPS24, CHMP3 | 2.859023838 |
| 924 | g4043.t1 | 2772 | g3220.t1 | | 5.096464748 |
| 925 | g10590.t1 | 2773 | g7033.t1 | K01190: lacZ | 0 |
| 926 | g11987.t1 | 2774 | g2441.t1 | K15172: SUPT5H, SPT5 | 6.055881291 |
| 927 | g7118.t1 | 2775 | g5583.t1 | K06670: SCC1, MCD1, RAD21 | 7.656991383 |
| 928 | g9841.t1 | 2776 | g9760.t1 | | 8.545788709 |
| 929 | g10869.t1 | 2777 | g134.t1 | | 0 |
| 930 | g8799.t1 | 2778 | g9975.t1 | | 4.851135285 |
| 931 | g3513.t1 | 2779 | g2205.t1 | K12041: SLC9A6__7, NHE6__7 | 4.628300692 |
| 932 | g4464.t1 | 2780 | g6823.t1 | K00111: glpA, gtpD | 4.913318358 |
| 933 | g912.t1 | 2781 | g9350.t1 | | 6.681560463 |
| 934 | g6047.t1 | 2482 | g264.t1 | | 5.833182512 |
| 935 | g8273.t1 | 2782 | g9995.t1 | | 5.609052156 |
| 936 | g8132.t1 | 2783 | g7944.t1 | K14526: POP7, RPP2 | 5.431104442 |
| 937 | g8077.t1 | 2540 | g7846.t1 | | 6.924579829 |
| 938 | g10164.t1 | 2784 | g6116.t1 | | 6.523454108 |
| 940 | g8187.t1 | 2785 | g7995.t1 | K03325: TC.ACR3 | 8.04995065 |
| 939 | g4598.t1 | 2528 | g6014.t1 | | 3.985835911 |
| 941 | g10685.t1 | 2786 | g8531.t1 | | 4.755054229 |
| 942 | g4368.t1 | 2787 | g3790.t1 | | 5.47962036 |
| 944 | g5574.t1 | 2789 | g7491.t1 | K11370: AHC1 | 7.953609684 |
| 943 | g10154.t1 | 2788 | g8466.t1 | K03661: ATPeV0B, ATP6F | 2.459230154 |
| 945 | g6618.t1 | 2790 | g11273.t1 | K14333: DHBD | 8.223627165 |
| 946 | g4717.t1 | 2791 | g2039.t1 | | 6.556761484 |
| 947 | g3409.t1 | 2792 | g6220.t1 | | 6.131735085 |
| 948 | g11995.t1 | 2793 | g2451.t1 | | 4.464464914 |
| 949 | g2327.t1 | 2794 | g9192.t1 | | 4.697725891 |
| 950 | g4993.t1 | 2795 | g8964.t1 | | 5.277688941 |
| 951 | g9979.t1 | 2796 | g9685.t1 | K15148: MED7 | 0 |
| 952 | g6193.t1 | 2797 | g11718.t1 | | 6.836216759 |
| 953 | g4069.t1 | 2798 | g3263.t1 | | 4.437917777 |
| 954 | g10250.t1 | 2799 | g3606.t1 | | 12.0823581 |
| 955 | g5983.t1 | 2800 | g11682.t1 | | 5.452835216 |
| 957 | g11115.t1 | 2802 | g733.t1 | | 6.202864972 |
| 956 | g3228.t1 | 2801 | g6074.t1 | | 4.204057944 |
| 958 | g9407.t1 | 2803 | g3620.t1 | | 4.931825845 |
| 959 | g1828.t1 | 2804 | g1714.t1 | K13535: CLD1 | 4.463119082 |
| 960 | g3944.t1 | 2805 | g3947.t1 | | 5.535649157 |
| 961 | g7851.t1 | 2806 | g10505.t1 | | 5.044625434 |
| 962 | g18788.t1 | 2807 | g387.t1 | | 6.532520126 |
| 963 | g9384.t1 | 2808 | g3650.t1 | K02210: MCM7, CDC47 | 6.91078027 |
| 964 | g1127.t1 | 2809 | g226.t1 | K13210: FUBP | 7.124489061 |
| 965 | g96.t1 | 2810 | g2917.t1 | | 0 |
| 966 | g6648.t1 | 2811 | g10192.t1 | K12868: SYF2 | 0 |
| 967 | g1350.t1 | 2812 | g7381.t1 | | 0 |
| 968 | g13893.t1 | 2813 | g6198.t1 | K07034: K07034 | 6.848687422 |
| 969 | g4507.t1 | 2814 | g10812.t1 | | 3.840346233 |
| 970 | g3241.t1 | 2815 | g8215.t1 | | 0 |
| 971 | g11754.t1 | 2816 | g9856.t1 | K01779: E5.1.1.13 | 5.221579117 |
| 972 | g1351.t1 | 2817 | g6327.t1 | | 0 |
| 973 | g2037.t1 | 2818 | g2568.t1 | K12659: ARG56 | 0 |
| 974 | g1683.t1 | 2819 | g4660.t1 | K10625: UBR1 | 3.398274676 |
| 975 | g12749.t1 | 2820 | g12137.t1 | | 0 |

TABLE 603-continued

| | | | | | |
|---|---|---|---|---|---|
| 976 | g9482.t1 | 2821 | g5768.t1 | | 6.71765746 |
| 977 | g11380.t1 | 2822 | g5068.t1 | | 0 |
| 978 | g6127.t1 | 2823 | g7319.t1 | K07213: ATOX1, ATX1, copZ | 11.50816411 |
| 979 | g270.t1 | 2824 | g7700.t1 | | 6.248619031 |
| 980 | g6423.t1 | 2825 | g5361.t1 | | 3.403273853 |
| 981 | g10729.t1 | 2826 | g2908.t1 | K03448: FEN2, LIZ1 | 0 |
| 982 | g3774.t1 | 2827 | g6851.t1 | | 0 |
| 983 | g8680.t1 | 2828 | g10944.t1 | K13621: BTA1 | 0 |
| 985 | g11533.t1 | 2830 | g4194.t1 | K00928: lysC | 8.670529213 |
| 984 | g2060.t1 | 2829 | g2537.t1 | | 4.647437267 |
| 987 | g6588.t1 | 2832 | g10117.t1 | | 5.93851127 |
| 986 | g9187.t1 | 2831 | g6519.t1 | | 0.369867578 |
| 988 | g2854.t1 | 2833 | g4992.t1 | | 3.667696129 |
| 989 | g173.t1 | 2834 | g5800.t1 | K07119: K07119 | 9.370340141 |
| 545 | g10561.t1 | 2342 | g1546.t1 | | 0 |
| 990 | g5941.t1 | 2835 | g2881.t1 | | 0 |
| 991 | g2978.t1 | 2836 | g8309.t1 | | 0 |
| 992 | g1958.t1 | 2837 | g6209.t1 | | 9.099456694 |
| 993 | g12003.t1 | 2838 | g10167.t1 | | 4.021343839 |
| 994 | g18673.t1 | 2839 | g8118.t1 | | 1.798228538 |
| 996 | g11700.t1 | 2841 | g6614.t1 | K03860: PIGQ, GPI1 | 4.969629765 |
| 997 | g5957.t1 | 2842 | g6229.t1 | K01056: PTH1, pth, spoVC | 0 |
| 995 | g21700.t1 | 2840 | g5543.t1 | | 3.167921414 |
| 998 | g8304.t1 | 2843 | g5092.t1 | K10253: K10253 | 4.621044993 |
| 1000 | g697.t1 | 2845 | g9928.t1 | K03941: NDUFS8 | 5.799554424 |
| 999 | g10287.t1 | 2844 | g36.t1 | K15444: TRM9 | 0 |
| 1001 | g2303.t1 | 2846 | g10723.t1 | K07441: ALG14 | 5.074009843 |
| 1002 | g6384.t1 | 2847 | g759.t1 | | 6.12726441 |
| 1003 | g7586.t1 | 2848 | g7651.t1 | | 5.043611275 |
| 1004 | g8534.t1 | 2849 | g6285.t1 | | 0 |
| 1005 | g5408.t1 | 2850 | g8612.t1 | K00276: AOC3, AOC2, tynA | 0 |
| 1006 | g8194.t1 | 2851 | g8514.t1 | | 6.303747883 |
| 1007 | g13118.t1 | 2852 | g7773.t1 | | 0 |
| 1008 | g9153.t1 | 2853 | g6485.t1 | K18716: NUP42, RIP1 | 6.170706947 |
| 1009 | g6545.t1 | 2854 | g10082.t1 | K03885: ndh | 0 |
| 1010 | g7749.t1 | 2855 | g7099.t1 | K01512: acyP | 1.405819898 |
| 1011 | g19631.t1 | 2856 | g6634.t1 | | 2.571565788 |
| 1012 | g522.t1 | 2857 | g889.t1 | | 10.81615793 |
| 1013 | g3484.t1 | 2858 | g2151.t1 | | 0 |
| 1014 | g12598.t1 | 2859 | g12.t1 | | 5.489807798 |
| 1016 | g2711.t1 | 2861 | g8361.t1 | K07195: EXOC7, EXO70 | 4.061048103 |
| 1015 | g579.t1 | 2860 | g3880.t1 | K14826: FPR3_4 | 4.281193383 |
| 1017 | g5304.t1 | 2862 | g2266.t1 | | 1.064282379 |
| 1018 | g15818.t1 | 2863 | g5620.t1 | | 5.095758915 |
| 1019 | g11541.t1 | 2864 | g4185.t1 | K15710: SHPRH | 9.337717858 |
| 1020 | g5073.t1 | 2865 | g8342.t1 | K08008: NOX, GP91 | 0 |
| 1022 | g6955.t1 | 2867 | g6434.t1 | K14860: TMA16 | 5.89989351 |
| 1021 | g6610.t1 | 2866 | g10146.t1 | | 9.37786699 |
| 1023 | g11689.t1 | 2868 | g10851.t1 | K10405: KIFC1 | 3.582191481 |
| 1024 | g4428.t1 | 2869 | g6761.t1 | | 7.515504705 |
| 1025 | g3928.t1 | 2870 | g3964.t1 | | 7.606070252 |
| 1028 | g4373.t1 | 2873 | g2130.t1 | K13501: TRP1 | 5.255678294 |
| 1027 | g10552.t1 | 2872 | g6698.t1 | | 0 |
| 1026 | g4264.t1 | 2871 | g1718.t1 | | 0 |
| 1029 | g7551.t1 | 2874 | g7255.t1 | K14640: SLC20A, PIT | 2.536552173 |
| 1030 | g73.t1 | 2875 | g914.t1 | | 4.346084349 |
| 1031 | g10225.t1 | 2876 | g11203.t1 | | 9.413047495 |
| 1032 | g5522.t1 | 2877 | g1649.t1 | K11699: RDR, RDRP | 5.864561275 |
| 1033 | g7042.t1 | 2878 | g6333.t1 | | 4.730082423 |
| 1034 | g4256.t1 | 2879 | g1726.t1 | K11254: H4 | 5.392555643 |
| 1036 | g1108.t1 | 2881 | g4055.t1 | K11131: DKC1, NOLA4, CBF5 | 4.027072029 |
| 1035 | g8681.t1 | 2880 | g10943.t1 | K00237: SDHD, SDH4 | 0 |
| 1037 | g11120.t1 | 2520 | g739.t1 | K11309: RTT109, KAT11 | 5.304552729 |
| 1038 | g10725.t1 | 2882 | g4263.t1 | K01495: GCH1, folE | 7.095909192 |
| 1039 | g9660.t1 | 2883 | g4874.t1 | | 0.457027413 |
| 1040 | g8820.t1 | 2884 | g3030.t1 | | 5.372767428 |
| 1041 | g4065.t1 | 2885 | g3253.t1 | K03362: FBXW1_11, BTRC, beta-TRCP | 3.768457818 |
| 1042 | g5448.t1 | 2886 | g3163.t1 | | 5.226224828 |
| 1043 | g7588.t1 | 2887 | g7649.t1 | | 6.811316171 |
| 1044 | g3582.t1 | 2888 | g5074.t1 | K00293: LYS9 | 3.263233452 |
| 1045 | g6422.t1 | 2889 | g5364.t1 | | 2.147147382 |
| 483 | g10693.t1 | 2485 | g8538.t1 | | 5.662368091 |
| 1046 | g6032.t1 | 2890 | g11214.t1 | | 8.820793561 |
| 1047 | g6561.t1 | 2891 | g10097.t1 | | 5.654687421 |
| 1048 | g2191.t1 | 2892 | g11582.t1 | K03352: APCS | 4.67408688 |

TABLE 603-continued

| | | | | | |
|---|---|---|---|---|---|
| 1049 | g8669.t1 | 2893 | g10956.t1 | | 4.818547725 |
| 1050 | g5585.t1 | 2894 | g7506.t1 | K14300: NUP133 | 5.450216932 |
| 1051 | g6577.t1 | 2895 | g2327.t1 | | 8.791267353 |
| 1052 | g4912.t1 | 2896 | g4547.t1 | | 0 |
| 1053 | g5600.t1 | 2897 | g7522.t1 | K17787: AIMS | 0 |
| 1054 | g59.t1 | 2898 | g2750.t1 | K09529: DNAJC9 | 0 |
| 1055 | g2459.t1 | 2899 | g6731.t1 | | 2.631378842 |
| 1056 | g3841.t1 | 2900 | g2574.t1 | | 5.178143897 |
| 1058 | g10928.t1 | 2902 | g11230.t1 | K09291: TPR | 2.438636081 |
| 1057 | g4517.t1 | 2901 | g10822.t1 | | 0 |
| 1059 | g5642.t1 | 2903 | g9240.t1 | | 10.22312916 |
| 1060 | g5649.t1 | 2904 | g1103.t1 | | 4.544636216 |
| 1061 | g11163.t1 | 2905 | g4845.t1 | K00838: ARO8 | 0.832183706 |
| 1062 | g5464.t1 | 2906 | g8437.t1 | K01487: E3.5.4.3, guaD | 4.270772945 |
| 1063 | g6448.t1 | 2907 | g5337.t1 | | 0.704996832 |
| 1064 | g546.t1 | 2908 | g5611.t1 | | 5.264731099 |
| 1065 | g970.t1 | 2909 | g8041.t1 | | 5.740601251 |
| 1066 | g196.t1 | 2910 | g5304.t1 | | 4.777372465 |
| 1067 | g1283.t1 | 2911 | g473.t1 | | 0 |
| 1068 | g12044.t1 | 2912 | g803.t1 | | 5.498118982 |
| 1069 | g9074.t1 | 2913 | g8565.t1 | | 0 |
| 1070 | g10056.t1 | 2914 | g2782.t1 | K05351: E1.1.1.9 | 7.25059785 |
| 1071 | g12237.t1 | 2915 | g11133.t1 | K17878: NNT1 | 4.149357354 |
| 1072 | g4465.t1 | 2916 | g6824.t1 | | 5.086524971 |
| 1073 | g1040.t1 | 2917 | g8111.t1 | | 0 |
| 1074 | g8432.t1 | 2918 | g2491.t1 | | 0 |
| 1075 | g9956.t1 | 2919 | g11404.t1 | | 0 |
| 1077 | g4593.t1 | 2921 | g6010.t1 | | 6.800127858 |
| 1076 | g449.t1 | 2920 | g8027.t1 | | 2.548177204 |
| 1078 | g15695.t1 | 2922 | g10590.t1 | | 0 |
| 1079 | g7238.t1 | 2923 | g10763.t1 | | 6.636516842 |
| 1080 | g2270.t1 | 2924 | g10687.t1 | K01551: arsA, ASNA1 | 1.338776738 |
| 1081 | g7667.t1 | 2925 | g7562.t1 | K01469: OPLAH, OXP1, OplAH | 4.982517875 |
| 1082 | g5077.t1 | 2926 | g4465.t1 | K01193: E3.2.1.26, sacA | 0 |
| 1083 | g6226.t1 | 2927 | g7123.t1 | K12609: CAF120 | 5.821481969 |
| 1084 | g5075.t1 | 2928 | g2985.t1 | | 0 |
| 1085 | g13910.t1 | 2929 | g8741.t1 | | 3.759982388 |
| 1086 | g8085.t1 | 2930 | g7863.t1 | | 7.812628972 |
| 1087 | g10423.t1 | 2931 | g8402.t1 | K14327: UPF2, RENT2 | 5.380749971 |
| 1088 | g11332.t1 | 2932 | g11641.t1 | | 4.160151798 |
| 1089 | g7007.t1 | 2933 | g6374.t1 | K12600: SKI3, TTC37 | 0 |
| 1090 | g2160.t1 | 2934 | g11899.t1 | | 2.646205187 |
| 1091 | g3470.t1 | 2935 | g2763.t1 | K00140: mmsA, iolA, ALDH6A1 | 6.130826774 |
| 1092 | g10929.t1 | 2936 | g11231.t1 | K14805: DDX24, MAK5 | 4.672508797 |
| 1093 | g5608.t1 | 2937 | g7532.t1 | | 0.756308574 |
| 1094 | g7845.t1 | 2938 | g10498.t1 | K03434: PIGL | 8.181737455 |
| 1095 | g15860.t1 | 2939 | g6739.t1 | K09831: ERG5 | 5.065082896 |
| 1096 | g584.t1 | 2940 | g3874.t1 | K01520: dut, DUT | 4.447661542 |
| 1097 | g5992.t1 | 2941 | g11691.t1 | K06276: PDPK1 | 4.323838023 |
| 1098 | g9408.t1 | 2942 | g3619.t1 | | 6.248005823 |
| 1099 | g12324.t1 | 2943 | g7430.t1 | K03936: NDUFS3 | 4.250138533 |
| 1100 | g8165.t1 | 2944 | g7972.t1 | | 0.505090398 |
| 1101 | g6804.t1 | 2945 | g4428.t1 | K15128: MED6 | 3.937924735 |
| 1102 | g4151.t1 | 2946 | g1828.t1 | K03327: TC.MATE, SLC47A, norM, mdtK, dinF | 5.671937128 |
| 1103 | g7170.t1 | 2947 | g560.t1 | | 5.705181185 |
| 1104 | g8819.t1 | 2948 | g3028.t1 | K09252: E3.1.1.73 | 6.425640233 |
| 1105 | g10490.t1 | 2949 | g1671.t1 | | 0.267350656 |
| 1106 | g10438.t1 | 2950 | g8414.t1 | K11090: LA, SSB | 4.175176818 |
| 1107 | g7152.t1 | 2951 | g11953.t1 | | 4.892910278 |
| 1108 | g7945.t1 | 2952 | g9700.t1 | K15272: SLC35A1__2__3 | 3.910911941 |
| 1110 | g5482.t1 | 2954 | g9825.t1 | K03544: clpX, CLPX | 5.959845259 |
| 1109 | g9746.t1 | 2953 | g1027.t1 | | 0 |
| 1111 | g7512.t1 | 2955 | g10315.t1 | K10268: FBXL2__20 | 5.036102597 |
| 1112 | g9423.t1 | 2956 | g10310.t1 | K17678: MRH4 | 5.698279892 |
| 1113 | g4358.t1 | 2957 | g427.t1 | K15394: ACE1 | 8.430767836 |
| 1114 | g2440.t1 | 2958 | g6709.t1 | | 8.194390826 |
| 1115 | g7412.t1 | 2959 | g7196.t1 | K17786: MOS2 | 4.719997185 |
| 1116 | g7292.t1 | 2960 | g11859.t1 | K17267: COPG | 5.289893047 |
| 479 | g10141.t1 | 2484 | g8477.t1 | | 5.541093332 |
| 1117 | g5887.t1 | 2961 | g10973.t1 | | 7.17403047 |
| 1119 | g1144.t1 | 2963 | g256.t1 | | 4.804829552 |
| 1118 | g6530.t1 | 2962 | g10068.t1 | K12345: SRD5A3 | 6.05975643 |
| 1120 | g1388.t1 | 2964 | g3922.t1 | K11108: RCL1 | 0 |
| 660 | g8547.t1 | 2461 | g10270.t1 | K02865: RP-L10Ae, RPL10A | 4.653519091 |
| 1121 | g1443.t1 | 2965 | g6990.t1 | | 6.353729544 |

TABLE 603-continued

| | | | | | |
|---|---|---|---|---|---|
| 557 | g5845.t1 | 2354 | g1158.t1 | K02985: RP-S3e, RPS3 | 6.78958802 |
| 1122 | g1775.t1 | 2966 | g1180.t1 | | 2.44192219 |
| 1123 | g5301.t1 | 2967 | g2268.t1 | | 4.832199777 |
| 1124 | g5630.t1 | 2968 | g1133.t1 | K10808: RRM2 | 3.538433491 |
| 1125 | g10024.t1 | 2969 | g8702.t1 | | 0 |
| 1126 | g2219.t1 | 2970 | g2626.t1 | | 5.454955353 |
| 1127 | g3982.t1 | 2971 | g7057.t1 | K07824: E1.14.13.12 | 4.476939292 |
| 1129 | g8840.t1 | 2973 | g1272.t1 | | 3.816201878 |
| 1128 | g9861.t1 | 2972 | g11455.t1 | K06101: ASH1L | 0 |
| 1130 | g4800.t1 | 2974 | g676.t1 | | 5.81071258 |
| 1131 | g11654.t1 | 2975 | g8005.t1 | | 2.909017487 |
| 1132 | g1136.t1 | 2976 | g245.t1 | | 10.59339274 |
| 1133 | g7223.t1 | 2977 | g5892.t1 | | 5.576672157 |
| 1134 | g3646.t1 | 2978 | g623.t1 | | 6.238451943 |
| 1135 | g11372.t1 | 2979 | g5059.t1 | | 0 |
| 1138 | g6590.t1 | 2982 | g10119.t1 | | 4.776549031 |
| 1136 | g1968.t1 | 2980 | g6227.t1 | | 5.415945903 |
| 1137 | g991.t1 | 2981 | g8058.t1 | | 4.169458418 |
| 1139 | g14.t1 | 2983 | g11312.t1 | | 5.71723547 |
| 1140 | g8611.t1 | 2984 | g3033.t1 | | 3.208304365 |
| 1141 | g6942.t1 | 2985 | g6445.t1 | K00988: APA1_2 | 0.122356187 |
| 1142 | g4972.t1 | 2986 | g8937.t1 | K13953: adhP | 1.662757196 |
| 1143 | g11708.t1 | 2987 | g6617.t1 | | 6.393154936 |
| 1144 | g6627.t1 | 2988 | g10177.t1 | | 4.492307379 |
| 1145 | g3793.t1 | 2989 | g2622.t1 | K00632: E2.3.1.16, fadA | 2.683933449 |
| 1146 | g5362.t1 | 2990 | g9549.t1 | | 5.333486397 |
| 1147 | g14458.t1 | 2991 | g213.t1 | K03417: prpB | 5.793822468 |
| 1148 | g3972.t1 | 2992 | g7050.t1 | K09274: K09274 | 4.82960772 |
| 1149 | g9183.t1 | 2993 | g6515.t1 | | 1.762573342 |
| 1150 | g3346.t1 | 2994 | g4782.t1 | | 0 |
| 1151 | g15347.t1 | 2995 | g9963.t1 | | 5.425175011 |
| 1152 | g610.t1 | 2996 | g3850.t1 | | 0 |
| 1153 | g5842.t1 | 2997 | g1161.t1 | | 4.563717732 |
| 1154 | g13891.t1 | 2998 | g7379.t1 | | 0 |
| 1155 | g13895.t1 | 2999 | g3474.t1 | K07407: E3.2.1.22B, galA, rafA | 6.607561086 |
| 1156 | g5991.t1 | 3000 | g11690.t1 | K11650: SMARCD | 6.177996747 |
| 1157 | g6045.t1 | 3001 | g11733.t1 | | 2.901234647 |
| 1158 | g5636.t1 | 3002 | g1113.t1 | K08818: CDC2L | 7.197842208 |
| 1159 | g7137.t1 | 2541 | g530.t1 | K09702: K09702 | 5.111190124 |
| 1160 | g2933.t1 | 3003 | g5977.t1 | | 6.559889482 |
| 1161 | g505.t1 | 3004 | g5519.t1 | | 3.863129552 |
| 1162 | g7769.t1 | 3005 | g7721.t1 | | 5.577160458 |
| 1163 | g7156.t1 | 3006 | g544.t1 | | 6.758034692 |
| 1165 | g930.t1 | 3008 | g9329.t1 | | 5.15713035 |
| 1164 | g13110.t1 | 3007 | g9758.t1 | | 0 |
| 1166 | g586.t1 | 3009 | g3871.t1 | | 3.781116872 |
| 577 | g1391.t1 | 2375 | g3917.t1 | | 3.770913064 |
| 1168 | g10165.t1 | 3011 | g7723.t1 | K01455: E3.5.1.49 | 5.879458438 |
| 1167 | g2887.t1 | 3010 | g10878.t1 | K00102: E1.1.2.4, dld | 4.602956869 |
| 689 | g849.t1 | 2496 | g9453.t1 | K06997: K06997 | 3.120625144 |
| 1169 | g7214.t1 | 3012 | g5878.t1 | | 4.495077603 |
| 1170 | g18895.t1 | 3013 | g5859.t1 | K10845: TTDA, GTF2H5, TFB5 | 5.98025722 |
| 1171 | g8250.t1 | 3014 | g10029.t1 | | 4.39864019 |
| 1172 | g2364.t1 | 3015 | g9259.t1 | | 9.213191896 |
| 1173 | g560.t1 | 3016 | g7760.t1 | K07819: B3GALT1 | 0 |
| 1174 | g5544.t1 | 3017 | g11318.t1 | K01874: MARS, metG | 5.478905924 |
| 1175 | g2772.t1 | 3018 | g9139.t1 | K14840: NOP53, GLTSCR2 | 0 |
| 1176 | g5248.t1 | 3019 | g2343.t1 | | 8.877204443 |
| 532 | g27.t1 | 2329 | g1583.t1 | | 6.169854164 |
| 1177 | g10546.t1 | 3020 | g6691.t1 | K12196: VPS4 | 0 |
| 1178 | g12603.t1 | 3021 | g1139.t1 | K13201: TIA1, TIAL1 | 3.823455116 |
| 1179 | g2082.t1 | 3022 | g2515.t1 | | 4.08648863 |
| 1180 | g4868.t1 | 3023 | g4487.t1 | K18106: GAAA | 5.341364148 |
| 666 | g9261.t1 | 2467 | g10439.t1 | K01336: E3.4.21.48 | 4.328483282 |
| 1181 | g4732.t1 | 3024 | g2022.t1 | | 3.266778123 |
| 1183 | g8014.t1 | 3026 | g3407.t1 | K05994: E3.4.11.10 | 5.396879706 |
| 1182 | g2889.t1 | 3025 | g10880.t1 | | 5.096458376 |
| 1184 | g6241.t1 | 3027 | g7141.t1 | | 2.980899445 |
| 1185 | g10185.t1 | 3028 | g11141.t1 | K12842: SR140 | 4.806643797 |
| 1186 | g3181.t1 | 3029 | g4963.t1 | | 5.389590661 |
| 1187 | g1146.t1 | 3030 | g259.t1 | | 0 |
| 1188 | g3478.t1 | 3031 | g4668.t1 | K15118: SLC25A38 | 7.188127807 |
| 1189 | g10812.t1 | 3032 | g11469.t1 | | 4.970990313 |
| 1190 | g5729.t1 | 3033 | g5268.t1 | | 4.667119257 |
| 1191 | g5773.t1 | 3034 | g5183.t1 | K18468: VPS35 | 2.974567603 |
| 1192 | g8342.t1 | 3035 | g5156.t1 | | 7.147347587 |

TABLE 603-continued

| | | | | | |
|---|---|---|---|---|---|
| 1193 | g2809.t1 | 3036 | g9099.t1 | | 8.970300194 |
| 1194 | g3231.t1 | 3037 | g6067.t1 | | 5.450346027 |
| 1195 | g15441.t1 | 3038 | g27.t1 | K02135: ATPeF1E, ATP5E, ATP15 | 0 |
| 1196 | g4098.t1 | 3039 | g3297.t1 | | 6.95311286 |
| 1197 | g4149.t1 | 3040 | g1830.t1 | | 5.595722786 |
| 1198 | g10768.t1 | 3041 | g811.t1 | K13281: uvsE, UVE1 | 6.312249915 |
| 1199 | g6034.t1 | 3042 | g11722.t1 | | 3.569534287 |
| 1200 | g7215.t1 | 3043 | g5884.t1 | K08141: MAL | 4.164169033 |
| 1201 | g8488.t1 | 3044 | g3354.t1 | | 3.054782379 |
| 1202 | g8852.t1 | 3045 | g1260.t1 | | 0.276187354 |
| 1203 | g17481.t1 | 3046 | g6577.t1 | K03457: TC.NCS1 | 4.118885089 |
| 1204 | g6412.t1 | 3047 | g5378.t1 | | 0 |
| 1205 | g5249.t1 | 3048 | g2342.t1 | | 4.593408785 |
| 1206 | g4308.t1 | 3049 | g1957.t1 | K01934: E6.3.3.2 | 4.385816144 |
| 1207 | g9497.t1 | 3050 | g5756.t1 | K12816: CDC40, PRP17 | 2.377976634 |
| 480 | g3149.t1 | 2377 | g4998.t1 | K01213: E3.2.1.67 | 0 |
| 1208 | g16357.t1 | 3051 | g3292.t1 | | 2.274644449 |
| 1209 | g7653.t1 | 3052 | g7536.t1 | K02218: CSNK1, CK1 | 5.559496827 |
| 1210 | g2461.t1 | 3053 | g6733.t1 | K17498: SPN1, IWS1 | 4.599947501 |
| 1211 | g2212.t1 | 3054 | g11601.t1 | K15116: SLC25A33_36, RIM2 | 4.637281551 |
| 1212 | g10883.t1 | 3055 | g172.t1 | | 0 |
| 1213 | g7108.t1 | 3056 | g5573.t1 | | 4.49020983 |
| 1214 | g4692.t1 | 3057 | g10596.t1 | K00559: E2.1.1.41, SMT1, ERG6 | 5.217966775 |
| 1215 | g7001.t1 | 3058 | g6383.t1 | | 0 |
| 1217 | g11520.t1 | 3060 | g4211.t1 | K01273: E3.4.13.19, DPEP1 | 5.534704503 |
| 1216 | g470.t1 | 3059 | g8009.t1 | K03235: EF3, TEF3 | 2.63960049 |
| 1218 | g2297.t1 | 3061 | g10716.t1 | | 6.357052968 |
| 1219 | g7855.t1 | 3062 | g10512.t1 | | 5.263495212 |
| 1221 | g1216.t1 | 3064 | g370.t1 | | 7.767118225 |
| 1220 | g15283.t1 | 3063 | g10473.t1 | | 0.148112638 |
| 1222 | g5238.t1 | 3065 | g2356.t1 | | 8.469488529 |
| 1223 | g16230.t1 | 3066 | g10013.t1 | | 6.19115729 |
| 1226 | g14146.t1 | 3069 | g3433.t1 | | 5.134598916 |
| 1225 | g882.t1 | 3068 | g9407.t1 | K12468: PAD1 | 5.834927879 |
| 1224 | g10984.t1 | 3067 | g5650.t1 | | 0 |
| 1227 | g6996.t1 | 3070 | g6388.t1 | K01104: E3.1.3.48 | 0 |
| 1228 | g4042.t1 | 3071 | g3218.t1 | K10426: DCTN4 | 3.476006591 |
| 1229 | g10440.t1 | 3072 | g8416.t1 | | 4.661283453 |
| 1230 | g3798.t1 | 3073 | g9469.t1 | | 6.108299926 |
| 1233 | g5250.t1 | 3076 | g2341.t1 | | 4.192956387 |
| 1231 | g17491.t1 | 3074 | g10533.t1 | | 2.340628751 |
| 1232 | g5149.t1 | 3075 | g3828.t1 | K11369: RTG2 | 2.742167769 |
| 1234 | g10738.t1 | 3077 | g11985.t1 | K10798: PARP | 0 |
| 1235 | g188.t1 | 3078 | g5816.t1 | K18342: OTUD6 | 4.706797138 |
| 678 | g2539.t1 | 2558 | g3572.t1 | | 8.765149435 |
| 1236 | g9576.t1 | 3079 | g6624.t1 | K05355: hexPS, COQ1 | 0 |
| 1237 | g7963.t1 | 3080 | g10258.t1 | | 6.877809835 |
| 1238 | g2081.t1 | 3081 | g2516.t1 | | 3.748359597 |
| 1239 | g4635.t1 | 3082 | g2418.t1 | | 4.337082348 |
| 1240 | g1191.t1 | 3083 | g351.t1 | K14997: SLC38A11 | 0.860169772 |
| 1241 | g3500.t1 | 3084 | g2191.t1 | | 1.215931569 |
| 1242 | g1860.t1 | 3085 | g1884.t1 | | 5.590523487 |
| 1243 | g7767.t1 | 3086 | g891.t1 | | 4.764291974 |
| 1244 | g2268.t1 | 3087 | g10684.t1 | | 5.863717773 |
| 1245 | g4613.t1 | 3088 | g7741.t1 | K00463: INDO | 1.444624706 |
| 683 | g9852.t1 | 3089 | g9791.t1 | | 7.876491011 |
| 1246 | g4349.t1 | 3090 | g2121.t1 | | 1.532279358 |
| 1247 | g8581.t1 | 3091 | g6606.t1 | K00558: DNMT1, dcm | 4.21948707 |
| 1249 | g9842.t1 | 3093 | g9770.t1 | K18576: XEG | 6.122795741 |
| 1248 | g2125.t1 | 3092 | g2952.t1 | K01480: E3.5.3.11, speB | 4.351289056 |
| 1250 | g10362.t1 | 3094 | g5453.t1 | | 4.153669397 |
| 1257 | g12070.t1 | 3101 | g7821.t1 | K15356: VRG4, GONST1 | 4.864054909 |
| 1256 | g4657.t1 | 3100 | g2389.t1 | | 5.666968159 |
| 1252 | g6958.t1 | 3096 | g6431.t1 | K11968: ARIH1 | 3.357418226 |
| 1253 | g19310.t1 | 3097 | g9485.t1 | | 5.087660505 |
| 1255 | g10767.t1 | 3099 | g12013.t1 | K16833: PPP1R2, IPP2 | 3.101333549 |
| 1251 | g11977.t1 | 3095 | g12286.t1 | | 5.145090044 |
| 1254 | g8978.t1 | 3098 | g11390.t1 | | 0 |
| 1258 | g21710.t1 | 3102 | g9500.t1 | | 1.238938387 |
| 1259 | g7491.t1 | 3103 | g10328.t1 | | 3.324272702 |
| 1260 | g7956.t1 | 3104 | g10264.t1 | | 6.737632146 |
| 1261 | g7964.t1 | 3105 | g10257.t1 | | 6.468663015 |
| 1262 | g7455.t1 | 3106 | g6879.t1 | | 7.133634176 |
| 1264 | g7919.t1 | 3108 | g8603.t1 | | 7.707220525 |
| 1263 | g6189.t1 | 3107 | g9611.t1 | | 3.290429112 |
| 1265 | g16176.t1 | 2509 | g5232.t1 | | 3.961883001 |

TABLE 603-continued

| | | | | | |
|---|---|---|---|---|---|
| 1266 | g8674.t1 | 3109 | g10950.t1 | | 4.335667589 |
| 1267 | g9656.t1 | 3110 | g4870.t1 | K12844: PRPF31 | 1.499922726 |
| 1268 | g7488.t1 | 3111 | g10325.t1 | K11240: MSG5 | 4.501108392 |
| 1269 | g7672.t1 | 3112 | g7571.t1 | | 3.989155638 |
| 1270 | g55.t1 | 3113 | g2746.t1 | K14567: UTP14 | 5.127910319 |
| 1272 | g9412.t1 | 3115 | g3614.t1 | | 7.062307238 |
| 1271 | g1753.t1 | 3114 | g9720.t1 | | 4.044374876 |
| 1273 | g10977.t1 | 3116 | g5641.t1 | K10735: GINS4, SLD5 | 4.051828119 |
| 1274 | g17737.t1 | 3117 | g6552.t1 | K01893: NARS, asnS | 6.388427463 |
| 1275 | g10487.t1 | 3118 | g1673.t1 | K17774: MDM10 | 2.164706382 |
| 1276 | g6558.t1 | 3119 | g10094.t1 | K00643: E2.3.1.37, ALAS | 6.31176497 |
| 1277 | g2287.t1 | 3120 | g9659.t1 | | 4.38553855 |
| 1278 | g842.t1 | 3121 | g9463.t1 | | 0 |
| 1279 | g2517.t1 | 3122 | g3549.t1 | | 5.937036867 |
| 1280 | g3451.t1 | 3123 | g4694.t1 | K18803: HPM1 | 7.686438949 |
| 1281 | g6141.t1 | 3124 | g7301.t1 | | 4.843357772 |
| 1282 | g12211.t1 | 3125 | g8489.t1 | | 4.086552127 |
| 1283 | g9200.t1 | 3126 | g6534.t1 | | 6.260040742 |
| 1284 | g5321.t1 | 3127 | g2239.t1 | | 7.891730863 |
| 1285 | g3577.t1 | 3128 | g3306.t1 | | 7.444698622 |
| 1286 | g16033.t1 | 3129 | g8312.t1 | K14961: RBBP5, SWD1, CPS50 | 6.814335139 |
| 1287 | g370.t1 | 3130 | g8886.t1 | K05351: E1.1.1.9 | 2.495983173 |
| 1288 | g11747.t1 | 3131 | g5055.t1 | | 5.579800871 |
| 1289 | g307.t1 | 3132 | g9470.t1 | K00450: E1.13.11.4 | 0 |
| 1290 | g4252.t1 | 3133 | g1730.t1 | K14554: UTP21, WDR36 | 5.046177386 |
| 1291 | g13249.t1 | 3134 | g7068.t1 | K00101: E1.1.2.3, lldD | 0 |
| 1292 | g97.t1 | 3135 | g2918.t1 | K17550: PPP1R7, SDS22 | 6.872034629 |
| 1293 | g11152.t1 | 3136 | g4836.t1 | K01736: aroC | 4.537533205 |
| 1294 | g277.t1 | 3137 | g11370.t1 | | 0 |
| 1296 | g1874.t1 | 3139 | g4227.t1 | | 3.147814191 |
| 1295 | g10285.t1 | 3138 | g38.t1 | | 0 |
| 1297 | g7205.t1 | 3140 | g5869.t1 | K04712: DEGS | 3.678254356 |
| 1298 | g3975.t1 | 3141 | g7052.t1 | K03127: TAF13 | 5.226674743 |
| 1299 | g6129.t1 | 3142 | g7317.t1 | K18584: ACTR3, ARP3 | 0.131743499 |
| 1300 | g1071.t1 | 3143 | g8144.t1 | K15163: SRB8, MED12 | 9.338879184 |
| 1301 | g9776.t1 | 3144 | g933.t1 | K18696: GDE1 | 4.318349985 |
| 1302 | g9449.t1 | 3145 | g10284.t1 | K08286: E2.7.11.— | 0.930122123 |
| 1303 | g8139.t1 | 3146 | g11353.t1 | | 5.695078874 |
| 1304 | g3952.t1 | 3147 | g3939.t1 | | 3.467152816 |
| 1306 | g4583.t1 | 3149 | g3309.t1 | | 1.533947618 |
| 1305 | g20261.t1 | 3148 | g5213.t1 | K15918: GLYK | 0 |
| 1307 | g7529.t1 | 3150 | g7276.t1 | | 6.576826873 |
| 1308 | g6754.t1 | 3151 | g4367.t1 | K02209: MCM5, CDC46 | 2.459200585 |
| 1311 | g491.t1 | 3154 | g5498.t1 | | 6.698116368 |
| 1309 | g7837.t1 | 3152 | g8557.t1 | | 6.106640364 |
| 1310 | g987.t1 | 3153 | g8056.t1 | | 0 |
| 1313 | g17939.t1 | 3156 | g10899.t1 | | 6.818707989 |
| 1312 | g2164.t1 | 3155 | g11903.t1 | | 5.515137675 |
| 1314 | g3906.t1 | 3157 | g3985.t1 | K03190: ureD, ureH | 2.671010414 |
| 1315 | g1097.t1 | 3158 | g4041.t1 | | 0.505695041 |
| 1317 | g3623.t1 | 3160 | g595.t1 | K16466: CETN3 | 4.801115612 |
| 1316 | g8411.t1 | 3159 | g4430.t1 | | 0 |
| 1318 | g20530.t1 | 3161 | g9496.t1 | | 0 |
| 1319 | g1348.t1 | 3162 | g3450.t1 | K10438: E1.14.13.63, phacB | 3.588175282 |
| 1320 | g3797.t1 | 3163 | g2615.t1 | | 6.056986997 |
| 1321 | g7399.t1 | 3164 | g7182.t1 | | 5.018202134 |
| 1322 | g5488.t1 | 3165 | g9822.t1 | | 3.362985644 |
| 1323 | g9157.t1 | 3166 | g6488.t1 | K02324: POLE1 | 1.973709427 |
| 1324 | g14847.t1 | 3167 | g1437.t1 | K00641: metX | 6.994074013 |
| 1325 | g6957.t1 | 3168 | g6432.t1 | K10746: EXO1 | 6.131134701 |
| 1326 | g3447.t1 | 3169 | g4698.t1 | | 4.987346272 |
| 1327 | g9400.t1 | 3170 | g3632.t1 | | 4.819542549 |
| 1328 | g10198.t1 | 3171 | g11163.t1 | | 5.978274196 |
| 1331 | g7497.t1 | 3174 | g10332.t1 | | 5.769438155 |
| 1330 | g7426.t1 | 3173 | g7211.t1 | K07151: STT3 | 6.089321429 |
| 1329 | g8972.t1 | 3172 | g11360.t1 | K00949: thiN, TPK1, THI80 | 0 |
| 1332 | g11012.t1 | 3175 | g5666.t1 | | 0 |
| 1335 | g2680.t1 | 3178 | g4137.t1 | K03305: TC.POT | 4.251138075 |
| 1334 | g12334.t1 | 3177 | g7439.t1 | | 4.832463772 |
| 1333 | g4070.t1 | 3176 | g3266.t1 | K08502: VAM7 | 5.539846457 |
| 1336 | g6026.t1 | 3179 | g11719.t1 | | 6.095844652 |
| 1337 | g3846.t1 | 3180 | g3215.t1 | | 5.151000423 |
| 1338 | g5774.t1 | 3181 | g5182.t1 | | 4.645161281 |
| 1339 | g3929.t1 | 3182 | g3963.t1 | K08866: TTK, MPS1 | 6.449588576 |
| 1340 | g2818.t1 | 3183 | g9112.t1 | | 5.23098229 |
| 1341 | g4639.t1 | 3184 | g3141.t1 | | 4.295463374 |

TABLE 603-continued

| | | | | | |
|---|---|---|---|---|---|
| 1342 | g7766.t1 | 3185 | g886.t1 | K00276: AOC3, AOC2, tynA | 3.696502907 |
| 1343 | g5178.t1 | 3186 | g3785.t1 | K10732: GINS1, PSF1 | 3.205102409 |
| 1344 | g6934.t1 | 3187 | g8796.t1 | | 5.750734244 |
| 1345 | g1969.t1 | 3188 | g6228.t1 | | 3.400168294 |
| 1346 | g172.t1 | 3189 | g12085.t1 | K01531: E3.6.3.2, mgtA, mgtB | 6.497766777 |
| 1347 | g11564.t1 | 3190 | g4163.t1 | K00274: MAO, aofH | 2.200547724 |
| 1348 | g6920.t1 | 3191 | g6466.t1 | K05607: AUH | 3.935782227 |
| 1349 | g155.t1 | 3192 | g5222.t1 | K00129: E1.2.1.5 | 0 |
| 1351 | g4054.t1 | 3194 | g3233.t1 | K00222: TM7SF2, ERG24 | 4.246709844 |
| 1350 | g259.t1 | 3193 | g11071.t1 | | 2.005826005 |
| 1352 | g2113.t1 | 3195 | g6610.t1 | | 5.320518398 |
| 1353 | g18993.t1 | 3196 | g1481.t1 | | 6.460112374 |
| 1354 | g9213.t1 | 3197 | g9107.t1 | K01535: E3.6.3.6 | 0.221964669 |
| 1355 | g8608.t1 | 3198 | g3036.t1 | | 6.171130211 |
| 1359 | g559.t1 | 3202 | g3897.t1 | | 6.201870178 |
| 1357 | g1111.t1 | 3200 | g4058.t1 | K17792: TIM54 | 5.442528526 |
| 1358 | g2917.t1 | 3201 | g5991.t1 | | 5.742797006 |
| 1356 | g13698.t1 | 3199 | g7803.t1 | K15015: SLC32A, VGAT | 3.095824509 |
| 1360 | g3970.t1 | 3203 | g9872.t1 | K14455: GOT2 | 6.495895484 |
| 1361 | g6219.t1 | 3204 | g7117.t1 | K15030: EIF3M | 9.064552828 |
| 1362 | g9425.t1 | 3205 | g10308.t1 | K08850: AURKX | 4.730673883 |
| 1363 | g7501.t1 | 3206 | g10336.t1 | K18160: NDUFAF2 | 5.345072335 |
| 1364 | g859.t1 | 3207 | g9445.t1 | | 6.22964011 |
| 1365 | g1915.t1 | 3208 | g6151.t1 | | 7.270928698 |
| 1366 | g12217.t1 | 3209 | g1989.t1 | K00826: E2.6.1.42, ilvE | 3.918920739 |
| 1367 | g4170.t1 | 3210 | g1809.t1 | | 0.622664993 |
| 1368 | g9398.t1 | 2532 | g3634.t1 | | 4.794435739 |
| 1369 | g11911.t1 | 3211 | g11961.t1 | | 4.426580032 |
| 1370 | g1975.t1 | 3212 | g6235.t1 | K03676: grxC, GLRX, GLRX2 | 5.422460166 |
| 1371 | g8163.t1 | 3213 | g7963.t1 | K16261: YAT | 4.292364721 |
| 1372 | g7701.t1 | 3214 | g5632.t1 | K16261: YAT | 3.918348151 |
| 1373 | g9062.t1 | 3215 | g8589.t1 | | 0 |
| 1374 | g21743.t1 | 3216 | g11779.t1 | K01969: E6.4.1.4B | 3.581364482 |
| 1375 | g5576.t1 | 3217 | g7494.t1 | | 8.893181528 |
| 1376 | g3089.t1 | 3218 | g11792.t1 | K00914: PIK3C3, VPS34 | 6.7596142 |
| 1377 | g5685.t1 | 3219 | g1056.t1 | K13524: ABAT | 0 |
| 1378 | g4641.t1 | 3220 | g2414.t1 | K03685: rnc, DROSHA, RNT1 | 0.412316469 |
| 1379 | g2363.t1 | 3221 | g9258.t1 | | 6.486658248 |
| 1380 | g21382.t1 | 3222 | g5714.t1 | K07734: paiB | 6.462845057 |
| 1381 | g6400.t1 | 3223 | g5394.t1 | | 0 |
| 1382 | g10337.t1 | 3224 | g56.t1 | | 4.374119128 |
| 1383 | g5528.t1 | 3225 | g1657.t1 | K02896: RP-L24e, RPL24 | 5.059362323 |
| 1384 | g11343.t1 | 3226 | g11653.t1 | K10981: POL4 | 6.259801244 |
| 1385 | g5150.t1 | 3227 | g3827.t1 | | 2.931671142 |
| 1386 | g6763.t1 | 3228 | g4378.t1 | K02321: POLA2 | 8.302494784 |
| 1387 | g5671.t1 | 3229 | g1071.t1 | K11853: USP34 | 0 |
| 1388 | g11809.t1 | 3230 | g12052.t1 | K11364: SGF29 | 3.463947854 |
| 1389 | g11797.t1 | 3231 | g11951.t1 | | 3.516751262 |
| 1390 | g10681.t1 | 3232 | g8527.t1 | | 5.58963777 |
| 1391 | g4325.t1 | 3233 | g11437.t1 | | 13.11970013 |
| 1392 | g9381.t1 | 3234 | g3653.t1 | | 5.511774101 |
| 1393 | g7852.t1 | 3235 | g10509.t1 | | 6.882721316 |
| 616 | g5090.t1 | 2415 | g2954.t1 | K08486: STX1B__2__3 | 0 |
| 1394 | g3829.t1 | 3236 | g2598.t1 | | 0.266144622 |
| 1395 | g11535.t1 | 3237 | g4192.t1 | K17279: REEP5__6 | 0.360331706 |
| 1396 | g6481.t1 | 3238 | g5293.t1 | K01886: QARS, glnS | 5.748896345 |
| 1397 | g3005.t1 | 3239 | g8297.t1 | | 4.660135675 |
| 1398 | g4078.t1 | 3240 | g3277.t1 | | 3.936715366 |
| 1399 | g2855.t1 | 3241 | g9059.t1 | K00627: DLAT, aceF, pdhC | 5.436104451 |
| 1400 | g3918.t1 | 3242 | g3974.t1 | K00297: metF, MTHFR | 5.369411331 |
| 1401 | g7179.t1 | 3243 | g566.t1 | K09523: DNAJC3 | 0.627178139 |
| 1402 | g12408.t1 | 3244 | g8249.t1 | | 6.349198309 |
| 1403 | g9652.t1 | 3245 | g6915.t1 | | 4.964995182 |
| 1404 | g7523.t1 | 3246 | g7288.t1 | K13704: ABHD12 | 1.294755574 |
| 1405 | g14653.t1 | 3247 | g2855.t1 | | 5.738900905 |
| 1406 | g4096.t1 | 3248 | g3295.t1 | K17362: ACOT13 | 4.848799761 |
| 1407 | g18248.t1 | 3249 | g2041.t1 | | 4.35781588 |
| 1408 | g1237.t1 | 3250 | g7426.t1 | | 5.683015328 |
| 1410 | g3632.t1 | 3252 | g608.t1 | | 3.639980584 |
| 1409 | g5562.t1 | 3251 | g7477.t1 | | 4.810359052 |
| 1411 | g5477.t1 | 3253 | g8419.t1 | K01876: DARS, aspS | 5.822436425 |

TABLE 603-continued

| | | | | | |
|---|---|---|---|---|---|
| 1412 | g9515.t1 | 3254 | g6599.t1 | K10729: SLD2 | 5.470455054 |
| 1413 | g10318.t1 | 3255 | g72.t1 | | 3.677226697 |
| 1414 | g24.t1 | 3256 | g12134.t1 | | 2.224553826 |
| 1415 | g8240.t1 | 3257 | g10040.t1 | K17784: MINOS1, MOS1 | 4.505441621 |
| 1416 | g7496.t1 | 3258 | g10330.t1 | | 4.295198041 |
| 1418 | g5019.t1 | 3260 | g8992.t1 | K00763: pncB, NAPRT1 | 5.789644312 |
| 1417 | g9422.t1 | 3259 | g10311.t1 | K17678: MRH4 | 4.99116655 |
| 1419 | g6947.t1 | 3261 | g6439.t1 | | 4.318049534 |
| 1420 | g1449.t1 | 3262 | g6978.t1 | | 7.510804913 |
| 1421 | g11952.t1 | 3263 | g5425.t1 | K11886: ECM29 | 3.293996124 |
| 1422 | g4463.t1 | 3264 | g6821.t1 | K03441: GLP-F | 5.769121905 |
| 1423 | g4565.t1 | 3265 | g4096.t1 | | 0.919084112 |
| 1424 | g5152.t1 | 3266 | g3825.t1 | | 3.965633731 |
| 1425 | g5796.t1 | 3267 | g4861.t1 | | 4.412444745 |
| 1426 | g2106.t1 | 3268 | g2479.t1 | K17877: NIT-6 | 4.442382018 |
| 1427 | g2132.t1 | 3269 | g9887.t1 | | 6.595948877 |
| 1428 | g2743.t1 | 3270 | g8874.t1 | | 10.26584456 |
| 1429 | g3255.t1 | 3271 | g8226.t1 | | 0 |
| 1430 | g2515.t1 | 3272 | g3546.t1 | K03935: NDUFS2 | 2.995934045 |
| 1431 | g11846.t1 | 3273 | g8779.t1 | | 5.108325438 |
| 1432 | g4309.t1 | 3274 | g1956.t1 | K15436: TRPO3, MTR10 | 3.512784384 |
| 1433 | g342.t1 | 3275 | g8843.t1 | K14617: LMBRD1 | 5.048487126 |
| 1434 | g10330.t1 | 3276 | g65.t1 | K10592: HUWE1, MULE, ARF-BP1 | 0 |
| 1435 | g12736.t1 | 3277 | g5713.t1 | | 0 |
| 1436 | g3120.t1 | 3278 | g11825.t1 | | 0 |
| 1437 | g6122.t1 | 3279 | g7325.t1 | | 3.73309277 |
| 1438 | g7506.t1 | 3280 | g1313.t1 | K02510: hpaI, hpcH | 5.681359113 |
| 1439 | g4219.t1 | 3281 | g1764.t1 | | 5.026702428 |
| 1440 | g5995.t1 | 3282 | g11694.t1 | K08501: STX8 | 5.459232545 |
| 1441 | g10838.t1 | 3283 | g9836.t1 | | 4.87039805 |
| 626 | g2308.t1 | 2425 | g10725.t1 | | 5.237036425 |
| 1442 | g6039.t1 | 3284 | g11727.t1 | K14809: DDX55, SPB4 | 5.042634955 |
| 1443 | g4021.t1 | 3285 | g3194.t1 | | 4.255555246 |
| 1444 | g7825.t1 | 3286 | g8668.t1 | | 7.009481452 |
| 1445 | g7886.t1 | 3287 | g8663.t1 | | 5.301291022 |
| 1446 | g13691.t1 | 3288 | g9725.t1 | | 2.720405954 |
| 1447 | g3039.t1 | 3289 | g8267.t1 | K14779: DDX52, ROK1 | 4.859751136 |
| 1448 | g5768.t1 | 3290 | g5189.t1 | K02948: RP-S11, MRPS11, rpsK | 3.223518382 |
| 1449 | g8149.t1 | 3291 | g7955.t1 | | 7.075631425 |
| 1450 | g13905.t1 | 3292 | g4807.t1 | | 5.937192138 |
| 1451 | g9050.t1 | 3293 | g5712.t1 | | 0 |
| 1452 | g11913.t1 | 3294 | g658.t1 | K14264: BNA3 | 3.176589195 |
| 1453 | g11806.t1 | 3295 | g12049.t1 | K17260: ACTR2, ARP2 | 3.412479141 |

| SEQ ID SYM00577 | Median Exp. SYM00300 | Log FC | B-statistic | t-statistic | Adj. p-value |
|---|---|---|---|---|---|
| 687 | 8.254570732 | 8.205162 | 7.709718 | 15.19085 | 5.97E−06 |
| 700 | 5.044729998 | 5.210069 | 5.708895 | 10.76568 | 2.93E−05 |
| 674 | 0.825824927 | −4.70074 | 5.191774 | −9.95863 | 4.34E−05 |
| 688 | 1.8413995 | −4.97725 | 5.089442 | −9.80948 | 4.75E−05 |
| 701 | 0.902872062 | −5.9827 | 4.978805 | −9.65176 | 5.17E−05 |
| 702 | 5.088279289 | 4.707624 | 4.928839 | 9.581698 | 5.38E−05 |
| 703 | 2.891582245 | 2.883676 | 4.49609 | 9.003087 | 8.38E−05 |
| 704 | 2.188447902 | −4.35168 | 4.123845 | −8.54179 | 0.000127 |
| 686 | 8.452816333 | 4.967614 | 4.058607 | 8.464065 | 0.000136 |
| 675 | 4.361478247 | 4.207187 | 3.745443 | 8.102858 | 0.000183 |
| 705 | 4.099415046 | 4.001025 | 3.630507 | 7.974961 | 0.000207 |
| 706 | 2.609740762 | −4.37343 | 3.601634 | −7.94321 | 0.000212 |
| 707 | 6.497290601 | 5.707041 | 3.4962 | 7.828495 | 0.000234 |
| 708 | 11.29461044 | 9.891677 | 3.448641 | 7.777378 | 0.000245 |
| 709 | 2.522819857 | 2.630813 | 3.252018 | 7.570029 | 0.00029 |
| 517 | 7.516860158 | 7.229 | 2.98496 | 7.298142 | 0.000373 |
| 710 | 1.763743187 | −5.35718 | 2.961709 | −7.27498 | 0.00038 |
| 690 | 1.736488111 | −4.94929 | 2.879288 | −7.19348 | 0.000407 |
| 711 | 1.054868326 | −8.62274 | 2.615828 | −6.93929 | 0.000517 |
| 558 | 1.996511676 | 2.075046 | 2.565361 | 6.891657 | 0.000539 |
| 712 | 2.790411134 | 2.620375 | 2.511141 | 6.840843 | 0.000565 |
| 713 | 2.519717879 | 2.387448 | 2.41189 | 6.748785 | 0.000619 |
| 714 | 4.899566565 | 4.139604 | 2.330919 | 6.674579 | 0.000663 |
| 692 | 0.928859379 | −3.94891 | 2.315037 | −6.66012 | 0.00067 |
| 685 | 0.295559632 | −4.51752 | 2.290181 | −6.63754 | 0.000686 |
| 696 | 0.848055404 | −4.26687 | 2.268441 | −6.61786 | 0.0007 |
| 715 | 2.348179343 | 2.481725 | 2.246454 | 6.598008 | 0.000711 |
| 716 | 7.387448493 | 4.164462 | 2.159094 | 6.519689 | 0.000767 |
| 717 | 1.384010569 | −3.67942 | 1.930876 | −6.31914 | 0.000935 |
| 718 | 6.539766193 | 3.910187 | 1.874559 | 6.270516 | 0.000984 |
| 719 | 0 | −2.24072 | 1.759813 | −6.17247 | 0.001088 |

TABLE 603-continued

| | | | | | |
|---|---|---|---|---|---|
| 720 | 0.894846762 | −4.42228 | 1.658568 | −6.08708 | 0.001189 |
| 721 | 1.441622985 | −3.3104 | 1.633153 | −6.0658 | 0.001218 |
| 722 | 0 | −4.44208 | 1.572778 | −6.01551 | 0.001275 |
| 698 | 1.558896118 | −3.19078 | 1.546359 | −5.99361 | 0.001305 |
| 723 | 0.383504801 | −6.22029 | 1.532513 | −5.98216 | 0.001318 |
| 724 | 0.874379809 | −5.05512 | 1.414511 | −5.88532 | 0.001468 |
| 725 | 3.178052882 | 3.1153 | 1.380226 | 5.857421 | 0.001515 |
| 726 | 2.743866247 | 2.530417 | 1.349556 | 5.832557 | 0.001563 |
| 727 | 8.67938655 | 4.03496 | 1.313775 | 5.803657 | 0.001613 |
| 728 | 1.675692023 | −4.12482 | 1.299312 | −5.79201 | 0.001627 |
| 729 | 4.320735935 | −3.01739 | 1.245211 | −5.74859 | 0.001712 |
| 730 | 1.117898542 | −4.15716 | 1.207594 | −5.71856 | 0.001762 |
| 731 | 0.295759975 | −4.21399 | 1.185637 | −5.70109 | 0.001799 |
| 732 | 3.472329984 | −3.5087 | 1.155325 | −5.67703 | 0.001844 |
| 733 | 0 | −5.05686 | 1.131697 | −5.65833 | 0.001884 |
| 734 | 2.303932777 | −4.90902 | 1.127765 | −5.65523 | 0.001886 |
| 735 | 4.894808598 | 3.487075 | 1.017153 | 5.568359 | 0.002056 |
| 737 | 2.496100539 | −2.7244 | 0.995641 | −5.55158 | 0.002086 |
| 736 | 3.748353789 | 3.251627 | 0.996266 | 5.552068 | 0.002086 |
| 738 | 0.097742219 | −2.19296 | 0.994155 | −5.55042 | 0.002087 |
| 739 | 4.494039562 | 5.038067 | 0.963629 | 5.526686 | 0.002143 |
| 740 | 4.883694275 | 4.299834 | 0.927171 | 5.498432 | 0.002209 |
| 741 | 3.543460499 | −3.27253 | 0.888456 | −5.46854 | 0.00228 |
| 742 | 3.201001736 | 3.227374 | 0.878381 | 5.460786 | 0.002292 |
| 743 | 1.134755003 | −3.43033 | 0.868413 | −5.45312 | 0.002307 |
| 744 | 1.31228389 | −4.40225 | 0.830737 | −5.42421 | 0.002375 |
| 745 | 2.18981705 | −3.00766 | 0.818268 | −5.41466 | 0.002395 |
| 746 | 7.105767696 | 4.126379 | 0.80081 | 5.401317 | 0.002438 |
| 747 | 1.219706529 | −3.83331 | 0.756008 | −5.36718 | 0.002518 |
| 748 | 1.014147489 | −4.86358 | 0.686637 | −5.31463 | 0.002646 |
| 749 | 5.108026741 | −4.51544 | 0.681969 | −5.3111 | 0.002652 |
| 750 | 6.189343256 | 5.968321 | 0.664673 | 5.298059 | 0.00269 |
| 751 | 1.594206545 | −4.0374 | 0.625713 | −5.26876 | 0.00276 |
| 752 | 4.02637883 | 3.250628 | 0.610465 | 5.257326 | 0.002793 |
| 697 | 2.276512626 | −3.03289 | 0.608594 | −5.25592 | 0.002796 |
| 753 | 2.916440322 | −3.19554 | 0.597045 | −5.24728 | 0.002823 |
| 754 | 5.582396377 | 5.11116 | 0.592518 | 5.243887 | 0.002833 |
| 755 | 7.127819277 | 5.646838 | 0.588484 | 5.24087 | 0.002836 |
| 691 | 0 | −4.207 | 0.547655 | −5.2104 | 0.002938 |
| 756 | 1.723275185 | −5.46022 | 0.54628 | −5.20937 | 0.00294 |
| 680 | 2.558100341 | −3.77627 | 0.53802 | −5.20322 | 0.002955 |
| 757 | 1.491025779 | −7.37296 | 0.51175 | −5.18369 | 0.003013 |
| 758 | 6.655679639 | 7.343952 | 0.499918 | 5.174915 | 0.003026 |
| 759 | 5.448500076 | 4.101199 | 0.496168 | 5.172135 | 0.003035 |
| 760 | 6.849405724 | 6.555104 | 0.494322 | 5.170766 | 0.003039 |
| 761 | 1.415264641 | −4.13804 | 0.465403 | −5.14936 | 0.003123 |
| 762 | 7.078833392 | 3.299493 | 0.45963 | 5.145095 | 0.003137 |
| 763 | 7.447835109 | 4.197994 | 0.459465 | 5.144973 | 0.003137 |
| 764 | 4.691855389 | −4.09505 | 0.428461 | −5.1221 | 0.003216 |
| 765 | 6.765913108 | 4.656261 | 0.394211 | 5.096913 | 0.003318 |
| 766 | 1.189911629 | −6.35022 | 0.3901 | −5.09389 | 0.003321 |
| 767 | 0.711873688 | −4.12247 | 0.378768 | −5.08558 | 0.003347 |
| 768 | 0.935705267 | −4.23339 | 0.376965 | −5.08426 | 0.00335 |
| 769 | 1.129748696 | −5.65043 | 0.372725 | −5.08115 | 0.00336 |
| 770 | 2.447676888 | 2.51643 | 0.360788 | 5.072408 | 0.003395 |
| 771 | 7.412793324 | 2.89405 | 0.344563 | 5.060539 | 0.003447 |
| 772 | 0 | −6.33439 | 0.32456 | −5.04593 | 0.003498 |
| 773 | 1.409452743 | −5.2232 | 0.315504 | −5.03933 | 0.00352 |
| 774 | 0 | −5.44413 | 0.305958 | −5.03237 | 0.003541 |
| 775 | 0.757799789 | −3.27057 | 0.251911 | −4.9931 | 0.003718 |
| 776 | 0.261005346 | −4.64558 | 0.221495 | −4.97108 | 0.003811 |
| 777 | 0.770128672 | −3.1553 | 0.143776 | −4.91509 | 0.004074 |
| 778 | 2.816941964 | −3.86408 | 0.10615 | −4.88812 | 0.004228 |
| 779 | 1.943606982 | −5.03828 | 0.095087 | −4.88021 | 0.004261 |
| 780 | 6.49982563 | 2.314873 | 0.091858 | 4.8779 | 0.004272 |
| 781 | 2.543445727 | 2.527428 | 0.077045 | 4.867319 | 0.00432 |
| 782 | 0.378277281 | −5.07738 | 0.074749 | −4.86568 | 0.004327 |
| 783 | 1.554052399 | −6.86013 | 0.073057 | −4.86447 | 0.004331 |
| 784 | 3.740313179 | −3.30861 | 0.057195 | −4.85316 | 0.004389 |
| 785 | 6.647954724 | 6.114271 | 0.049884 | 4.847953 | 0.004415 |
| 786 | 0.809756341 | −3.46435 | 0.037282 | −4.83898 | 0.004447 |
| 787 | 4.419507408 | 4.457627 | 0.01987 | 4.826605 | 0.004499 |
| 788 | 1.722062181 | −5.09666 | 0.004896 | −4.81597 | 0.004554 |
| 789 | 8.147623562 | 6.459604 | −0.00779 | 4.806976 | 0.004594 |
| 790 | 3.849786723 | −2.31991 | −0.01622 | −4.80101 | 0.004625 |
| 791 | 6.450195037 | 4.96722 | −0.02376 | 4.795666 | 0.00466 |
| 792 | 8.130353179 | 6.315026 | −0.03164 | 4.790094 | 0.004696 |
| 793 | 0.297925928 | −5.04598 | −0.03768 | −4.78582 | 0.004716 |
| 794 | 5.862148582 | 5.707939 | −0.06956 | 4.763314 | 0.004863 |
| 795 | 3.230236428 | −2.8374 | −0.10943 | −4.73525 | 0.005047 |

TABLE 603-continued

| | | | | | |
|---|---|---|---|---|---|
| 796 | 1.199045091 | −4.36726 | −0.11833 | −4.729 | 0.00509 |
| 797 | 0.871860339 | −7.01828 | −0.12739 | −4.72264 | 0.005126 |
| 798 | 0.330447252 | −5.92622 | −0.1483 | −4.70798 | 0.005219 |
| 800 | 1.098104153 | −4.19885 | −0.16955 | −4.6931 | 0.005312 |
| 799 | 2.933131491 | 3.290135 | −0.16944 | 4.69318 | 0.005312 |
| 801 | 6.021652199 | 4.83424 | −0.17145 | 4.691775 | 0.005318 |
| 803 | 2.002833589 | −5.05292 | −0.19244 | −4.67711 | 0.005407 |
| 802 | 3.578287021 | −4.08273 | −0.18889 | −4.67959 | 0.005407 |
| 804 | 0.648456799 | −3.72185 | −0.21394 | −4.66212 | 0.005504 |
| 805 | 2.020784202 | −2.43559 | −0.21784 | −4.6594 | 0.005514 |
| 808 | 0.580666117 | −6.38818 | −0.22369 | −4.65532 | 0.005525 |
| 807 | 2.809100574 | −2.35658 | −0.22257 | −4.65611 | 0.005525 |
| 806 | 4.097390482 | −2.23548 | −0.2214 | −4.65692 | 0.005525 |
| 809 | 5.263030629 | 2.68504 | −0.23653 | 4.646388 | 0.005581 |
| 810 | 1.906016093 | −7.95994 | −0.23905 | −4.64464 | 0.005585 |
| 812 | 3.374272912 | −2.55359 | −0.24971 | −4.63722 | 0.005633 |
| 811 | 2.229412642 | −2.2735 | −0.24919 | −4.63759 | 0.005633 |
| 813 | 5.191947 | 3.218252 | −0.25601 | 4.632846 | 0.005659 |
| 814 | 5.175711473 | 5.284348 | −0.27649 | 4.618638 | 0.005755 |
| 815 | 0.457571639 | −3.67907 | −0.28594 | −4.61209 | 0.0058 |
| 816 | 5.901553526 | 3.155387 | −0.2866 | 4.611627 | 0.0058 |
| 817 | 1.938854906 | −4.27181 | −0.29258 | −4.60749 | 0.005825 |
| 818 | 3.751441415 | −2.52835 | −0.29951 | −4.60269 | 0.005855 |
| 819 | 0.847940328 | −3.32137 | −0.32592 | −4.58442 | 0.006017 |
| 820 | 2.5557465 | −4.96282 | −0.34887 | −4.56858 | 0.006156 |
| 821 | 5.505094032 | 4.420758 | −0.36167 | 4.559767 | 0.006238 |
| 822 | 2.080339763 | −3.66131 | −0.36679 | −4.55624 | 0.006268 |
| 823 | 0.715469044 | −4.2781 | −0.38183 | −4.54589 | 0.006357 |
| 825 | 1.425755818 | −3.75003 | −0.3861 | −4.54296 | 0.006362 |
| 824 | 0.732571213 | −3.30399 | −0.38598 | −4.54303 | 0.006362 |
| 826 | 1.858084528 | −5.0271 | −0.39476 | −4.537 | 0.006412 |
| 827 | 5.108233831 | 5.231226 | −0.39838 | 4.534514 | 0.006433 |
| 828 | 2.220629054 | 2.40642 | −0.40728 | 4.528399 | 0.00648 |
| 829 | 0.999936795 | −4.02216 | −0.42399 | −4.51694 | 0.006569 |
| 830 | 0.956968472 | −3.3446 | −0.42698 | −4.51489 | 0.006581 |
| 831 | 7.666771535 | 4.889688 | −0.44251 | 4.504248 | 0.006673 |
| 832 | 4.462106061 | 3.362316 | −0.44719 | 4.501046 | 0.006692 |
| 833 | 0.798417819 | −5.95745 | −0.45635 | −4.49478 | 0.006748 |
| 835 | 0.745638707 | −2.59361 | −0.48058 | −4.47822 | 0.006877 |
| 834 | 2.039008683 | 2.449259 | −0.48038 | 4.478357 | 0.006877 |
| 836 | 1.272304701 | −4.60015 | −0.49143 | −4.47081 | 0.006946 |
| 837 | 3.138905614 | −2.18675 | −0.49273 | −4.46993 | 0.006946 |
| 838 | 0 | −3.96218 | −0.49789 | −4.46641 | 0.006961 |
| 839 | 0.441358118 | −4.38384 | −0.50196 | −4.46364 | 0.006974 |
| 840 | 4.07697119 | 2.537012 | −0.50227 | 4.463427 | 0.006974 |
| 841 | 3.744824974 | −2.67465 | −0.52217 | −4.44987 | 0.007097 |
| 842 | 0.658532988 | −3.53015 | −0.52453 | −4.44827 | 0.007102 |
| 843 | 0 | −4.46853 | −0.54372 | −4.43522 | 0.007224 |
| 844 | 5.483246572 | 3.820601 | −0.54429 | 4.434824 | 0.007224 |
| 845 | 4.218558155 | 3.368666 | −0.54552 | 4.433987 | 0.007229 |
| 846 | 0.531333536 | −5.80897 | −0.5699 | −4.41744 | 0.007352 |
| 847 | 5.125810617 | 4.200583 | −0.57194 | 4.416052 | 0.007359 |
| 848 | 1.508836141 | −4.45308 | −0.57862 | −4.41153 | 0.007396 |
| 849 | 4.196864651 | 4.108622 | −0.58006 | 4.410547 | 0.007402 |
| 850 | 0 | −4.14265 | −0.58148 | −4.40958 | 0.007408 |
| 851 | 2.386025864 | −6.90475 | −0.60002 | −4.39703 | 0.007531 |
| 852 | 7.391829386 | 7.341373 | −0.61198 | 4.388939 | 0.007608 |
| 853 | 0.280401415 | −6.23052 | −0.6128 | −4.38838 | 0.007609 |
| 854 | 0 | −5.84296 | −0.61807 | −4.38482 | 0.007637 |
| 855 | 10.89359383 | 4.483809 | −0.62462 | 4.380391 | 0.00768 |
| 856 | 3.574070188 | −2.75777 | −0.63106 | −4.37604 | 0.007723 |
| 857 | 3.185653977 | −2.63104 | −0.63216 | −4.3753 | 0.007727 |
| 858 | 0 | −3.93177 | −0.63567 | −4.37293 | 0.007745 |
| 859 | 0.821736911 | −3.64067 | −0.66191 | −4.35523 | 0.007924 |
| 860 | 1.513388401 | −5.92967 | −0.67062 | −4.34936 | 0.007991 |
| 861 | 5.288562871 | 5.164408 | −0.67364 | 4.347332 | 0.008003 |
| 519 | 2.153109228 | −5.17926 | −0.68969 | −4.33653 | 0.008113 |
| 862 | 2.924286464 | 3.494282 | −0.6901 | 4.33625 | 0.008113 |
| 863 | 4.831002225 | 5.170113 | −0.7042 | 4.326775 | 0.008209 |
| 864 | 0.350736603 | −4.55951 | −0.71336 | −4.32062 | 0.008262 |
| 865 | 0.897423937 | −5.14471 | −0.71421 | −4.32005 | 0.008264 |
| 866 | 3.02046933 | −2.23527 | −0.72773 | −4.31098 | 0.008362 |
| 867 | 4.148359441 | 4.700775 | −0.72891 | 4.310188 | 0.008367 |
| 868 | 7.241823447 | 4.71758 | −0.73179 | 4.308255 | 0.008388 |
| 869 | 0.362821722 | −3.21259 | −0.73646 | −4.30512 | 0.008418 |
| 870 | 1.94750928 | −2.81205 | −0.74858 | −4.297 | 0.008489 |
| 871 | 0 | −3.47396 | −0.75224 | −4.29455 | 0.00851 |
| 872 | 0.627760328 | −5.29907 | −0.7639 | −4.28674 | 0.008589 |
| 873 | 0.951987955 | −3.0524 | −0.76717 | −4.28455 | 0.008614 |
| 874 | 0.734008502 | −6.22448 | −0.77307 | −4.28061 | 0.008657 |

TABLE 603-continued

| | | | | | |
|---|---|---|---|---|---|
| 875 | 0.296780765 | −2.07634 | −0.77841 | −4.27704 | 0.008695 |
| 876 | 2.694353324 | −2.70682 | −0.79002 | −4.26927 | 0.008782 |
| 877 | 6.450463175 | 3.82448 | −0.79922 | 4.263133 | 0.008844 |
| 878 | 2.140747407 | −6.13606 | −0.81393 | −4.25332 | 0.008927 |
| 879 | 2.173954682 | −4.47826 | −0.81655 | −4.25157 | 0.00894 |
| 880 | 1.6914174 | −4.77307 | −0.81897 | −4.24996 | 0.008951 |
| 881 | 2.35645327 | −4.64979 | −0.83531 | −4.23907 | 0.009074 |
| 882 | 3.30963121 | −2.17414 | −0.83911 | −4.23654 | 0.009106 |
| 883 | 2.158000596 | 2.42587 | −0.84519 | 4.232488 | 0.00916 |
| 884 | 2.531678954 | −3.1414 | −0.84671 | −4.23148 | 0.009169 |
| 885 | 2.194869885 | 2.402679 | −0.84832 | 4.230406 | 0.009172 |
| 886 | 2.193043465 | −3.49995 | −0.85623 | −4.22514 | 0.009214 |
| 887 | 0.314001411 | −5.55798 | −0.86027 | −4.22245 | 0.009226 |
| 889 | 0.712887218 | −4.88085 | −0.86671 | −4.21817 | 0.009265 |
| 888 | 0.611123391 | −3.75978 | −0.86634 | −4.21842 | 0.009265 |
| 890 | 1.141019105 | −7.87059 | −0.88299 | −4.20736 | 0.009375 |
| 891 | 1.709043647 | −3.91338 | −0.8871 | −4.20463 | 0.009395 |
| 892 | 1.101158731 | −3.40776 | −0.88917 | −4.20326 | 0.009404 |
| 893 | 2.213804236 | −4.55459 | −0.90647 | −4.19178 | 0.00955 |
| 894 | 1.275657111 | −4.20948 | −0.91395 | −4.18682 | 0.009596 |
| 895 | 0.352165126 | −7.40328 | −0.918 | −4.18414 | 0.009626 |
| 896 | 2.683347982 | 2.354425 | −0.92977 | 4.176344 | 0.00973 |
| 897 | 0.740211298 | −2.9098 | −0.93127 | −4.17535 | 0.00974 |
| 898 | 2.395376228 | −4.44254 | −0.9342 | −4.17341 | 0.009764 |
| 899 | 0.686771667 | −4.62795 | −0.94048 | −4.16926 | 0.009812 |
| 900 | 4.469180465 | 6.919872 | −0.94401 | 4.166923 | 0.009837 |
| 901 | 2.882217215 | −4.44428 | −0.94674 | −4.16512 | 0.009859 |
| 902 | 0 | −2.81719 | −0.9494 | −4.16336 | 0.009881 |
| 903 | 3.486426657 | −4.11858 | −0.95426 | −4.16014 | 0.009921 |
| 904 | 1.24041635 | −3.15204 | −0.95549 | −4.15933 | 0.009928 |
| 905 | 0.925832893 | −3.77285 | −0.9583 | −4.15747 | 0.009945 |
| 906 | 1.938081563 | −3.28418 | −0.95965 | −4.15658 | 0.009953 |
| 907 | 0 | −5.52502 | −0.96997 | −4.14977 | 0.010045 |
| 562 | 8.926092537 | 4.673774 | −0.97066 | 4.149315 | 0.010046 |
| 908 | 1.081386438 | −4.42774 | −0.97346 | −4.14747 | 0.01007 |
| 909 | 4.33702816 | 4.270014 | −0.97624 | 4.14563 | 0.010094 |
| 910 | 2.524623108 | −3.0042 | −0.98484 | −4.13995 | 0.010182 |
| 611 | 2.196818636 | −2.56782 | −0.98876 | −4.13737 | 0.010206 |
| 911 | 0.559439018 | −3.98216 | −0.99896 | −4.13064 | 0.010292 |
| 679 | 2.335225171 | −2.22283 | −1.00489 | −4.12674 | 0.010332 |
| 912 | 1.511594622 | −3.89684 | −1.00716 | −4.12524 | 0.010351 |
| 913 | 1.544496353 | −5.26083 | −1.01212 | −4.12197 | 0.01038 |
| 914 | 6.391579804 | 2.423474 | −1.01251 | 4.121713 | 0.01038 |
| 915 | 1.714884516 | −3.78652 | −1.01346 | −4.12109 | 0.010382 |
| 916 | 1.729090589 | −4.13011 | −1.0233 | −4.11461 | 0.010466 |
| 917 | 0.413151614 | −5.47293 | −1.02797 | −4.11154 | 0.010506 |
| 918 | 1.578952778 | −4.16193 | −1.03098 | −4.10956 | 0.010524 |
| 919 | 5.534733082 | 4.711339 | −1.03102 | 4.109529 | 0.010524 |
| 921 | 0.611123391 | −5.50761 | −1.03508 | −4.10686 | 0.010547 |
| 920 | 0.663970885 | −2.81812 | −1.03464 | −4.10715 | 0.010547 |
| 922 | 5.985251291 | 3.589267 | −1.03779 | 4.105077 | 0.010566 |
| 923 | 6.502695672 | 3.091915 | −1.04093 | 4.103011 | 0.010586 |
| 924 | 1.443935828 | −4.5113 | −1.05361 | −4.09468 | 0.010703 |
| 925 | 2.243268623 | 3.095296 | −1.06313 | 4.088427 | 0.010784 |
| 926 | 2.362058349 | −3.85574 | −1.06897 | −4.0846 | 0.010834 |
| 927 | 0.390883076 | −7.66832 | −1.07595 | −4.08002 | 0.010905 |
| 928 | 2.867657374 | −4.92548 | −1.082 | −4.07604 | 0.010958 |
| 929 | 4.541052906 | 5.755119 | −1.09914 | 4.06481 | 0.011149 |
| 930 | 2.848977141 | −2.03413 | −1.10105 | −4.06356 | 0.011158 |
| 931 | 7.602958834 | 4.626855 | −1.10473 | 4.061149 | 0.011189 |
| 932 | 1.479604123 | −3.34305 | −1.1065 | −4.05999 | 0.011196 |
| 933 | 1.806751763 | −4.31686 | −1.1196 | −4.05142 | 0.011342 |
| 934 | 0.677369437 | −5.13698 | −1.12643 | −4.04694 | 0.011405 |
| 935 | 1.060347821 | −4.34904 | −1.14015 | −4.03798 | 0.011561 |
| 936 | 0.674479047 | −4.05357 | −1.14688 | −4.03357 | 0.011602 |
| 937 | 3.179764724 | −3.71311 | −1.15782 | −4.02643 | 0.011726 |
| 938 | 2.07702255 | −4.71124 | −1.17646 | −4.01427 | 0.011932 |
| 940 | 0.87529095 | −5.79877 | −1.18683 | −4.0075 | 0.012033 |
| 939 | 8.056156653 | 3.69429 | −1.18652 | 4.007708 | 0.012033 |
| 941 | 0.597731661 | −5.22216 | −1.18923 | −4.00594 | 0.012049 |
| 942 | 0.600445772 | −5.6468 | −1.19165 | −4.00436 | 0.012073 |
| 944 | 0 | −8.04647 | −1.19703 | −4.00086 | 0.012107 |
| 943 | 8.648411182 | 5.524738 | −1.19676 | 4.001038 | 0.012107 |
| 945 | 4.489647578 | −3.74758 | −1.20103 | −3.99825 | 0.012152 |
| 946 | 0.832520653 | −5.79326 | −1.2067 | −3.99456 | 0.012204 |
| 947 | 2.932298929 | −4.4842 | −1.21334 | −3.99024 | 0.012261 |
| 948 | 0.151188629 | −4.14283 | −1.21373 | −3.98998 | 0.012261 |
| 949 | 3.031852784 | −2.51819 | −1.22384 | −3.98341 | 0.01238 |
| 950 | 1.187953513 | −4.53745 | −1.225 | −3.98265 | 0.012388 |
| 951 | 5.949359522 | 6.520548 | −1.22659 | 3.981618 | 0.012402 |

TABLE 603-continued

| | | | | | |
|---|---|---|---|---|---|
| 952 | 0.250673031 | −7.32329 | −1.23434 | −3.97658 | 0.012461 |
| 953 | 1.954717425 | −2.12779 | −1.24126 | −3.97208 | 0.012532 |
| 954 | 5.349202675 | −5.14517 | −1.24396 | −3.97033 | 0.012561 |
| 955 | 1.46241328 | −3.94481 | −1.24535 | −3.96942 | 0.012564 |
| 957 | 1.546483629 | −4.74294 | −1.24702 | −3.96834 | 0.012572 |
| 956 | 1.75745979 | −2.38792 | −1.24691 | −3.96841 | 0.012572 |
| 958 | 2.242713995 | −2.80653 | −1.2614 | −3.959 | 0.012715 |
| 959 | 0.759418996 | −4.44127 | −1.27477 | −3.95032 | 0.012862 |
| 960 | 0 | −5.19232 | −1.288 | −3.94174 | 0.012985 |
| 961 | 2.009449375 | −2.88495 | −1.28967 | −3.94066 | 0.013001 |
| 962 | 0 | −5.41093 | −1.29136 | −3.93956 | 0.013009 |
| 963 | 1.571021615 | −4.64794 | −1.29234 | −3.93894 | 0.013015 |
| 964 | 2.229618353 | −5.13781 | −1.29958 | −3.93424 | 0.013094 |
| 965 | 5.492351766 | 4.171895 | −1.30404 | 3.931351 | 0.013134 |
| 966 | 3.516802163 | 3.256136 | −1.30608 | 3.930031 | 0.013156 |
| 967 | 3.889064314 | 4.850634 | −1.30889 | 3.928212 | 0.013188 |
| 968 | 0 | −6.40524 | −1.31197 | −3.92621 | 0.013224 |
| 969 | 0.671708995 | −3.61124 | −1.31998 | −3.92103 | 0.013315 |
| 970 | 5.467296488 | 6.060068 | −1.32773 | 3.916022 | 0.013403 |
| 971 | 2.774475816 | −2.73909 | −1.33008 | −3.9145 | 0.013416 |
| 972 | 1.545461152 | 2.309288 | −1.34311 | 3.906078 | 0.013561 |
| 973 | 2.389962015 | 2.943914 | −1.34345 | 3.905856 | 0.013561 |
| 974 | 0 | −4.674 | −1.35076 | −3.90114 | 0.013653 |
| 975 | 4.230324352 | 4.826237 | −1.35244 | 3.900048 | 0.013662 |
| 976 | 1.451437878 | −4.59504 | −1.36048 | −3.89485 | 0.013771 |
| 977 | 7.45098535 | 7.483026 | −1.3621 | 3.893807 | 0.013774 |
| 978 | 4.935645484 | −6.72817 | −1.37221 | −3.88728 | 0.013876 |
| 979 | 2.885761626 | −3.92892 | −1.37418 | −3.88601 | 0.013881 |
| 980 | 6.221604639 | 2.695089 | −1.38022 | 3.882118 | 0.013943 |
| 981 | 3.964745867 | 3.303213 | −1.38528 | 3.878855 | 0.014 |
| 982 | 3.457188398 | 2.664168 | −1.38842 | 3.876826 | 0.01404 |
| 983 | 5.217325652 | 5.065179 | −1.39706 | 3.871256 | 0.014155 |
| 985 | 3.613657545 | −5.20151 | −1.40566 | −3.86571 | 0.014246 |
| 984 | 0 | −3.66136 | −1.40528 | −3.86596 | 0.014246 |
| 987 | 1.623174665 | −4.60564 | −1.40762 | −3.86446 | 0.014246 |
| 986 | 6.089917916 | 7.049988 | −1.40678 | 3.864993 | 0.014246 |
| 988 | 8.241283975 | 5.523058 | −1.40977 | 3.863072 | 0.014268 |
| 989 | 4.321377749 | −3.96851 | −1.41225 | −3.86147 | 0.014299 |
| 545 | 4.450650367 | 6.044056 | −1.42629 | 3.852432 | 0.014477 |
| 990 | 2.254791406 | 2.038211 | −1.4329 | 3.848179 | 0.01457 |
| 991 | 10.62344924 | 7.901472 | −1.43469 | 3.847032 | 0.014582 |
| 992 | 1.119311238 | −6.95438 | −1.43536 | −3.8466 | 0.014585 |
| 993 | 0.753679573 | −3.29178 | −1.44029 | −3.84343 | 0.014654 |
| 994 | 5.146898574 | 3.430541 | −1.44724 | 3.838958 | 0.014756 |
| 996 | 0.352559564 | −4.46723 | −1.45227 | −3.83573 | 0.014818 |
| 997 | 1.976704664 | 2.01366 | −1.45267 | 3.835472 | 0.014818 |
| 995 | 5.319048056 | 2.74517 | −1.45215 | 3.835802 | 0.014818 |
| 998 | 0.255280379 | −3.70757 | −1.4678 | −3.82575 | 0.015036 |
| 1000 | 1.181054579 | −4.15809 | −1.4692 | −3.82485 | 0.015042 |
| 999 | 5.874305957 | 5.783803 | −1.46917 | 3.824872 | 0.015042 |
| 1001 | 1.567191477 | −3.7165 | −1.47258 | −3.82268 | 0.015079 |
| 1002 | 3.083653978 | −2.87756 | −1.48007 | −3.81787 | 0.015176 |
| 1003 | 1.963825039 | −3.6841 | −1.49291 | −3.80963 | 0.015336 |
| 1004 | 6.247010754 | 5.020519 | −1.52096 | 3.791656 | 0.015745 |
| 1005 | 8.151281431 | 5.76651 | −1.52222 | 3.790847 | 0.015749 |
| 1006 | 2.955946512 | −2.77841 | −1.52803 | −3.78712 | 0.015822 |
| 1007 | 2.046350551 | 2.429844 | −1.5376 | 3.781003 | 0.01595 |
| 1008 | 3.061140417 | −4.53758 | −1.53902 | −3.78009 | 0.015957 |
| 1009 | 3.860530568 | 3.48447 | −1.54576 | 3.775781 | 0.016064 |
| 1010 | 5.724724114 | 3.992675 | −1.56158 | 3.765662 | 0.01626 |
| 1011 | 0.506732919 | −2.42296 | −1.56584 | −3.76294 | 0.016307 |
| 1012 | 0 | −8.03958 | −1.5726 | −3.75861 | 0.016414 |
| 1013 | 3.773241919 | 4.603707 | −1.57385 | 3.757817 | 0.016422 |
| 1014 | 2.727386827 | −2.67853 | −1.57834 | −3.75495 | 0.016483 |
| 1016 | 0.82017382 | −4.30659 | −1.58513 | −3.75061 | 0.016586 |
| 1015 | 0.923209684 | −3.22546 | −1.58489 | −3.75076 | 0.016586 |
| 1017 | 6.276337463 | 4.132421 | −1.58843 | 3.748508 | 0.01663 |
| 1018 | 1.04393275 | −3.79971 | −1.60492 | −3.73798 | 0.016879 |
| 1019 | 3.868672254 | −4.98764 | −1.60709 | −3.73659 | 0.016905 |
| 1020 | 3.029525217 | 4.770622 | −1.60735 | 3.73643 | 0.016905 |
| 1022 | 1.267905318 | −6.51374 | −1.61151 | −3.73378 | 0.016916 |
| 1021 | 5.898480598 | −4.99071 | −1.61123 | −3.73396 | 0.016916 |
| 1023 | 0.519463263 | −3.48082 | −1.62299 | −3.72646 | 0.017089 |
| 1024 | 2.722287062 | −5.41187 | −1.62797 | −3.72328 | 0.017144 |
| 1025 | 2.558264062 | −4.77608 | −1.64316 | −3.7136 | 0.017342 |
| 1028 | 0.925732567 | −4.57859 | −1.64785 | −3.71061 | 0.017346 |
| 1027 | 2.63960419 | 2.31192 | −1.64604 | 3.711768 | 0.017346 |
| 1026 | 6.178156431 | 4.998374 | −1.64578 | 3.711931 | 0.017346 |
| 1029 | 0 | −2.40333 | −1.65666 | −3.705 | 0.017474 |
| 1030 | 0.493988199 | −4.09124 | −1.66098 | −3.70226 | 0.017537 |

TABLE 603-continued

| | | | | | |
|---|---|---|---|---|---|
| 1031 | 0.613538354 | −6.24471 | −1.66287 | −3.70106 | 0.017554 |
| 1032 | 1.938062923 | −3.04363 | −1.66588 | −3.69914 | 0.017592 |
| 1033 | 1.654400295 | −2.98841 | −1.67296 | −3.69463 | 0.017699 |
| 1034 | 3.344095815 | −2.53578 | −1.68387 | −3.68769 | 0.017848 |
| 1036 | 1.511031928 | −2.40023 | −1.68571 | −3.68653 | 0.017848 |
| 1035 | 8.70058704 | 7.017271 | −1.68454 | 3.687266 | 0.017848 |
| 1037 | 8.043114244 | 3.98187 | −1.68842 | 3.684801 | 0.017891 |
| 1038 | 1.607176292 | −5.94728 | −1.69053 | −3.68346 | 0.017922 |
| 1039 | 5.574517372 | 4.436765 | −1.69563 | 3.680219 | 0.018002 |
| 1040 | 0.370292524 | −4.05667 | −1.6974 | −3.67909 | 0.018007 |
| 1041 | 1.950585648 | −2.47011 | −1.69787 | −3.67879 | 0.018007 |
| 1042 | 3.242059589 | −2.42483 | −1.70473 | −3.67444 | 0.018122 |
| 1043 | 1.76280266 | −3.78597 | −1.7088 | −3.67185 | 0.018192 |
| 1044 | 1.316734534 | −2.09676 | −1.71032 | −3.67089 | 0.018202 |
| 1045 | 5.164303702 | 2.861711 | −1.71391 | 3.668603 | 0.018254 |
| 483 | 3.168076577 | −4.05295 | −1.71839 | −3.66576 | 0.018333 |
| 1046 | 3.54374382 | −7.9404 | −1.72085 | −3.6642 | 0.018372 |
| 1047 | 2.820296417 | −2.65197 | −1.7243 | −3.66201 | 0.018411 |
| 1048 | 1.782772866 | −3.29686 | −1.72886 | −3.65912 | 0.018482 |
| 1049 | 2.715853793 | −3.19505 | −1.73268 | −3.65669 | 0.018539 |
| 1050 | 2.124950228 | −3.36335 | −1.73378 | −3.656 | 0.018551 |
| 1051 | 3.370950467 | −4.38699 | −1.73587 | −3.65467 | 0.018573 |
| 1052 | 4.635965828 | 4.676103 | −1.73742 | 3.653682 | 0.018585 |
| 1053 | 3.93663278 | 3.907389 | −1.74421 | 3.649379 | 0.018705 |
| 1054 | 5.496293536 | 5.677194 | −1.75422 | 3.643028 | 0.018876 |
| 1055 | 1.157983737 | −2.10785 | −1.75717 | −3.64116 | 0.018906 |
| 1056 | 2.175433875 | −2.89829 | −1.7677 | −3.63449 | 0.019072 |
| 1058 | 5.135322312 | 2.167023 | −1.76965 | 3.633253 | 0.019092 |
| 1057 | 5.512328424 | 5.554663 | −1.7695 | 3.633348 | 0.019092 |
| 1059 | 5.571257573 | −3.6137 | −1.77777 | −3.62811 | 0.01922 |
| 1060 | 0.801147961 | −4.17727 | −1.77847 | −3.62766 | 0.019225 |
| 1061 | 5.305901271 | 4.234911 | −1.78279 | 3.624925 | 0.019305 |
| 1062 | 0.22548607 | −4.11742 | −1.79064 | −3.61996 | 0.019439 |
| 1063 | 4.000286115 | 4.304908 | −1.79379 | 3.617966 | 0.019484 |
| 1064 | 1.369172577 | −3.2191 | −1.79682 | −3.61605 | 0.019538 |
| 1065 | 1.557405801 | −3.67053 | −1.80007 | −3.61399 | 0.019576 |
| 1066 | 1.654308781 | −2.76658 | −1.80086 | −3.61349 | 0.019583 |
| 1067 | 3.842656586 | 6.802298 | −1.80742 | 3.609337 | 0.019702 |
| 1068 | 3.142019176 | −2.65907 | −1.80959 | −3.60797 | 0.019728 |
| 1069 | 5.223284374 | 5.133706 | −1.81049 | 3.607396 | 0.019737 |
| 1070 | 2.52330656 | −4.70108 | −1.82053 | −3.60105 | 0.019899 |
| 1071 | 1.472587157 | −3.10449 | −1.82085 | −3.60084 | 0.019899 |
| 1072 | 0.645587044 | −4.07666 | −1.82154 | −3.60041 | 0.019901 |
| 1073 | 5.890637103 | 5.870779 | −1.8259 | 3.597655 | 0.019975 |
| 1074 | 5.00001954 | 4.190313 | −1.82818 | 3.596214 | 0.020014 |
| 1075 | 6.541463318 | 5.35561 | −1.83034 | 3.594846 | 0.02005 |
| 1077 | 3.549959281 | −2.93876 | −1.83506 | −3.59186 | 0.020132 |
| 1076 | 6.213381276 | 3.478537 | −1.83504 | 3.591878 | 0.020132 |
| 1078 | 7.173454513 | 6.185129 | −1.83708 | 3.590587 | 0.020145 |
| 1079 | 0 | −4.81827 | −1.84088 | −3.58819 | 0.020217 |
| 1080 | 5.795884869 | 4.024342 | −1.84369 | 3.586412 | 0.020268 |
| 1081 | 0.932891826 | −3.4849 | −1.845 | −3.58558 | 0.020287 |
| 1082 | 2.960911198 | 3.374984 | −1.84621 | 3.584819 | 0.020303 |
| 1083 | 0.802806449 | −5.22139 | −1.85419 | −3.57978 | 0.020457 |
| 1084 | 4.80563983 | 3.713653 | −1.85653 | 3.578302 | 0.020488 |
| 1085 | 0.360268275 | −3.12849 | −1.87274 | −3.56807 | 0.020807 |
| 1086 | 1.145353766 | −4.97699 | −1.87917 | −3.56401 | 0.02092 |
| 1087 | 0.19444946 | −4.70673 | −1.88023 | −3.56334 | 0.020927 |
| 1088 | 2.045122287 | −2.26209 | −1.8804 | −3.56323 | 0.020927 |
| 1089 | 2.790129292 | 3.618279 | −1.88398 | 3.560979 | 0.020986 |
| 1090 | 0.257249951 | −3.58225 | −1.88632 | −3.5595 | 0.021018 |
| 1091 | 0.21865482 | −4.84924 | −1.88786 | −3.55853 | 0.021042 |
| 1092 | 1.17072715 | −3.01023 | −1.8894 | −3.55756 | 0.021066 |
| 1093 | 5.212354025 | 3.853227 | −1.88984 | 3.557283 | 0.021066 |
| 1094 | 1.583646888 | −6.91124 | −1.89564 | −3.55362 | 0.021156 |
| 1095 | 0.529768939 | −3.57805 | −1.89631 | −3.5532 | 0.02116 |
| 1096 | 0.440246825 | −4.18025 | −1.89957 | −3.55115 | 0.021224 |
| 1097 | 1.006472653 | −3.77529 | −1.90915 | −3.54511 | 0.021424 |
| 1098 | 2.598887614 | −2.71989 | −1.90919 | −3.54508 | 0.021424 |
| 1099 | 1.633961537 | −2.27784 | −1.91946 | −3.53861 | 0.021607 |
| 1100 | 5.931877819 | 3.973947 | −1.92982 | 3.532082 | 0.021785 |
| 1101 | 1.226226038 | −3.06025 | −1.93078 | −3.53148 | 0.021797 |
| 1102 | 3.119497464 | −2.69006 | −1.93393 | −3.5295 | 0.021849 |
| 1103 | 2.50956836 | −3.52997 | −1.93676 | −3.52772 | 0.021905 |
| 1104 | 2.167666125 | −4.21806 | −1.94078 | −3.52518 | 0.021957 |
| 1105 | 5.289400866 | 4.58514 | −1.94331 | 3.523591 | 0.021995 |
| 1106 | 0.564083606 | −3.119 | −1.94491 | −3.52258 | 0.022022 |
| 1107 | 0 | −4.28485 | −1.94745 | −3.52098 | 0.022069 |
| 1108 | 6.892708872 | 2.844791 | −1.94782 | 3.520755 | 0.022069 |
| 1110 | 3.962799023 | −2.6218 | −1.95044 | −3.5191 | 0.02211 |

TABLE 603-continued

| | | | | | |
|---|---|---|---|---|---|
| 1109 | 3.49762073 | 3.171806 | −1.95002 | 3.519371 | 0.02211 |
| 1111 | 1.924325269 | −2.88696 | −1.95351 | −3.51717 | 0.022172 |
| 1112 | 0.794188824 | −4.53867 | −1.95601 | −3.5156 | 0.02221 |
| 1113 | 2.590016536 | −4.22487 | −1.96125 | −3.5123 | 0.022313 |
| 1114 | 0.959769507 | −5.65514 | −1.96222 | −3.51169 | 0.022326 |
| 1115 | 0.149385666 | −4.56381 | −1.96848 | −3.50776 | 0.022424 |
| 1116 | 1.985649581 | −3.35694 | −1.96926 | −3.50726 | 0.022424 |
| 479 | 2.791373031 | −2.40723 | −1.9695 | −3.50711 | 0.022424 |
| 1117 | 0.786931333 | −5.65287 | −1.97046 | −3.50651 | 0.022436 |
| 1119 | 0.756889395 | −4.9479 | −1.97225 | −3.50539 | 0.022447 |
| 1118 | 0.765101758 | −4.56855 | −1.97188 | −3.50562 | 0.022447 |
| 1120 | 3.606104684 | 4.172772 | −1.97523 | 3.50351 | 0.022506 |
| 660 | 0.569101736 | −4.25142 | −1.97772 | −3.50195 | 0.022536 |
| 1121 | 3.715374057 | −2.42559 | −1.97777 | −3.50191 | 0.022536 |
| 557 | 3.97973657 | −3.61504 | −1.98019 | −3.50039 | 0.022571 |
| 1122 | 5.786705282 | 3.075249 | −1.98055 | 3.500163 | 0.022571 |
| 1123 | 1.450036735 | −4.59182 | −1.9812 | −3.49976 | 0.022576 |
| 1124 | 8.044277291 | 4.332171 | −1.98319 | 3.498506 | 0.022613 |
| 1125 | 4.379295342 | 4.698935 | −1.98525 | 3.497209 | 0.022641 |
| 1126 | 0.251432019 | −3.8457 | −1.99306 | −3.4923 | 0.02281 |
| 1127 | 1.319684937 | −2.77154 | −1.99439 | −3.49147 | 0.02281 |
| 1129 | 6.770081287 | 3.045058 | −1.99951 | 3.488248 | 0.022869 |
| 1128 | 4.633512356 | 4.527713 | −1.99917 | 3.488465 | 0.022869 |
| 1130 | 0.839736228 | −3.94597 | −2.00606 | −3.48413 | 0.022998 |
| 1131 | 6.248705968 | 3.378105 | −2.00904 | 3.482265 | 0.023049 |
| 1132 | 4.772886191 | −4.68428 | −2.01923 | −3.47586 | 0.02327 |
| 1133 | 1.870596878 | −3.72025 | −2.02093 | −3.4748 | 0.02329 |
| 1134 | 1.598186508 | −3.95284 | −2.02649 | −3.4713 | 0.023385 |
| 1135 | 3.180254596 | 2.748058 | −2.0306 | 3.468725 | 0.023466 |
| 1138 | 0 | −3.51612 | −2.03519 | −3.46585 | 0.023548 |
| 1136 | 1.846262242 | −2.98674 | −2.0347 | −3.46615 | 0.023548 |
| 1137 | 6.394078234 | 3.701135 | −2.03493 | 3.46601 | 0.023548 |
| 1139 | 2.200469261 | −2.90045 | −2.03611 | −3.46527 | 0.02356 |
| 1140 | 6.684869911 | 4.600843 | −2.03808 | 3.46403 | 0.023599 |
| 1141 | 4.223472162 | 3.719099 | −2.04026 | 3.462663 | 0.023643 |
| 1142 | 5.891631852 | 4.01311 | −2.04335 | 3.460725 | 0.023699 |
| 1143 | 0.574680488 | −5.63531 | −2.05038 | −3.45631 | 0.023866 |
| 1144 | 0 | −4.73854 | −2.05245 | −3.45502 | 0.023898 |
| 1145 | 0.762155863 | −2.33328 | −2.05833 | −3.45133 | 0.024039 |
| 1146 | 1.869084159 | −3.81693 | −2.06267 | −3.44861 | 0.02414 |
| 1147 | 0.460510026 | −4.53188 | −2.06694 | −3.44593 | 0.024224 |
| 1148 | 2.115464547 | −2.69328 | −2.07351 | −3.44181 | 0.024331 |
| 1149 | 7.079679643 | 4.155095 | −2.07513 | 3.440795 | 0.02435 |
| 1150 | 3.996837394 | 3.371635 | −2.07771 | 3.439177 | 0.024406 |
| 1151 | 3.445024571 | −3.15188 | −2.0797 | −3.43793 | 0.024436 |
| 1152 | 2.724738444 | 4.721844 | −2.07971 | 3.437925 | 0.024436 |
| 1153 | 6.156540077 | 2.037263 | −2.0869 | 3.433418 | 0.024569 |
| 1154 | 5.395995421 | 4.86386 | −2.08715 | 3.433268 | 0.024569 |
| 1155 | 4.158554252 | −2.60137 | −2.08937 | −3.43187 | 0.024609 |
| 1156 | 0.576104948 | −4.263 | −2.08984 | −3.43158 | 0.02461 |
| 1157 | 8.987765157 | 5.807638 | −2.09548 | 3.428044 | 0.024702 |
| 1158 | 1.025911245 | −5.25317 | −2.10189 | −3.42403 | 0.024838 |
| 1159 | 0.46928073 | −4.29408 | −2.10378 | −3.42285 | 0.024853 |
| 1160 | 1.898194519 | −3.99948 | −2.11649 | −3.41489 | 0.025137 |
| 1161 | 6.615728181 | 2.44593 | −2.12415 | 3.410093 | 0.025321 |
| 1162 | 1.98974677 | −3.2893 | −2.13007 | −3.40639 | 0.025436 |
| 1163 | 0.550773544 | −5.82435 | −2.13342 | −3.40429 | 0.025476 |
| 1165 | 2.062962464 | −2.56378 | −2.13372 | −3.4041 | 0.025476 |
| 1164 | 2.27010416 | 3.871956 | −2.13369 | 3.404124 | 0.025476 |
| 1166 | 0.130099531 | −3.60762 | −2.14382 | −3.39779 | 0.025688 |
| 577 | 1.227337296 | −2.68731 | −2.14399 | −3.39768 | 0.025688 |
| 1168 | 2.187241836 | −3.86391 | −2.15334 | −3.39184 | 0.025911 |
| 1167 | 2.179867653 | −2.46981 | −2.15315 | −3.39195 | 0.025911 |
| 689 | 0.692301308 | −2.11851 | −2.15658 | −3.38981 | 0.025968 |
| 1169 | 0 | −3.33078 | −2.16097 | −3.38706 | 0.026065 |
| 1170 | 0.117852324 | −4.59309 | −2.16486 | −3.38463 | 0.026138 |
| 1171 | 7.809600987 | 3.394989 | −2.17214 | 3.380082 | 0.026274 |
| 1172 | 3.489449551 | −5.38194 | −2.1741 | −3.37886 | 0.026289 |
| 1173 | 2.547125215 | 2.005488 | −2.17957 | 3.375436 | 0.026433 |
| 1174 | 1.205809707 | −3.53649 | −2.18062 | −3.37478 | 0.026451 |
| 1175 | 4.504187056 | 3.485223 | −2.18408 | 3.372617 | 0.026537 |
| 1176 | 2.997703245 | −4.70877 | −2.1848 | −3.37217 | 0.026545 |
| 532 | 4.284198791 | −2.89306 | −2.18645 | −3.37113 | 0.026568 |
| 1177 | 2.055350266 | 2.102813 | −2.18629 | 3.371236 | 0.026568 |
| 1178 | 1.065757314 | −2.74675 | −2.18876 | −3.3697 | 0.026622 |
| 1179 | 0.419218481 | −3.44889 | −2.19514 | −3.36571 | 0.026769 |
| 1180 | 1.56593075 | −3.25482 | −2.19916 | −3.3632 | 0.026846 |
| 666 | 2.215262412 | −2.51243 | −2.19953 | −3.36297 | 0.026846 |
| 1181 | 7.967784506 | 3.789697 | −2.20442 | 3.359911 | 0.026965 |
| 1183 | 0.439592246 | −4.17848 | −2.20633 | −3.35872 | 0.026993 |

TABLE 603-continued

| | | | | | |
|---|---|---|---|---|---|
| 1182 | 2.729262266 | −2.29259 | −2.20614 | −3.35884 | 0.026993 |
| 1184 | 5.57372668 | 2.99467 | −2.20671 | 3.35848 | 0.026993 |
| 1185 | 1.972250473 | −3.66739 | −2.20879 | −3.35718 | 0.027029 |
| 1186 | 3.444021927 | −2.6427 | −2.20945 | −3.35677 | 0.027036 |
| 1187 | 6.234452055 | 4.526416 | −2.21441 | 3.353674 | 0.027156 |
| 1188 | 0.666767656 | −5.89063 | −2.21606 | −3.35264 | 0.027187 |
| 1189 | 1.431805036 | −2.73708 | −2.21814 | −3.35135 | 0.027228 |
| 1190 | 1.758398652 | −2.50173 | −2.2199 | −3.35025 | 0.027267 |
| 1191 | 0 | −2.90432 | −2.22779 | −3.34532 | 0.027463 |
| 1192 | 4.289313069 | −2.89998 | −2.2316 | −3.34294 | 0.027563 |
| 1193 | 3.622997906 | −4.26489 | −2.23498 | −3.34083 | 0.027638 |
| 1194 | 0 | −4.96789 | −2.23666 | −3.33979 | 0.027676 |
| 1195 | 4.22621488 | 3.724809 | −2.238 | 3.338948 | 0.027703 |
| 1196 | 0.150996268 | −5.81014 | −2.24117 | −3.33697 | 0.027773 |
| 1197 | 9.860906704 | 3.915612 | −2.24474 | 3.334743 | 0.027867 |
| 1198 | 2.018280024 | −3.29096 | −2.24832 | −3.33251 | 0.02795 |
| 1199 | 0.521226153 | −2.51415 | −2.25484 | −3.32844 | 0.028085 |
| 1200 | 1.616753056 | −2.47644 | −2.26216 | −3.32387 | 0.028255 |
| 1201 | 8.26554451 | 3.678738 | −2.2697 | 3.319177 | 0.028434 |
| 1202 | 4.110227051 | 3.121435 | −2.2707 | 3.318549 | 0.028452 |
| 1203 | 0 | −3.46084 | −2.27203 | −3.31772 | 0.028471 |
| 1204 | 6.454245699 | 4.80025 | −2.27216 | 3.31764 | 0.028471 |
| 1205 | 2.333125085 | −2.29042 | −2.27289 | −3.31719 | 0.028481 |
| 1206 | 0.977864811 | −3.10874 | −2.27469 | −3.31607 | 0.028523 |
| 1207 | 6.369846039 | 3.969675 | −2.28074 | 3.312295 | 0.028645 |
| 480 | 4.972121854 | 5.052188 | −2.29031 | 3.306327 | 0.028891 |
| 1208 | 6.642495757 | 3.654868 | −2.29659 | 3.302412 | 0.029061 |
| 1209 | 1.609655567 | −3.10003 | −2.29822 | −3.3014 | 0.029099 |
| 1210 | 0.537444052 | −3.16588 | −2.3086 | −3.29493 | 0.0294 |
| 1211 | 2.751924072 | −2.41127 | −2.31001 | −3.29405 | 0.029419 |
| 1212 | 3.218252001 | 2.292182 | −2.31043 | 3.293789 | 0.029419 |
| 1213 | 1.428868948 | −5.17599 | −2.31348 | −3.29189 | 0.029502 |
| 1214 | 0 | −4.43958 | −2.3144 | −3.29132 | 0.029519 |
| 1215 | 3.269277905 | 3.250609 | −2.31504 | 3.29092 | 0.029526 |
| 1217 | 1.679588747 | −3.69176 | −2.31962 | −3.28807 | 0.029632 |
| 1216 | 0.413728279 | −3.66277 | −2.31946 | −3.28817 | 0.029632 |
| 1218 | 0.740815837 | −4.61457 | −2.32036 | −3.2876 | 0.029643 |
| 1219 | 2.246381404 | −2.56985 | −2.32321 | −3.28583 | 0.029721 |
| 1221 | 5.274857999 | −2.76524 | −2.326 | −3.28409 | 0.029784 |
| 1220 | 3.597680572 | 3.864568 | −2.32577 | 3.284235 | 0.029784 |
| 1222 | 1.842323775 | −6.58325 | −2.3311 | −3.28092 | 0.029895 |
| 1223 | 1.549847227 | −4.95006 | −2.3385 | −3.27631 | 0.030121 |
| 1226 | 0 | −3.69373 | −2.33977 | −3.27552 | 0.030123 |
| 1225 | 7.524019066 | 3.111951 | −2.33963 | 3.275605 | 0.030123 |
| 1224 | 3.058662563 | 3.407107 | −2.33921 | 3.275869 | 0.030123 |
| 1227 | 6.684739153 | 5.253925 | −2.34351 | 3.273191 | 0.030231 |
| 1228 | 0.824375553 | −2.8745 | −2.34446 | −3.2726 | 0.030248 |
| 1229 | 2.396963708 | −3.00648 | −2.34837 | −3.27017 | 0.030363 |
| 1230 | 1.801505479 | −3.74373 | −2.35226 | −3.26774 | 0.030434 |
| 1233 | 2.110417944 | −2.71795 | −2.35314 | −3.26719 | 0.030434 |
| 1231 | 5.104359936 | 3.343498 | −2.35272 | 3.267457 | 0.030434 |
| 1232 | 5.745670985 | 4.044872 | −2.35272 | 3.267456 | 0.030434 |
| 1234 | 6.207294428 | 5.059725 | −2.3571 | 3.264731 | 0.030488 |
| 1235 | 1.42083914 | −4.18554 | −2.35888 | −3.26362 | 0.030533 |
| 678 | 6.260432332 | −2.87811 | −2.35928 | −3.26338 | 0.030533 |
| 1236 | 2.554894937 | 3.221165 | −2.36306 | 3.26102 | 0.030604 |
| 1237 | 1.401061786 | −5.00254 | −2.36399 | −3.26044 | 0.030621 |
| 1238 | 0.609941541 | −2.61083 | −2.37166 | −3.25567 | 0.030835 |
| 1239 | 1.030670213 | −3.00281 | −2.37336 | −3.25461 | 0.030878 |
| 1240 | 4.900013294 | 2.978588 | −2.37713 | 3.252265 | 0.030977 |
| 1241 | 6.936301079 | 6.119258 | −2.37828 | 3.251549 | 0.031002 |
| 1242 | 2.5557465 | −2.92429 | −2.37869 | −3.25129 | 0.031002 |
| 1243 | 0.394275237 | −5.55384 | −2.38214 | −3.24915 | 0.031067 |
| 1244 | 0.278611595 | −4.4083 | −2.38343 | −3.24835 | 0.03108 |
| 1245 | 3.80329617 | 2.176605 | −2.38439 | 3.247751 | 0.031098 |
| 683 | 4.26909549 | −2.81084 | −2.39122 | −3.2435 | 0.031274 |
| 1246 | 7.011463446 | 4.872741 | −2.39865 | 3.238883 | 0.03147 |
| 1247 | 0.630336439 | −5.33079 | −2.40589 | −3.23438 | 0.031676 |
| 1249 | 1.361365172 | −6.17274 | −2.40937 | −3.23221 | 0.031754 |
| 1248 | 1.416547398 | −2.95902 | −2.40906 | −3.23241 | 0.031754 |
| 1250 | 1.595880592 | −2.66682 | −2.41506 | −3.22868 | 0.031908 |
| 1257 | 0.460510026 | −4.71756 | −2.4197 | −3.22579 | 0.031957 |
| 1256 | 0.321502083 | −4.36415 | −2.41953 | −3.2259 | 0.031957 |
| 1252 | 0.095701333 | −3.62143 | −2.41882 | −3.22634 | 0.031957 |
| 1253 | 2.997819493 | −2.41441 | −2.41917 | −3.22612 | 0.031957 |
| 1255 | 1.02165507 | −2.06684 | −2.41943 | −3.22596 | 0.031957 |
| 1251 | 8.173976979 | 2.420158 | −2.41811 | 3.226784 | 0.031957 |
| 1254 | 4.740307825 | 4.144828 | −2.41933 | 3.226023 | 0.031957 |
| 1258 | 3.734242323 | 3.209893 | −2.42554 | 3.222163 | 0.032104 |
| 1259 | 0.292287423 | −2.5088 | −2.42722 | −3.22112 | 0.032149 |

TABLE 603-continued

| | | | | | |
|---|---|---|---|---|---|
| 1260 | 0 | −4.52249 | −2.43476 | −3.21643 | 0.032321 |
| 1261 | 2.565678496 | −3.82371 | −2.43516 | −3.21619 | 0.032321 |
| 1262 | 2.350511691 | −4.46812 | −2.43579 | −3.21579 | 0.032322 |
| 1264 | 5.344305103 | −2.48556 | −2.43812 | −3.21434 | 0.032362 |
| 1263 | 6.571773343 | 2.859167 | −2.43769 | 3.214609 | 0.032362 |
| 1265 | 1.690859985 | −2.35469 | −2.43856 | −3.21407 | 0.032363 |
| 1266 | 1.644834875 | −2.29957 | −2.43968 | −3.21337 | 0.032377 |
| 1267 | 5.995240597 | 4.144522 | −2.44487 | 3.210148 | 0.032511 |
| 1268 | 0.613661381 | −3.60908 | −2.4515 | −3.20603 | 0.032688 |
| 1269 | 1.357471583 | −3.34293 | −2.45175 | −3.20587 | 0.032688 |
| 1270 | 6.999646309 | 2.571354 | −2.45654 | 3.2029 | 0.032843 |
| 1272 | 0.410055385 | −4.46156 | −2.45932 | −3.20117 | 0.0329 |
| 1271 | 5.846317087 | 2.751402 | −2.45908 | 3.201321 | 0.0329 |
| 1273 | 8.612393187 | 4.987555 | −2.47134 | 3.193707 | 0.03327 |
| 1274 | 4.460451965 | −2.16214 | −2.47597 | −3.19083 | 0.033354 |
| 1275 | 4.843319565 | 3.625833 | −2.47943 | 3.188681 | 0.033451 |
| 1276 | 2.48933491 | −3.18947 | −2.48208 | −3.18703 | 0.033532 |
| 1277 | 6.941829687 | 3.216688 | −2.4855 | 3.184907 | 0.033614 |
| 1278 | 4.044547142 | 3.952811 | −2.48774 | 3.18352 | 0.033652 |
| 1279 | 2.027078484 | −3.14005 | −2.49094 | −3.18153 | 0.033741 |
| 1280 | 4.233781072 | −2.70319 | −2.49375 | −3.17979 | 0.033786 |
| 1281 | 0.856838746 | −3.43 | −2.49677 | −3.17791 | 0.033868 |
| 1282 | 0.933666875 | −3.29049 | −2.4978 | −3.17727 | 0.033888 |
| 1283 | 2.764634545 | −2.90907 | −2.50672 | −3.17173 | 0.034162 |
| 1284 | 3.602558714 | −3.87368 | −2.50755 | −3.17122 | 0.034169 |
| 1285 | 1.243570464 | −4.43732 | −2.51028 | −3.16953 | 0.03425 |
| 1286 | 0 | −4.98563 | −2.51933 | −3.1639 | 0.034515 |
| 1287 | 0 | −2.61273 | −2.52005 | −3.16346 | 0.034527 |
| 1288 | 0 | −5.65729 | −2.52153 | −3.16254 | 0.034567 |
| 1289 | 4.296941509 | 3.379645 | −2.52502 | 3.160374 | 0.034684 |
| 1290 | 0 | −4.35342 | −2.52588 | −3.15984 | 0.034692 |
| 1291 | 2.243022049 | 2.361545 | −2.53745 | 3.152658 | 0.035035 |
| 1292 | 1.343604487 | −4.47691 | −2.53859 | −3.15195 | 0.035064 |
| 1293 | 12.27861396 | 6.435958 | −2.54243 | 3.149569 | 0.035195 |
| 1294 | 3.079036559 | 2.875716 | −2.54813 | 3.146033 | 0.035339 |
| 1296 | 5.126168567 | 2.979917 | −2.55508 | 3.141723 | 0.035531 |
| 1295 | 3.651708721 | 6.254533 | −2.55454 | 3.142055 | 0.035531 |
| 1297 | 0.752860849 | −2.40347 | −2.55623 | −3.14101 | 0.035546 |
| 1298 | 2.844506041 | −3.29814 | −2.56215 | −3.13733 | 0.035745 |
| 1299 | 5.532439821 | 3.976918 | −2.56833 | 3.133498 | 0.035969 |
| 1300 | 2.598174135 | −4.65483 | −2.57512 | −3.12929 | 0.036158 |
| 1301 | 2.568252231 | −2.16956 | −2.57518 | −3.12925 | 0.036158 |
| 1302 | 5.973997216 | 3.699965 | −2.57627 | 3.128576 | 0.036169 |
| 1303 | 3.389930558 | −2.65431 | −2.58118 | −3.12553 | 0.036322 |
| 1304 | 8.346322304 | 4.395715 | −2.58284 | 3.124498 | 0.036357 |
| 1306 | 4.292967522 | 2.896727 | −2.58921 | 3.120549 | 0.036563 |
| 1305 | 1.938193397 | 3.648685 | −2.58912 | 3.120602 | 0.036563 |
| 1307 | 2.083647571 | −4.58843 | −2.5904 | −3.11981 | 0.036595 |
| 1308 | 5.055158724 | 2.751377 | −2.5914 | 3.11919 | 0.036619 |
| 1311 | 3.721035259 | −3.28029 | −2.59415 | −3.11749 | 0.036659 |
| 1309 | 3.365204838 | −2.32578 | −2.59377 | −3.11772 | 0.036659 |
| 1310 | 3.027945316 | 3.671038 | −2.59389 | 3.117647 | 0.036659 |
| 1313 | 5.005569394 | −2.67236 | −2.60024 | −3.11371 | 0.036861 |
| 1312 | 2.685444972 | −2.26759 | −2.5999 | −3.11392 | 0.036861 |
| 1314 | 5.33593488 | 2.738302 | −2.60354 | 3.111663 | 0.036951 |
| 1315 | 3.969049246 | 4.485033 | −2.60467 | 3.110959 | 0.036981 |
| 1317 | 1.915084147 | −3.20944 | −2.60598 | −3.11015 | 0.036988 |
| 1316 | 2.810557222 | 2.579531 | −2.60547 | 3.110465 | 0.036988 |
| 1318 | 3.999056646 | 3.361046 | −2.60652 | 3.109816 | 0.036994 |
| 1319 | 1.235710845 | −2.25653 | −2.60816 | −3.1088 | 0.037045 |
| 1320 | 2.555508643 | −2.7468 | −2.61051 | −3.10734 | 0.037124 |
| 1321 | 2.232656771 | −2.93727 | −2.61149 | −3.10673 | 0.037149 |
| 1322 | 6.104316624 | 2.718614 | −2.61209 | 3.106356 | 0.037158 |
| 1323 | 4.469428234 | 3.333555 | −2.61992 | 3.101503 | 0.037412 |
| 1324 | 3.436994314 | −2.90018 | −2.63256 | −3.09366 | 0.037835 |
| 1325 | 0.388290481 | −4.29624 | −2.63704 | −3.09089 | 0.037954 |
| 1326 | 1.724391306 | −4.26254 | −2.63726 | −3.09075 | 0.037954 |
| 1327 | 7.125673734 | 3.137002 | −2.63773 | 3.09046 | 0.037954 |
| 1328 | 2.788975408 | −3.31916 | −2.6404 | −3.08881 | 0.038033 |
| 1331 | 2.358653046 | −3.94971 | −2.64303 | −3.08718 | 0.03808 |
| 1330 | 2.57287541 | −2.74784 | −2.64279 | −3.08733 | 0.03808 |
| 1329 | 4.277976912 | 2.876826 | −2.64269 | 3.087385 | 0.03808 |
| 1332 | 5.38381861 | 3.856589 | −2.6484 | 3.083847 | 0.038255 |
| 1335 | 0.905078368 | −3.52825 | −2.65137 | −3.08201 | 0.038301 |
| 1334 | 1.425823624 | −3.26532 | −2.65114 | −3.08215 | 0.038301 |
| 1333 | 2.546984577 | −2.7732 | −2.65099 | −3.08224 | 0.038301 |
| 1336 | 0.68430684 | −4.28462 | −2.66367 | −3.07438 | 0.038767 |
| 1337 | 1.006964699 | −3.90954 | −2.66555 | −3.07322 | 0.03883 |
| 1338 | 0 | −3.4513 | −2.66704 | −3.07229 | 0.038877 |
| 1339 | 3.278968193 | −3.36947 | −2.66843 | −3.07143 | 0.03892 |

TABLE 603-continued

| | | | | | |
|---|---|---|---|---|---|
| 1340 | 2.042748595 | −4.97039 | −2.67161 | −3.06946 | 0.038992 |
| 1341 | 0 | −3.88825 | −2.67162 | −3.06945 | 0.038992 |
| 1342 | 1.950100615 | −2.2513 | −2.67226 | −3.06906 | 0.039003 |
| 1343 | 0.465489204 | −2.9998 | −2.67294 | −3.06864 | 0.039016 |
| 1344 | 3.373972395 | −2.72485 | −2.67465 | −3.06758 | 0.039072 |
| 1345 | 1.126194748 | −2.65712 | −2.67603 | −3.06672 | 0.039115 |
| 1346 | 1.752973654 | −3.4052 | −2.67672 | −3.0663 | 0.039129 |
| 1347 | 5.983180821 | 3.284934 | −2.67943 | 3.064613 | 0.039212 |
| 1348 | 1.559896558 | −2.81933 | −2.68386 | −3.06187 | 0.039338 |
| 1349 | 2.038635734 | 2.662139 | −2.68959 | 3.058314 | 0.039519 |
| 1351 | 0.753125695 | −3.82499 | −2.6984 | −3.05285 | 0.039787 |
| 1350 | 6.702898665 | 4.844188 | −2.69807 | 3.053061 | 0.039787 |
| 1352 | 1.691648425 | −3.58956 | −2.70003 | −3.05185 | 0.039841 |
| 1353 | 2.188072612 | −3.62105 | −2.70385 | −3.04948 | 0.039958 |
| 1354 | 4.444533441 | 4.861882 | −2.70441 | 3.049135 | 0.039966 |
| 1355 | 2.686136331 | −2.9841 | −2.70848 | −3.04661 | 0.040111 |
| 1359 | 1.933937599 | −3.99892 | −2.71429 | −3.04301 | 0.040268 |
| 1357 | 1.477478055 | −3.04273 | −2.71355 | −3.04347 | 0.040268 |
| 1358 | 3.575636867 | −2.07424 | −2.71393 | −3.04323 | 0.040268 |
| 1356 | 6.420340227 | 3.453954 | −2.71294 | 3.043849 | 0.040268 |
| 1360 | 1.144303422 | −3.38447 | −2.71544 | −3.0423 | 0.040287 |
| 1361 | 7.245420142 | −3.3623 | −2.71784 | −3.04081 | 0.040375 |
| 1362 | 0.868742846 | −4.27344 | −2.72342 | −3.03735 | 0.040551 |
| 1363 | 0.733430789 | −4.13019 | −2.72367 | −3.03719 | 0.040551 |
| 1364 | 1.992693147 | −3.27148 | −2.72413 | −3.03692 | 0.040555 |
| 1365 | 4.976410906 | −2.43324 | −2.73052 | −3.03295 | 0.040756 |
| 1366 | 1.387924318 | −2.78762 | −2.73448 | −3.0305 | 0.040915 |
| 1367 | 6.671635624 | 3.839574 | −2.74399 | 3.024609 | 0.041257 |
| 1368 | 1.682112273 | −3.12889 | −2.74644 | −3.02309 | 0.041334 |
| 1369 | 0.838075179 | −3.7127 | −2.75198 | −3.01966 | 0.04155 |
| 1370 | 3.194829169 | −2.95272 | −2.75339 | −3.01878 | 0.041581 |
| 1371 | 2.128178192 | −2.1584 | −2.75419 | −3.01829 | 0.041601 |
| 1372 | 2.429142725 | −2.02558 | −2.76273 | −3.013 | 0.041938 |
| 1373 | 4.231781639 | 4.010053 | −2.76633 | 3.010768 | 0.042068 |
| 1374 | 0.847557335 | −4.15212 | −2.76857 | −3.00938 | 0.042138 |
| 1375 | 1.120853281 | −5.86159 | −2.77127 | −3.00771 | 0.042212 |
| 1376 | 1.576374675 | −4.25202 | −2.77342 | −3.00637 | 0.042277 |
| 1377 | 2.065375591 | 2.44012 | −2.78145 | 3.001401 | 0.042547 |
| 1378 | 4.991257678 | 3.332549 | −2.78404 | 2.999796 | 0.042649 |
| 1379 | 1.454471294 | −6.28212 | −2.79029 | −2.99592 | 0.042862 |
| 1380 | 2.264599961 | −3.14521 | −2.79042 | −2.99584 | 0.042862 |
| 1381 | 4.971894272 | 4.307014 | −2.7932 | 2.994118 | 0.042975 |
| 1382 | 0.945262194 | −2.67548 | −2.79768 | −2.99134 | 0.043133 |
| 1383 | 2.912712707 | −2.81694 | −2.80156 | −2.98894 | 0.043281 |
| 1384 | 1.648126626 | −4.35678 | −2.80503 | −2.98679 | 0.043411 |
| 1385 | 5.392109666 | 3.102784 | −2.81072 | 2.983263 | 0.043629 |
| 1386 | 5.13409511 | −2.44481 | −2.81189 | −2.98254 | 0.043667 |
| 1387 | 4.496504481 | 3.601192 | −2.81539 | 2.98037 | 0.043799 |
| 1388 | 6.116692885 | 2.833623 | −2.81691 | 2.979429 | 0.043837 |
| 1389 | 1.679255644 | −2.65677 | −2.82277 | −2.9758 | 0.044083 |
| 1390 | 3.099515857 | −2.57245 | −2.82433 | −2.97483 | 0.04413 |
| 1391 | 2.933682888 | −7.21408 | −2.82725 | −2.97302 | 0.044229 |
| 1392 | 1.012685905 | −3.81034 | −2.82909 | −2.97188 | 0.044293 |
| 1393 | 5.021376437 | −3.07319 | −2.8293 | −2.97175 | 0.044293 |
| 616 | 3.867535804 | 3.836476 | −2.8345 | 2.968529 | 0.044458 |
| 1394 | 4.669261532 | 3.50036 | −2.8361 | 2.967538 | 0.044518 |
| 1395 | 9.163288499 | 7.510402 | −2.83657 | 2.967251 | 0.044524 |
| 1396 | 1.179880874 | −5.49899 | −2.83881 | −2.96586 | 0.044606 |
| 1397 | 0.923693205 | −4.96111 | −2.83903 | −2.96573 | 0.044606 |
| 1398 | 2.213435275 | −2.83788 | −2.83933 | −2.96554 | 0.044606 |
| 1399 | 0.350451845 | −3.90005 | −2.84415 | −2.96255 | 0.044805 |
| 1400 | 6.805636855 | 2.484666 | −2.84783 | 2.960272 | 0.044957 |
| 1401 | 4.16165657 | 3.409315 | −2.84799 | 2.960173 | 0.044957 |
| 1402 | 4.267606287 | −4.36478 | −2.85278 | −2.9572 | 0.045157 |
| 1403 | 3.229940066 | −3.59518 | −2.85436 | −2.95623 | 0.045182 |
| 1404 | 5.275553403 | 5.591409 | −2.85471 | 2.95601 | 0.045182 |
| 1405 | 1.835542251 | −3.20682 | −2.86057 | −2.95238 | 0.045453 |
| 1406 | 1.091069648 | −3.86237 | −2.86465 | −2.94985 | 0.045602 |
| 1407 | 7.901252086 | 3.784351 | −2.86851 | 2.947457 | 0.045759 |
| 1408 | 2.488598283 | −2.99706 | −2.87184 | −2.94539 | 0.045853 |
| 1410 | 1.944176831 | −2.64596 | −2.87251 | −2.94498 | 0.045853 |
| 1409 | 9.131036427 | 4.168862 | −2.87246 | 2.945014 | 0.045853 |
| 1411 | 3.686550344 | −3.1569 | −2.87291 | −2.94473 | 0.045855 |
| 1412 | 2.40515865 | −2.98726 | −2.87443 | −2.94379 | 0.045909 |
| 1413 | 5.754668913 | 3.289688 | −2.88275 | 2.938638 | 0.046244 |
| 1414 | 7.898332502 | 4.242374 | −2.8828 | 2.938606 | 0.046244 |
| 1415 | 2.059214773 | −3.2426 | −2.88456 | −2.93751 | 0.046298 |
| 1416 | 0.62681007 | −4.62511 | −2.88616 | −2.93652 | 0.046343 |
| 1418 | 0 | −4.02631 | −2.88687 | −2.93608 | 0.046344 |
| 1417 | 2.76827123 | −2.74095 | −2.8868 | −2.93613 | 0.046344 |

TABLE 603-continued

| | | | | | |
|---|---|---|---|---|---|
| 1419 | 0.859611004 | −3.26378 | −2.89495 | −2.93107 | 0.046698 |
| 1420 | 5.552335444 | −3.23923 | −2.89616 | −2.93033 | 0.046742 |
| 1421 | 0.612527291 | −2.70149 | −2.90035 | −2.92773 | 0.046902 |
| 1422 | 0.957880078 | −3.49533 | −2.90325 | −2.92593 | 0.047032 |
| 1423 | 5.08912066 | 3.486226 | −2.90372 | 2.925643 | 0.047038 |
| 1424 | 9.790435178 | 4.134104 | −2.9047 | 2.925032 | 0.047071 |
| 1425 | 6.978987815 | 2.714293 | −2.9071 | 2.923548 | 0.047159 |
| 1426 | 1.795290638 | −2.90776 | −2.90858 | −2.92263 | 0.047216 |
| 1427 | 2.130028726 | −3.56948 | −2.91683 | −2.91752 | 0.047586 |
| 1428 | 3.775688511 | −5.63147 | −2.91883 | −2.91628 | 0.047669 |
| 1429 | 4.623799698 | 4.753278 | −2.91912 | 2.916098 | 0.047669 |
| 1430 | 5.779005536 | 2.983913 | −2.91952 | 2.915847 | 0.047672 |
| 1431 | 0.456052036 | −4.50763 | −2.91997 | −2.91557 | 0.047677 |
| 1432 | 0.746291622 | −3.75578 | −2.92157 | −2.91458 | 0.047742 |
| 1433 | 6.613903693 | 2.614424 | −2.92704 | 2.91119 | 0.047918 |
| 1434 | 6.217591133 | 4.494671 | −2.92903 | 2.909954 | 0.048004 |
| 1435 | 2.67764343 | 3.587796 | −2.93123 | 2.908589 | 0.048101 |
| 1436 | 2.782475712 | 2.382813 | −2.93213 | 2.908034 | 0.048112 |
| 1437 | 0 | −3.82204 | −2.93383 | −2.90698 | 0.048183 |
| 1438 | 2.954196465 | −4.30541 | −2.93555 | −2.90591 | 0.048255 |
| 1439 | 3.19824011 | −2.28706 | −2.93664 | −2.90523 | 0.048294 |
| 1440 | 0.507403584 | −3.61957 | −2.94175 | −2.90207 | 0.048544 |
| 1441 | 2.795973757 | −2.14792 | −2.94515 | −2.89996 | 0.048705 |
| 626 | 3.494277968 | −2.61152 | −2.94809 | −2.89814 | 0.048825 |
| 1442 | 2.144742508 | −3.54449 | −2.95453 | −2.89415 | 0.049112 |
| 1443 | 1.771901086 | −3.07477 | −2.95556 | −2.89351 | 0.049148 |
| 1444 | 4.830504535 | −2.37807 | −2.95614 | −2.89315 | 0.049161 |
| 1445 | 3.603605432 | −2.98612 | −2.95905 | −2.89135 | 0.049265 |
| 1446 | 4.969707656 | 2.361023 | −2.95911 | 2.891306 | 0.049265 |
| 1447 | 2.56647477 | −2.80026 | −2.95956 | −2.89103 | 0.049269 |
| 1448 | 6.638489334 | 3.700189 | −2.95986 | 2.890843 | 0.049269 |
| 1449 | 1.400206991 | −4.60509 | −2.96226 | −2.88936 | 0.049369 |
| 1450 | 4.105355745 | −2.28795 | −2.96241 | −2.88926 | 0.049369 |
| 1451 | 1.428557276 | 2.850041 | −2.96403 | 2.888256 | 0.049437 |
| 1452 | 0.818863118 | −2.7115 | −2.96755 | −2.88608 | 0.049608 |
| 1453 | 8.573811497 | 4.004772 | −2.96831 | 2.885605 | 0.049628 |

This table describes orthologous genes of *Acremonium zea* sp. with beneficial and neutral effects on soybean growth, these genes show significant changes in expression between the two genotypes when grown in culture without soybean homogenate. "Median Exp. SYM00577" represents the median expression value in log 2 tpm across biological replicates of the beneficial *Acremonium* grown in media inoculated with 50 mM PBS buffer. "Median Exp. SYM00300" represents the median expression value in log 2 tpm across biological replicates of the neutral *Acremonium* grown in media inoculated with 50 mM PBS buffer. "Log FC" represents the estimate of the log 2-fold-change of the contrast. "B-statistic" represents the log-odds that the gene is differentially expressed. "t-statistic" represents the moderated t-statistic. "Adj. p-value" represents the false discovery rate (Benjamini & Hochberg, 1995) adjusted p-values.

TABLE 604

| SEQ ID SYM00577 | sym577 gene | SEQ ID SYM00300 | sym300 gene | Description | Median Exp. SYM00577 Plant | Median Exp. SYM00577 Mock |
|---|---|---|---|---|---|---|
| 685 | g6380.t1 | 2492 | g764.t1 | K05857: PLCD | 3.20141475 | 5.073855922 |
| 686 | g857.t1 | 2491 | g9451.t1 | K01950: E6.3.5.1, NADSYN1, QNS1, nadE | 3.886920369 | 3.802514601 |
| 687 | g13072.t1 | 2494 | g9142.t1 | | 0 | 0 |
| 675 | g5348.t1 | 2554 | g1.t1 | | 5.703283097 | 0 |
| 674 | g5345.t1 | 2555 | g9530.t1 | K03510: POLI | 0 | 5.845894518 |
| 688 | g68.t1 | 2495 | g909.t1 | K00106: XDH | 6.788107371 | 7.003820996 |
| 689 | g849.t1 | 2496 | g9453.t1 | K06997: K06997 | 2.698992601 | 3.120625144 |
| 690 | g7926.t1 | 2497 | g8597.t1 | | 6.166677332 | 6.853860482 |
| 680 | g1340.t1 | 2553 | g523.t1 | | 0 | 5.657989905 |
| 691 | g5563.t1 | 2493 | g7478.t1 | | 4.68326473 | 4.371792513 |
| 692 | g5169.t1 | 2506 | g3798.t1 | | 4.28203011 | 4.865818268 |
| 677 | g13489.t1 | 2556 | g8733.t1 | | 4.049293359 | 0 |
| 694 | g3058.t1 | 2499 | g1604.t1 | | 0 | 0 |
| 693 | g2076.t1 | 2498 | g2520.t1 | | 3.957231552 | 3.655783096 |
| 695 | g3790.t1 | 2501 | g2628.t1 | K12486: SMAP | 0 | 0 |
| 676 | g7741.t1 | 2557 | g7091.t1 | | 7.176505771 | 2.550284622 |
| 697 | g852.t1 | 2502 | g9454.t1 | K11824: AP2A | 4.880882459 | 5.513795279 |
| 696 | g3920.t1 | 2508 | g3972.t1 | | 4.127763996 | 5.062011561 |
| 678 | g2539.t1 | 2558 | g3572.t1 | | 2.326788417 | 8.765149435 |
| 699 | g2257.t1 | 2504 | g10668.t1 | | 0 | 0 |
| 698 | g657.t1 | 2503 | g9863.t1 | | 4.688200862 | 4.4628192 |

TABLE 604-continued

| SEQ ID SYM00577 | Median Exp. SYM00300 Plant | Median Exp. SYM00300 Mock | Log FC | B-statistic | t-statistic | Adj. p-value |
|---|---|---|---|---|---|---|
| 685 | 9.359327016 | 0.295559632 | 10.14621 | 4.342538 | 10.54136 | 0.005738 |
| 686 | 0.533450094 | 8.452816333 | −8.12443 | 3.977388 | −9.78835 | 0.005838 |
| 687 | 2.137400252 | 8.254570732 | −6.46147 | 3.201272 | −8.45884 | 0.009315 |
| 675 | 4.093445794 | 4.361478247 | −5.78572 | 2.800585 | −7.87932 | 0.009315 |
| 674 | 0.472127747 | 0.825824927 | 5.241458 | 2.780518 | 7.851832 | 0.009315 |
| 688 | 7.792433369 | 1.8413995 | 5.850131 | 2.994894 | 8.152802 | 0.009315 |
| 689 | 7.963289978 | 0.692301308 | 7.186104 | 2.979489 | 8.13062 | 0.009315 |
| 690 | 8.618339677 | 1.736488111 | 7.728272 | 2.846411 | 7.942614 | 0.009315 |
| 680 | 5.308190284 | 2.558100341 | 8.898276 | 3.336937 | 8.669616 | 0.009315 |
| 691 | 9.926472681 | 0 | 8.941653 | 2.765035 | 7.830714 | 0.009315 |
| 692 | 6.198143572 | 0.928859379 | 6.202992 | 2.4341 | 7.397597 | 0.014126 |
| 677 | 1.530959943 | 1.496465963 | −3.96529 | 2.150927 | −7.05207 | 0.018531 |
| 694 | 5.62596164 | 1.924786245 | 3.932304 | 2.090546 | 6.981083 | 0.018531 |
| 693 | 13.01166964 | 2.835668263 | 10.44786 | 2.127351 | 7.024242 | 0.018531 |
| 695 | 6.121031288 | 1.019511648 | 5.080878 | 1.93808 | 6.80576 | 0.021595 |
| 676 | 3.981693891 | 3.632045248 | −4.74363 | 1.718895 | −6.56295 | 0.02595 |
| 697 | 7.286171288 | 2.276512626 | 5.32327 | 1.68203 | 6.523118 | 0.02595 |
| 696 | 6.356788736 | 0.848055404 | 5.962067 | 1.696466 | 6.538681 | 0.02595 |
| 678 | 6.873536849 | 6.260432332 | 7.696947 | 1.344744 | 6.171118 | 0.039348 |
| 699 | 3.910887164 | 10.12999017 | −6.28123 | 1.22348 | −6.04968 | 0.042032 |
| 698 | 5.925534706 | 1.558896118 | 4.563314 | 1.235076 | 6.061179 | 0.042032 |

This table describes orthologous genes of *Acremonium zea* sp. with beneficial and neutral effects on soybean growth, these genes show significant genotype specific changes in expression when grown in culture with and without plant homogenate. “Median Exp. SYM00577 Plant” represents the median expression value in log 2 tpm across biological replicates of the beneficial *Acremonium* grown in media inoculated with soybean seedling homogenate extracted with 50 mM PBS. “Median Exp. SYM00577 Mock” represents the median expression value in log 2 tpm across biological replicates of the beneficial *Acremonium* grown in media inoculated with 50 mM PBS buffer. “Median Exp. SYM00300 Plant” seedling homogenate extracted with 50 mM PBS. “Median Exp. SYM00300” represents the median expression value in log 2 tpm across biological replicates of the neutral *Acremonium* grown in media inoculated with soybean seedling homogenate extracted with 50 mM PBS. “Median Exp. SYM00300 Mock” represents the median expression value in log 2 tpm across biological replicates of the neutral *Acremonium* grown in media inoculated with 50 mM PBS buffer. “Log FC” represents the estimate of the log 2-fold-change of the contrast. “B-statistic” represents the log-odds that the gene is differentially expressed. “t-statistic” represents the moderated t-statistic. “Adj. p-value” represents the false discovery rate (Benjamini & Hochberg, 1995) adjusted p-values.

TABLE 605

| SEQ ID | Description | sym577 gene | Median Exp. Plant | Median Exp. Mock | Log FC | B-statistic | t-statistic | Adj. p-value |
|---|---|---|---|---|---|---|---|---|
| 674 | K03510: POLI | g5345.t1 | 0 | 5.845894518 | −5.48202 | 5.274576 | −11.6138 | 0.002239 |
| 675 | | g5348.t1 | 5.703283097 | 0 | 5.589081 | 4.886533 | 10.76433 | 0.002344 |
| 677 | | g13489.t1 | 4.049293359 | 0 | 3.940048 | 4.438055 | 9.909633 | 0.002595 |
| 676 | | g7741.t1 | 7.176505771 | 2.550284622 | 5.088009 | 4.463602 | 9.955217 | 0.002595 |
| 678 | | g2539.t1 | 2.326788417 | 8.765149435 | −7.03125 | 3.150667 | −7.97247 | 0.014249 |
| 680 | | g1340.t1 | 0 | 5.657989905 | −5.64042 | 2.991613 | −7.77178 | 0.014249 |
| 679 | K00275: pdxH, PNPO | g4287.t1 | 0.807562533 | 4.95193285 | −4.19518 | 3.005051 | −7.78848 | 0.014249 |
| 681 | K00574: E2.1.1.79, cfa | g4581.t1 | 0.51190239 | 5.56764375 | −4.84984 | 2.75309 | −7.48306 | 0.017529 |
| 682 | K06874: K06874 | g9772.t1 | 1.832873801 | 5.323512963 | −3.59486 | 2.657715 | −7.37145 | 0.017819 |
| 683 | | g9852.t1 | 0.939929541 | 7.876491011 | −5.93834 | 2.189836 | −6.85242 | 0.030523 |
| 684 | | g2536.t1 | 9.671862421 | 2.653812149 | 6.993491 | 1.944631 | 6.59743 | 0.03853 |

This table describes genes of a *Acremonium zea* sp. with beneficial effects on soybean growth, these genes show significant changes in expression when grown in culture with and without plant homogenate. “Median Exp. Plant” represents the median expression value in log 2 tpm across biological replicates grown in media inoculated with soybean seedling homogenate extracted with 50 mM PBS. “Median Exp. Mock” represents the median expression value in log 2_tpm across biological replicates grown in media inoculated with 50 mM PBS buffer. “Log FC” represents the estimate of the log 2-fold-change of the contrast. “B-statistic” represents the log-odds that the gene is differentially expressed. “t-statistic” represents the moderated t-statistic. “Adj. p-value” represents the false discovery rate (Benjamini & Hochberg, 1995) adjusted p-values.

Example 7: Functional Characterization of Endophytes (Secreted Proteomics Experiments)

This Example describes the ability of synthetic compositions comprising plant seeds and a single endophyte strain or a plurality of endophyte strains described herein, to confer beneficial traits to a host plant. Among other things, this Example provides exemplary characterization of modulations in a beneficial endophyte's secretome, as compared to the secretome of a neutral microbe of the same genus.

Mass spectrometry was used to explore differences in secreted proteins between beneficial endophytes and neutral microbes. Four genera were selected for the secreted proteomic analysis (two fungal and two bacterial): *Acremonium, Phoma, Stenotrophomonas*, and *Agrobacterium*. For each genus, a beneficial endophyte and neutral microbe were selected: SYM00577 (SEQ ID NO: 344) and SYM00300 (SEQ ID NO: 449); SYM15774 (SEQ ID NO: 447) and SYM01331 (SEQ ID NO: 450); SYM00906 (SEQ ID NO: 439) and SYM00865 (SEQ ID NO: 451); and SYM01004 (SEQ ID NO: 441) and SYM00091 (SEQ ID NO: 427).

Microbes were cultivated in three biological replicates for each strain. Briefly, each bacterium was initially streaked on Reasoner's 2A (R2A) agar, distinct CFUs selected and cultured in 10 mL R2A broth for 4 days. Fungal strains were streaked on potato dextrose (PD) agar and individual plugs containing spores and mycelial tissues were used to initiate growth in 10 mL PD broth for 6 days. All strains were grown with agitation at room temperature. Microbial culture filtrate was harvested by centrifuging at 4500 RPM for 20 minutes in 15 mL Falcon tubes to allow culture separation and removal of the supernatant. Five mL of culture supernatant were used for secreted proteomics analysis. All steps were performed in sterile conditions. Culture filtrates were kept in dry ice after harvest at all times to preserve protein stability. Media only samples consisting of PDB and R2A were tested independently to ensure the absence of intact proteins that could potentially interfere with the secreted microbial peptides.

Prior to mass spectrometry, samples were concentrated on a Pall 3 kD MWCO MicroSep Spin Column (VWR Cat #89132-006) and quantified at 1:10 dilution by Qubit fluorometry (Life Technologies). 12 μg of each sample was separated ~1.5 cm on a 10% Bis-Tris Novex mini-gel (Invitrogen) using the MES buffer system. The gel was stained with coomassie and each lane was excised into ten equally sized segments.

Gel pieces were processed using a robot (ProGest, DigiLab) with the following protocol:

- Washed with 25 mM ammonium bicarbonate followed by acetonitrile.
- Reduced with 10 mM dithiothreitol at 60° C. followed by alkylation with 50 mM iodoacetamide at RT.
- Digested with trypsin (Promega) at 37° C. for 4 h.
- Quenched with formic acid and the supernatant was analyzed directly without further processing.

Mass Spectrometry

The digests were analyzed by nano LC/MS/MS with a Waters NanoAcquity HPLC system interfaced to a ThermoFisher Q Exactive. Peptides were loaded on a trapping column and eluted over a 75 μm analytical column at 350 nL/min; both columns were packed with Proteo Jupiter resin (Phenomenex). A 30 min gradient was employed (5 h total). The mass spectrometer was operated in data-dependent mode, with MS and MS/MS performed in the Orbitrap at 70,000 FWHM and 17,500 FWHM resolution, respectively. The fifteen most abundant ions were selected for MS/MS.

Data were searched using a local copy of Mascot with the following parameters: Fixed modification: Carbamidomethyl (C); Variable modifications: Oxidation (M), Acetyl (Protein N-term), Pyro-Glu (N-term Q), Deamidation (NQ); Mass values: Monoisotopic; Peptide Mass Tolerance: 10 ppm; Fragment Mass Tolerance: 0.02 Da; Max Missed Cleavages: 2.

Mascot DAT files were parsed into the Scaffold software for validation, filtering and to create a non-redundant list per sample. Data were filtered 1% protein and peptide level false discovery rate (FDR) and requiring at least two unique peptides per protein.

Differential Secreted Protein Expression and Functional Enrichment Analysis

Data Acquisition and Processing

Protein sequence data, KEGG annotations and corresponding protein mass spectrometry spectral count data were provided to a vendor. Data were provided for beneficial (A) and non-beneficial (B) species pairs from two fungal and two bacterial genera. All data were converted into file formats and a local database suitable for subsequent processing, analysis and parallelization.

Protein Ortholog Identification

Pairs/groups of orthologous proteins were identified using a modified version of the OrthoMCL pipeline. Orthologs were identified as reciprocal best BLASTP hits, and then clusters of orthologous proteins were defined using the modified OrthoMCL pipeline. This process was done independently for the within genera and the between genera analyses. BLASTP was run in parallel on the Georgia Tech PACE HPC environment.

Protein Functional Annotation

KEGG annotations for individual proteins were provided to the vendor based on the whole genome sequence annotations. The program BLAST2GO was used to annotate proteins with gene ontology (GO) terms based on sequence similarity to previously annotated proteins.

Protein Expression Quantification and Normalization

Individual protein expression levels were taken as the number of observed spectra (i.e. the spectra count) corresponding to each protein. Protein spectra counts were retrieved across three replicates for each species. Missing counts for any given ortholog or replicate were assigned values of 0. Individual protein expression levels (spectra counts) were then normalized by the total number of observed spectra for each replicate. This process was done independently for the three replicates corresponding to each member of the A-B pair of every species. Fold-change (FC) values for orthologous pairs/groups were computed as $\log_2$ A/B spectra counts for the purpose of functional enrichment analysis Protein Differential Expression Analysis Differential protein expression analysis was done for a) pairs of orthologous proteins from the within genera analysis and b) groups of orthologous proteins from the between genera analysis. Differential expression was quantified by comparing the within group normalized spectra count variation to the between group normalized spectra count variation using the Students ttest. A Benjamini-Hochberg False Discover Rate threshold of 0.2 was used to identify differentially abundant orthologous proteins.

Pathway and Functional Enrichment Analysis

Enrichment analysis was done in parallel using both KEGG and GO annotations with the hypergeometric test and via Gene Set Enrichment Analysis (GSEA). For the hypergeometric test, for any given functional annotation category (i.e. KEGG pathway or GO term), the number of proteins up-regulated in the beneficial member of the orthologous pair (species A) was compared to the total number of proteins up-regulated in the complete set of orthologs. For GSEA analysis, orthologous protein pairs/groups were ranked by FC values and the distribution of FC values was evaluated for a shift using the clusterprofiler R package.

SYM00577 Secreted Proteomic Analysis

TABLE 700

25 most abundant proteins secreted by SYM00577; "Median Abundance" represents the median value across three biological replicates in units of spectra per hundred spectra

| SEQ ID | Protein ID | Median Abundance | GO Terms | KEGG Terms |
|---|---|---|---|---|
| 477 | 1AXg13463.t1 | 1.171575 | GO: 0008152: metabolic process; GO: 0016798: hydrolase activity, acting on glycosyl bonds | none |
| 478 | 1AXg10805.t1 | 1.042072 | GO: 0004348: glucosylceramidase activity; GO: 0005576: extracellular region; GO: 0005975: carbohydrate metabolic process; GO: 0006665: sphingolipid metabolic process; GO: 0030248: cellulose binding | none |
| 479 | 1AXg10141.t1 | 0.63105 | GO: 0005975: carbohydrate metabolic process; GO: 0016787: hydrolase activity | none |
| 480 | 1AXg3149.t1 | 0.581995 | GO: 0005975: carbohydrate metabolic process; GO: 0016798: hydrolase activity, acting on glycosyl bonds | KEGG Orthology: K01213: E3.2.1.67: galacturan 1,4-alpha-galacturonidase [EC: 3.2.1.67]; KEGG PATHWAY: ko00040: Pentose and glucuronate interconversions:; KEGG PATHWAY: ko00500: Starch and sucrose metabolism: |
| 481 | 1AXg5293.t1 | 0.516427 | GO: 0003723: RNA binding; GO: 0033897: ribonuclease T2 activity; GO: 0090502: RNA phosphodiester bond hydrolysis, endonucleolytic | KEGG Orthology: K01166: E3.1.27.1: ribonuclease T2 [EC: 3.1.27.1] |
| 482 | 1AXg10578.t1 | 0.498434 | GO: 0004190: aspartic-type endopeptidase activity; GO: 0006508: proteolysis | none |
| 483 | 1AXg10693.t1 | 0.404474 | GO: 0000328: fungal-type vacuole lumen; GO: 0016020: membrane; GO: 0032366: intracellular sterol transport | none |
| 484 | 1AXg11973.t1 | 0.336207 | GO: 0005886: plasma membrane; GO: 0005975: carbohydrate metabolic process; GO: 0016021: integral component of membrane; GO: 0016740: transferase activity; GO: 0016787: hydrolase activity; GO: 0031225: anchored component of membrane | none |
| 485 | 1AXg1240.t1 | 0.322054 | GO: 0003993: acid phosphatase activity; GO: 0016311: dephosphorylation; GO: 0046872: metal ion binding | KEGG Orthology: K01078: E3.1.3.2: acid phosphatase [EC: 3.1.3.2]; KEGG PATHWAY: ko00627: Aminobenzoate degradation:; KEGG PATHWAY: ko00740: Riboflavin metabolism:; KEGG PATHWAY: ko05152: Tuberculosis: Tuberculosis, or TB, is an infectious disease caused by *Mycobacterium tuberculosis*. One third of the world's population is thought to be infected with TB. About 90% of those infected result in latent infections, and about 10% of latent infections develop active diseases when their immune system is impaired due to the age, other diseases such as AIDS or exposure to immunosuppressive drugs. TB is transmitted through the air and primarily attacks the lungs, then it can spread by the circulatory system to other parts of body. Once TB bacilli have entered the host by the respiratory route and infected macrophages in the lungs, they interfere with phagosomal maturation, antigen presentation, apoptosis and host immune |

TABLE 700-continued

| 25 most abundant proteins secreted by SYM00577; "Median Abundance" represents the median value across three biological replicates in units of spectra per hundred spectra | | | | |
|---|---|---|---|---|
| SEQ ID | Protein ID | Median Abundance | GO Terms | KEGG Terms |
| | | | | system to establish persistent or latent infection. |
| 486 | 1AXg4516.t1 | 0.315618 | GO: 0005975: carbohydrate metabolic process; GO: 0016740: transferase activity; GO: 0031224: intrinsic component of membrane | none |
| 487 | 1AXg5358.t1 | 0.294999 | GO: 0005976: polysaccharide metabolic process; GO: 0016798: hydrolase activity, acting on glycosyl bonds; GO: 0030246: carbohydrate binding | KEGG Orthology: K01178: E3.2.1.3: glucoamylase [EC: 3.2.1.3]; KEGG PATHWAY: ko00500: Starch and sucrose metabolism: |
| 488 | 1AXg9478.t1 | 0.283328 | GO: 0044464: cell part | none |
| 489 | 1AXg3273.t1 | 0.275195 | GO: 0008233: peptidase activity | KEGG Orthology: K01312: PRSS: trypsin [EC: 3.4.21.4]; KEGG PATHWAY: ko04080: Neuroactive ligand-receptor interaction:; KEGG PATHWAY: ko04972: Pancreatic secretion: The pancreas performs both exocrine and endocrine functions. The exocrine pancreas consists of two parts, the acinar and duct cells. The primary functions of pancreatic acinar cells are to synthesize and secrete digestive enzymes. Stimulation of the cell by secretagogues such as acetylcholine (ACh) and cholecystokinin (CCK) causes the generation of an intracellular Ca2+ signal. This signal, in turn, triggers the fusion of the zymogen granules with the apical plasma membrane, leading to the polarised secretion of the enzymes. The major task of pancreatic duct cells is the secretion of fluid and bicarbonate ions (HCO3−), which neutralize the acidity of gastric contents that enter the duodenum. An increase in intracellular cAMP by secretin is one of the major signals of pancreatic HCO3− secretion. Activation of the CFTR Cl− channel and the CFTR-dependent Cl−/HCO3− exchange activities is responsible for cAMP-induced HCO3− secretion.; KEGG PATHWAY: ko04974: Protein digestion and absorption: Protein is a dietary component essential for nutritional homeostasis in humans. Normally, ingested protein undergoes a complex series of degradative processes following the action of gastric, pancreatic and small intestinal enzymes. The result of this proteolytic activity is a mixture of amino acids and small peptides. Amino acids (AAs) are transported into the enterocyte (intestinal epithelial cell) by a variety of AA transporters that are specific for cationic (basic) AA, neutral AA, and anionic (acidic) AA. Small peptides are absorbed into enterocytes by the PEPT1 transporter. Inside enterocytes peptides are hydrolyzed, and the resulting amino acids are released together with those absorbed by AA transporters into blood via multiple, basolateral, AA transporters. Hydrolysis-resistant peptides, however, are transported out of the cells by a basolateral peptide transporter that has not been identified molecularly.; KEGG PATHWAY: ko05164: Influenza A: Influenza is a contagious respiratory disease caused by influenza virus infection. Influenza A virus is responsible for both annual seasonal epidemics and periodic worldwide pandemics. Novel strains that cause pandemics arise from avian influenza virus by genetic reassortment among influenza viruses and two surface glycoproteins HA and NA form the basis of serologically distinct virus types. |

TABLE 700-continued 25 most abundant proteins secreted by SYM00577; "Median Abundance" represents the median value across three biological replicates in units of spectra per hundred spectra

| SEQ ID | Protein ID | Median Abundance | GO Terms | KEGG Terms |
|---|---|---|---|---|
| | | | | The innate immune system recognizes invaded virus through multiple mechanisms. Viral non-structural NS1 protein is a multifunctional virulence factor that interfere IFN-mediated antiviral response. It inhibits IFN production by blocking activation of transcription factors such as NF-kappa B, IRF3 and AP1. NS1 further inhibits the activation of IFN-induced antiviral genes. PB1-F2 protein is another virulence factor that induce apoptosis of infected cells, which results in life-threatening bronchiolitis. |
| 490 | 1AXg8115.t1 | 0.234864 | GO: 0008152: metabolic process; GO: 0016787: hydrolase activity | none |
| 491 | 1AXg12530.t1 | 0.232187 | GO: 0000103: sulfate assimilation; GO: 0005634: nucleus; GO: 0005829: cytosol; GO: 0006457: protein folding; GO: 0015035: protein disulfide oxidoreductase activity; GO: 0016671: oxidoreductase activity, acting on a sulfur group of donors, disulfide as acceptor; GO: 0034599: cellular response to oxidative stress; GO: 0044281: small molecule metabolic process; GO: 0045454: cell redox homeostasis; GO: 0055114: oxidation-reduction process; GO: 0071704: organic substance metabolic process; GO: 1900429: negative regulation of filamentous growth of a population of unicellular organisms | KEGG Orthology: K03671: trxA: thioredoxin 1 |
| 492 | 1AXg9266.t1 | 0.218366 | GO: 0016491: oxidoreductase activity | none |
| 493 | 1AXg12742.t1 | 0.214329 | GO: 0004553: hydrolase activity, hydrolyzing O-glycosyl compounds; GO: 0071704: organic substance metabolic process | none |
| 494 | 1AXg6959.t1 | 0.213513 | GO: 0004190: aspartic-type endopeptidase activity; GO: 0006508: proteolysis | none |
| 495 | 1AXg936.t1 | 0.208768 | GO: 0008152: metabolic process; GO: 0019239: deaminase activity | none |
| 496 | 1AXg13882.t1 | 0.208427 | GO: 0008152: metabolic process; GO: 0016788: hydrolase activity, acting on ester bonds | KEGG Orthology: K01078: E3.1.3.2: acid phosphatase [EC: 3.1.3.2]; KEGG PATHWAY: ko00627: Aminobenzoate degradation:; KEGG PATHWAY: ko00740: Riboflavin metabolism:; KEGG PATHWAY: ko05152: Tuberculosis: Tuberculosis, or TB, is an infectious disease caused by *Mycobacterium tuberculosis*. One third of the world's population is thought to be infected with TB. About 90% of those infected result in latent infections, and about 10% of latent infections develop active diseases when their immune system is impaired due to the age, other diseases such as AIDS or exposure to immunosuppressive drugs. TB is transmitted through the air and primarily attacks the lungs, then it can spread by the circulatory system to other parts of body. Once TB bacilli have entered the host by the respiratory route and |

TABLE 700-continued

| 25 most abundant proteins secreted by SYM00577; "Median Abundance" represents the median value across three biological replicates in units of spectra per hundred spectra | | | | |
|---|---|---|---|---|
| SEQ ID | Protein ID | Median Abundance | GO Terms | KEGG Terms |
| | | | | infected macrophages in the lungs, they interfere with phagosomal maturation, antigen presentation, apoptosis and host immune system to establish persistent or latent infection. |
| 497 | 1AXg9750.t1 | 0.191554 | GO: 0005576: extracellular region; GO: 0030248: cellulose binding; GO: 0045493: xylan catabolic process; GO: 0046373: L-arabinose metabolic process; GO: 0046556: alpha-L-arabinofuranosidase activity | none |
| 498 | 1AXg6573.t1 | 0.188047 | GO: 0004568: chitinase activity; GO: 0005975: carbohydrate metabolic process; GO: 0006032: chitin catabolic process | none |
| 499 | 1AXg92.t1 | 0.186476 | GO: 0016998: cell wall macromolecule catabolic process; GO: 0052861: glucan endo-1,3-beta-glucanase activity, C-3 substituted reducing group; GO: 0052862: glucan endo-1,4-beta-glucanase activity, C-3 substituted reducing group | none |
| 500 | 1AXg9192.t1 | 0.167015 | GO: 0005975: carbohydrate metabolic process | none |
| 501 | 1AXg11043.t1 | 0.1663 | GO: 0003824: catalytic activity; GO: 0044238: primary metabolic process; GO: 0071704: organic substance metabolic process | none |

SYM00577 Versus SYM00300

TABLE 701

| Differential secreted protein abundance between SYM00577 and SYM00300. | | | | | |
|---|---|---|---|---|---|
| SEQ ID Beneficial | A.protein | SEQ ID Neutral | B.protein | KEGG | GO |
| 502 | 1AXg1022.t1 | 2297 | 1BXg8091.t1 | Biosynthesis of amino acids, Carbon metabolism, E2.2.1.2, talA, talB, Pentose phosphate pathway | carbohydrate metabolic process, cytosol, nucleus, pentose-phosphate shunt, non-oxidative branch, sedoheptulose-7-phosphate:D-glyceraldehyde-3-phosphate glyceronetransferase activity |
| 487 | 1AXg5358.t1 | 2298 | 1BXg9546.t1 | E3.2.1.3, Starch and sucrose metabolism | carbohydrate binding, hydrolase activity, acting on glycosyl bonds, polysaccharide metabolic process |
| 503 | 1AXg8841.t1 | 2299 | 1BXg1271.t1 | Cysteine and methionine metabolism, E3.3.1.1, ahcY | adenosylhomocysteinase activity, cytosol, one-carbon metabolic process, phosphatidylcholine biosynthetic process, S-adenosylhomocysteine catabolic process, triglyceride metabolic process |

TABLE 701-continued

| Differential secreted protein abundance between SYM00577 and SYM00300. | | | | | |
|---|---|---|---|---|---|
| 504 | 1AXg20808.t1 | 2300 | 1BXg8757.t1 | None | carbohydrate metabolic process, hydrolase activity, acting on glycosyl bonds, hydrolase activity, hydrolyzing O-glycosyl compounds, metabolic process |
| 505 | 1AXg10583.t1 | 2301 | 1BXg10631.t1 | None | cell wall macromolecule catabolic process, lysozyme activity, peptidoglycan catabolic process |
| 506 | 1AXg8644.t1 | 2302 | 1BXg2276.t1 | E3.1.27.1 | cytoplasmic part, ribonuclease T2 activity, RNA binding, RNA phosphodiester bond hydrolysis, endonucleolytic, single-organism cellular process |
| 507 | 1AXg360.t1 | 2303 | 1BXg8875.t1 | None | None |
| 508 | 1AXg9960.t1 | 2304 | 1BXg11250.t1 | Purine metabolism, ylbA, UGHY | None |
| 509 | 1AXg10066.t1 | 2305 | 1BXg2721.t1 | None | nuclease activity |
| 510 | 1AXg9954.t1 | 2306 | 1BXg11402.t1 | None | hydrolase activity, metabolic process |
| 511 | 1AXg11078.t1 | 2307 | 1BXg1562.t1 | None | None |
| 512 | 1AXg7160.t1 | 2308 | 1BXg550.t1 | Aminobenzoate degradation, Folate biosynthesis, phoD, Two-component system | None |
| 513 | 1AXg7978.t1 | 2309 | 1BXg10240.t1 | None | hydrolase activity |
| 514 | 1AXg8599.t1 | 2310 | 1BXg3056.t1 | None | None |
| 515 | 1AXg11864.t1 | 2311 | 1BXg8819.t1 | None | glucose metabolic process, L-xylulose reductase (NADP+) activity, mannitol 2-dehydrogenase (NADP+) activity, mitochondrion, oxidation-reduction process, protein homotetramerization, xylulose metabolic process |
| 516 | 1AXg13464.t1 | 2312 | 1BXg8758.t1 | None | hydrolase activity, metabolic process |
| 517 | 1AXg13099.t1 | 2313 | 1BXg8761.t1 | None | carbohydrate metabolic process, hydrolase activity, hydrolyzing O-glycosyl compounds, intracellular part |
| 518 | 1AXg10728.t1 | 2314 | 1BXg4259.t1 | None | hydrolase activity, metabolic process |
| 519 | 1AXg31.t1 | 2315 | 1BXg2840.t1 | gcvH, GCSH, Glycine, serine and threonine metabolism, Glyoxylate and dicarboxylate metabolism | glycine cleavage complex, glycine decarboxylation via glycine cleavage system, mitochondrion, one-carbon metabolic process, oxidation-reduction process, protein lipoylation |
| 520 | 1AXg4476.t1 | 2316 | 1BXg5721.t1 | None | endonuclease activity, exonuclease activity, nuclease activity, nucleic acid phosphodiester bond hydrolysis |
| 521 | 1AXg11059.t1 | 2317 | 1BXg2900.t1 | Fatty acid elongation, Fatty acid metabolism, Lysosome, PPT | endoplasmic reticulum, palmitoyl-(protein) hydrolase activity, protein depalmitoylation, vacuolar acidification, vacuole |
| 522 | 1AXg10328.t1 | 2318 | 1BXg8689.t1 | None | None |
| 523 | 1AXg10740.t1 | 2319 | 1BXg11987.t1 | None | cell part |
| 524 | 1AXg18392.t1 | 2320 | 1BXg11664.t1 | Adrenergic signaling in cardiomyocytes, Alcoholism, Alzheimer's disease, | ascospore-type prospore-specific spindle pole body remodeling, ATP hydrolysis coupled proton transport, barrier septum, calcium ion binding, calcium-dependent |

TABLE 701-continued

| Differential secreted protein abundance between SYM00577 and SYM00300. | | | | | |
|---|---|---|---|---|---|
| | | | | Amphetamine addiction, Calcium signaling pathway, CALM, cAMP signaling pathway, cGMP-PKG signaling pathway, Circadian entrainment, Dopaminergic synapse, Estrogen signaling pathway, Gastric acid secretion, Glioma, GnRH signaling pathway, Inflammatory mediator regulation of TRP channels, Insulin signaling pathway, Long-term potentiation, Melanogenesis, Neurotrophin signaling pathway, Olfactory transduction, Oocyte meiosis, Oxytocin signaling pathway, Pertussis, Phosphatidylinositol signaling system, Phototransduction, Phototransduction - fly, Plant-pathogen interaction, Rap1 signaling pathway, Ras signaling pathway, Salivary secretion, Tuberculosis, Vascular smooth muscle contraction | protein binding, cell budding, cell division site, cellular bud neck, cellular bud tip, central plaque of spindle pole body, cytosol, hydrogen ion transmembrane transporter activity, incipient cellular bud site, integral component of membrane, karyogamy involved in conjugation with cellular fusion, lysosomal microautophagy, maintenance of protein location in spindle pole body, mating projection tip, mitotic spindle assembly, mitotic spindle pole body, mycelium development, new growing cell tip, NLS-bearing protein import into nucleus, nucleus, old growing cell tip, phosphatidylinositol biosynthetic process, proton-transporting V-type ATPase, V0 domain, receptor-mediated endocytosis, regulation of cell cycle, spitzenkorper, spore germination, transcription factor import into nucleus, vacuole fusion, non-autophagic |
| 525 | 1AXg3446.t1 | 2321 | 1BXg4699.t1 | None | None |
| 526 | 1AXg3959.t1 | 2322 | 1BXg3931.t1 | Amino sugar and nucleotide sugar metabolism, E3.2.1.14 | hydrolase activity, hydrolyzing O-glycosyl compounds, organic substance metabolic process |
| 494 | 1AXg6959.t1 | 2323 | 1BXg7026.t1 | None | aspartic-type endopeptidase activity, proteolysis |
| 527 | 1AXg4985.t1 | 2324 | 1BXg8953.t1 | None | FMN binding, oxidation-reduction process, oxidoreductase activity |
| 528 | 1AXg4291.t1 | 2325 | 1BXg1944.t1 | E3.2.1.101 | hydrolase activity |
| 529 | 1AXg6728.t1 | 2326 | 1BXg4339.t1 | ndk, NME, Purine metabolism, Pyrimidine metabolism | ATP binding, CDP phosphorylation, cellular response to DNA damage stimulus, CTP biosynthetic process, cytosol, GTP biosynthetic process, identical protein binding, integral component of membrane, mitochondrial |

TABLE 701-continued

Differential secreted protein abundance between SYM00577 and SYM00300.

| | | | | | |
|---|---|---|---|---|---|
| | | | | | intermembrane space, nucleoside diphosphate kinase activity, nucleus, UTP biosynthetic process |
| 530 | 1AXg10268.t1 | 2327 | 1BXg2378.t1 | None | hydrolase activity, acting on glycosyl bonds, metabolic process |
| 531 | 1AXg3277.t1 | 2328 | 1BXg3155.t1 | None | hydrolase activity, membrane |
| 532 | 1AXg27.t1 | 2329 | 1BXg1583.t1 | None | acid phosphatase activity, dephosphorylation |
| 533 | 1AXg1627.t1 | 2330 | 1BXg7860.t1 | None | cell redox homeostasis, Golgi trans cisterna, integral component of plasma membrane, oligopeptide transport, oligopeptide transporter activity, peroxisome, positive regulation of monopolar cell growth, regulation of phospholipid translocation, regulation of vacuole organization, transmembrane transport, vacuole fusion, non-autophagic |
| 534 | 1AXg5235.t1 | 2331 | 1BXg2358.t1 | Antigen processing and presentation, Endocytosis, Epstein-Barr virus infection, Estrogen signaling pathway, HSPA1__8, Influenza A, Legionellosis, MAPK signaling pathway, Measles, Protein processing in endoplasmic reticulum, Spliceosome, Toxoplasmosis | ATP binding, integral component of membrane |
| 535 | 1AXg7693.t1 | 2332 | 1BXg9970.t1 | None | carbohydrate binding, carbohydrate catabolic process, hydrolase activity, hydrolyzing O-glycosyl compounds |
| 536 | 1AXg7827.t1 | 2333 | 1BXg8670.t1 | Ribosome, RP-S16e, RPS16 | ribosome, structural constituent of ribosome, translation |
| 537 | 1AXg9662.t1 | 2334 | 1BXg4876.t1 | None | integral component of membrane, transmembrane transport, transmembrane transporter activity |
| 538 | 1AXg5289.t1 | 2335 | 1BXg2280.t1 | Alanine, aspartate and glutamate metabolism, beta-Alanine metabolism, Butanoate metabolism, E4.1.1.15, gadB, gadA, GAD, GABAergic synapse, Taurine and hypotaurine metabolism, Type I diabetes mellitus | calmodulin binding, cellular response to oxidative stress, cytoplasm, glutamate catabolic process, glutamate decarboxylase activity, pyridoxal phosphate binding |
| 539 | 1AXg10486.t1 | 2336 | 1BXg1674.t1 | SLC39A1__2__3, ZIP1__2__3 | integral component of membrane, low-affinity zinc II ion transport, low-affinity zinc ion transmembrane |

TABLE 701-continued

| Differential secreted protein abundance between SYM00577 and SYM00300. | | | | | |
|---|---|---|---|---|---|
| | | | | | transporter activity, plasma membrane, zinc II ion transmembrane transport, zinc ion transmembrane transporter activity |
| 540 | 1AXg12100.t1 | 2337 | 1BXg7176.t1 | Cell cycle, Epstein-Barr virus infection, Hippo signaling pathway, Hippo signaling pathway - fly, Neurotrophin signaling pathway, Oocytemeiosis, PI3K-Akt signaling pathway, Viral carcinogenesis, YWHAE | monooxygenase activity, oxidation-reduction process, protein domain specific binding |
| 541 | 1AXg5383.t1 | 2338 | 1BXg9570.t1 | Alzheimer's disease, Biosynthesis of amino acids, Carbon fixation in photosynthetic organisms, Carbon metabolism, GAPDH, gapA, Glycolysis/ Gluconeogenesis, HIF-1 signaling pathway | glucose metabolic process, glyceraldehyde-3-phosphate dehydrogenase (NAD+) (phosphorylating) activity, glycolytic process, NAD binding, NADP binding, oxidation-reduction process |
| 542 | 1AXg10197.t1 | 2339 | 1BXg11161.t1 | E3.1.4.46, glpQ, ugpQ, Glycerophospholipid metabolism | glycerophosphodiester phosphodiesterase activity, lipid metabolic process |
| 543 | 1AXg4433.t1 | 2340 | 1BXg6768.t1 | E3.2.1.6 | hydrolase activity, hydrolyzing O-glycosyl compounds, metabolic process |
| 544 | 1AXg3932.t1 | 2341 | 1BXg3960.t1 | FoxO signaling pathway, PRMT1 | cytosol, identical protein binding, mRNA export from nucleus, negative regulation of DNA-templated transcription, termination, nucleus, peptidyl-arginine methylation, to asymmetrical-dimethyl arginine, positive regulation of transcription elongation from RNA polymerase II promoter, protein-arginine omega-N asymmetric methyltransferase activity, protein-arginine omega-N monomethyltransferase activity |
| 545 | 1AXg10561.t1 | 2342 | 1BXg1546.t1 | None | oxidoreductase activity |
| 546 | 1AXg3216.t1 | 2343 | 1BXg6110.t1 | None | lipid metabolic process, organic substance metabolic process, phosphoric diester hydrolase activity, primary metabolic process |
| 547 | 1AXg7277.t1 | 2344 | 1BXg11845.t1 | EEF1A, Legionellosis, RNA transport | cytoplasm, GTP binding, GTPase activity, translation elongation factor activity, translational elongation |
| 548 | 1AXg10803.t1 | 2345 | 1BXg2053.t1 | None | carbohydrate metabolic process, cellulose binding, extracellular region, hydrolase activity, hydrolyzing O-glycosyl compounds |

TABLE 701-continued

| Differential secreted protein abundance between SYM00577 and SYM00300. | | | | | |
|---|---|---|---|---|---|
| 549 | 1AXg6123.t1 | 2346 | 1BXg7324.t1 | None | None |
| 550 | 1AXg4834.t1 | 2347 | 1BXg4445.t1 | None | carbohydrate metabolic process, hydrolase activity, hydrolyzing O-glycosyl compounds, integral component of membrane |
| 551 | 1AXg13304.t1 | 2348 | 1BXg9661.t1 | None | carbohydrate metabolic process, hydrolase activity, hydrolyzing O-glycosyl compounds |
| 552 | 1AXg3171.t1 | 2349 | 1BXg2692.t1 | E3.2.1.4, Starch and sucrose metabolism | hydrolase activity, hydrolyzing O-glycosyl compounds, polysaccharide catabolic process |
| 553 | 1AXg7126.t1 | 2350 | 1BXg5592.t1 | Amino sugar and nucleotide sugar metabolism, Butirosin and neomycin biosynthesis, Carbohydrate digestion and absorption, Carbon metabolism, Central carbon metabolism in cancer, Fructose and mannose metabolism, Galactose metabolism, Glycolysis/ Gluconeogenesis, HIF-1 signaling pathway, HK, Insulin signaling pathway, Starch and sucrose metabolism, Streptomycin biosynthesis, Type II diabetes mellitus | ATP binding, canonical glycolysis, carbohydrate phosphorylation, cellular glucose homeostasis, cytosol, fructokinase activity, fructose 6-phosphate metabolic process, fructose import, fructose metabolic process, glucokinase activity, glucose 6-phosphate metabolic process, glucose binding, glucose import, mannokinase activity, mannose metabolic process, mitochondrion, nucleus, regulation of transcription by glucose, replicative cell aging |
| 554 | 1AXg1749.t1 | 2351 | 1BXg9726.t1 | None | None |
| 555 | 1AXg10973.t1 | 2352 | 1BXg5639.t1 | K16330, Pyrimidine metabolism | cytoplasm, endonucleolytic cleavage in 5'-ETS of tricistronic rRNA transcript (SSU-rRNA, 5.8S rRNA, LSU-rRNA), endonucleolytic cleavage in ITS1 to separate SSU-rRNA from 5.8S rRNA and LSU-rRNA from tricistronic rRNA transcript (SSU-rRNA, 5.8S rRNA, LSU-rRNA), endonucleolytic cleavage to generate mature 5'-end of SSU-rRNA from (SSU-rRNA, 5.8S rRNA, LSU-rRNA), hydrolase activity, acting on glycosyl bonds, kinase activity, phosphorylation, pseudouridine synthesis, Pwp2p-containing subcomplex of 90S preribosome, small-subunit processome |
| 556 | 1AXg2695.t1 | 2353 | 1BXg6589.t1 | None | None |
| 557 | 1AXg5845.t1 | 2354 | 1BXg1158.t1 | Ribosome, RP-S3e, RPS3 | cytoplasmic translation, cytosolic small ribosomal subunit, DNA catabolic process, endonucleolytic, DNA-(apurinic or apyrimidinic site) lyase activity, preribosome, small subunit precursor, ribosomal small subunit |

TABLE 701-continued

| Differential secreted protein abundance between SYM00577 and SYM00300. | | | | | |
|---|---|---|---|---|---|
| | | | | | export from nucleus, RNA binding, rRNA export from nucleus, structural constituent of ribosome |
| 558 | 1AXg9065.t1 | 2355 | 1BXg8585.t1 | AMPK signaling pathway, EEF2, Oxytocin signaling pathway | GTP binding, GTPase activity, integral component of membrane, translation elongation factor activity, translational elongation |
| 559 | 1AXg10539.t1 | 2356 | 1BXg6684.t1 | None | None |
| 560 | 1AXg4683.t1 | 2357 | 1BXg10580.t1 | E3.2.1.8, xynA | D-xylose metabolic process, endo-1,4-beta-xylanase activity, xylan catabolic process |
| 561 | 1AXg1198.t1 | 2358 | 1BXg352.t1 | Adherens junction, Axon guidance, Bacterial invasion of epithelial cells, cAMP signaling pathway, cGMP-PKG signaling pathway, Chemokine signaling pathway, Colorectal cancer, Endocytosis, Focal adhesion, Leukocyte transendothelial migration, MAPK signaling pathway - yeast, MicroRNAs in cancer, Neurotrophin signaling pathway, Oxytocin signaling pathway, Pancreatic secretion, Pathogenic *Escherichia coli* infection, Pathways in cancer, Pertussis, Platelet activation, Proteoglycans in cancer, Rap1 signaling pathway, Ras signaling pathway, Regulation of actin cytoskeleton, RHOA, Sphingolipid signaling pathway, T cell receptor signaling pathway, TGF-beta signaling pathway, Tight junction, Tuberculosis, Vascular smooth muscle contraction, Viral | 1,3-beta-D-glucan synthase complex, actin cytoskeleton reorganization, budding cell bud growth, cellular bud neck, cellular bud tip, Golgi apparatus, GTP binding, GTPase activity, incipient cellular bud site, mating projection tip, peroxisome, positive regulation of endocytosis, positive regulation of protein kinase C signaling, protein transport, regulation of cell size, regulation of cell wall (1->3)-beta-D-glucan biosynthetic process, regulation of exocyst localization, regulation of fungal-type cell wall organization, regulation of vacuole fusion, non-autophagic, small GTPase mediated signal transduction |

TABLE 701-continued

Differential secreted protein abundance between SYM00577 and SYM00300.

| | | | | | |
|---|---|---|---|---|---|
| 562 | 1AXg1904.t1 | 2359 | 1BXg5010.t1 | YAT | amino acid transmembrane transport, amino acid transmembrane transporter activity, integral component of membrane |
| 563 | 1AXg3176.t1 | 2360 | 1BXg4958.t1 | HXT, Meiosis - yeast | integral component of membrane, substrate-specific transmembrane transporter activity, transmembrane transport |
| 564 | 1AXg10060.t1 | 2361 | 1BXg2790.t1 | E3.2.1.8, xynA | endo-1,4-beta-xylanase activity, xylan catabolic process |
| 565 | 1AXg5709.t1 | 2362 | 1BXg9980.t1 | 2-Oxocarboxylic acid metabolism, Biosynthesis of amino acids, C5-Branched dibasic acid metabolism, leuB, Valine, leucine and isoleucine biosynthesis | 3-isopropylmalate dehydrogenase activity, ATP binding, ATP hydrolysis coupled proton transport, ATP metabolic process, cytosol, glyoxylate cycle, leucine biosynthetic process, magnesium ion binding, NAD binding, oxidation-reduction process, proton-transporting ATPase activity, rotational mechanism, proton-transporting V-type ATPase, V1 domain |
| 566 | 1AXg8275.t1 | 2363 | 1BXg5365.t1 | None | None |
| 567 | 1AXg1909.t1 | 2364 | 1BXg6126.t1 | None | peptidase activity |
| 568 | 1AXg4752.t1 | 2365 | 1BXg2001.t1 | AMPK signaling pathway, Pancreatic secretion, RAB8A, MEL | ascospore-type prospore assembly, autophagy, cytosol, exocytosis, Golgi to plasma membrane transport, GTP binding, GTPase activity, incipient cellular bud site, intracellular protein transport, membrane, membrane addition at site of cytokinesis, metabolic process, nucleocytoplasmic transport, nucleus, small GTPase mediated signal transduction, transport vesicle, vesicle fusion |
| 569 | 1AXg3765.t1 | 2366 | 1BXg2666.t1 | None | catalytic activity, integral component of membrane, metabolic process |
| 570 | 1AXg2891.t1 | 2367 | 1BXg10882.t1 | None | carboxypeptidase activity, metallocarboxypeptidase activity, proteolysis, zinc ion binding |
| 478 | 1AXg10805.t1 | 2368 | 1BXg9667.t1 | None | carbohydrate metabolic process, cellulose binding, extracellular region, glucosylceramidase activity, sphingolipid metabolic process |
| 571 | 1AXg5891.t1 | 2369 | 1BXg10979.t1 | E5.2.1.8 | apoptotic process, cytosol, mitochondrion, nucleus, peptidyl-prolyl cis-trans isomerase activity, protein folding, protein peptidyl-prolyl isomerization |
| 572 | 1AXg10065.t1 | 2370 | 1BXg2722.t1 | None | None |
| 573 | 1AXg19725.t1 | 2371 | 1BXg7679.t1 | Ribosome, RP-L7e, RPL7 | ribosome |
| 574 | 1AXg20723.t1 | 2372 | 1BXg2050.t1 | None | integral component of membrane, transmembrane transport, transmembrane transporter activity |
| 575 | 1AXg21175.t1 | 2373 | 1BXg6238.t1 | Ribosome, RP-L13Ae, RPL13A | large ribosomal subunit, structural constituent of ribosome, translation |

TABLE 701-continued

| Differential secreted protein abundance between SYM00577 and SYM00300. | | | | | |
|---|---|---|---|---|---|
| 576 | 1AXg2292.t1 | 2374 | 1BXg10710.t1 | ARN | integral component of membrane, transmembrane transport |
| 577 | 1AXg1391.t1 | 2375 | 1BXg3917.t1 | None | cytosol, nucleus, proteolysis, serine-type peptidase activity |
| 578 | 1AXg8174.t1 | 2376 | 1BXg7986.t1 | None | catalytic activity, cell, cell redox homeostasis, glycerol ether metabolic process, integral component of membrane, membrane, oxidation-reduction process, protein disulfide oxidoreductase activity, single-organism cellular process, single-organism metabolic process, translation |
| 480 | 1AXg3149.t1 | 2377 | 1BXg4998.t1 | E3.2.1.67, Pentose and glucuronate interconversions, Starch and sucrose metabolism | carbohydrate metabolic process, cell wall organization, extracellular region, hydrolase activity, acting on glycosyl bonds, polygalacturonase activity |
| 579 | 1AXg4184.t1 | 2378 | 1BXg1792.t1 | None | integral component of membrane |
| 580 | 1AXg5751.t1 | 2379 | 1BXg7894.t1 | Carbohydrate digestion and absorption, E3.2.1.1, amyA, malS, Starch and sucrose metabolism | alpha-amylase activity, carbohydrate metabolic process, cation binding, oxidation-reduction process, oxidoreductase activity, starch binding |
| 581 | 1AXg10745.t1 | 2380 | 1BXg11993.t1 | None | None |
| 582 | 1AXg8977.t1 | 2381 | 1BXg11388.t1 | TC.POT | integral component of membrane, oligopeptide transport, transporter activity |
| 583 | 1AXg2503.t1 | 2382 | 1BXg3531.t1 | Amino sugar and nucleotide sugar metabolism, Galactose metabolism, Glycolysis/ Gluconeogenesis, Pentose phosphate pathway, pgm, Purine metabolism, Starch and sucrose metabolism, Streptomycin biosynthesis | carbohydrate metabolic process, intramolecular transferase activity, phosphotransferases, magnesium ion binding, nucleus |
| 584 | 1AXg3358.t1 | 2383 | 1BXg4769.t1 | None | None |
| 585 | 1AXg8317.t1 | 2384 | 1BXg5117.t1 | None | None |
| 586 | 1AXg4278.t1 | 2385 | 1BXg1931.t1 | AFG1, LACE1, zapE | ATP binding, cellular response to oxidative stress, misfolded or incompletely synthesized protein catabolic process, mitochondrial inner membrane, protein import into peroxisome matrix |
| 587 | 1AXg11050.t1 | 2386 | 1BXg2887.t1 | None | proteolysis, serine-type carboxypeptidase activity |
| 588 | 1AXg8247.t1 | 2387 | 1BXg10032.t1 | Biosynthesis of amino acids, Carbon fixation in photosynthetic organisms, Carbon metabolism, Fructose and mannose | canonical glycolysis, gluconeogenesis, mitochondrion, nucleus, pentose-phosphate shunt, triose-phosphate isomerase activity |

TABLE 701-continued

Differential secreted protein abundance between SYM00577 and SYM00300.

| | | | | | |
|---|---|---|---|---|---|
| | | | | metabolism, Glycolysis/ Gluconeogenesis, Inositol phosphate metabolism, TPI, tpiA | |
| 589 | 1AXg5531.t1 | 2388 | 1BXg11344.t1 | E3.2.1.6 | carbohydrate metabolic process, hydrolase activity, hydrolyzing O-glycosyl compounds |
| 590 | 1AXg9521.t1 | 2389 | 1BXg6591.t1 | None | cellular aromatic compound metabolic process, ferric iron binding, integral component of membrane, oxidation-reduction process, oxidoreductase activity, acting on single donors with incorporation of molecular oxygen, incorporation of two atoms of oxygen |
| 591 | 1AXg11377.t1 | 2390 | 1BXg307.t1 | XEG | carbohydrate etabolicm process, hydrolase activity, acting on glycosyl bonds, hydrolase activity, hydrolyzing O-glycosyl compounds |
| 592 | 1AXg7658.t1 | 2391 | 1BXg7553.t1 | Cysteine and methionine metabolism, E1.8.4.14 | cellular response to, oxidative stress, cytoplasm, methionine-R-sulfoxide reductase activity, oxidation-reduction process |
| 593 | 1AXg1255.t1 | 2392 | 1BXg439.t1 | None | None |
| 594 | 1AXg11060.t1 | 2393 | 1BXg1582.t1 | None | integral component of membrane, transmembrane transport |
| 595 | 1AXg6907.t1 | 2394 | 1BXg8642.t1 | None | None |
| 596 | 1AXg1976.t1 | 2395 | 1BXg6237.t1 | None | intracellular ribonucleoprotein complex |
| 597 | 1AXg10216.t1 | 2396 | 1BXg11971.t1 | None | cell redox homeostasis, cellular response to oxidative stress, glutathione peroxidase activity, mitochondrion, oxidation-reduction process, response to cadmium ion, thioredoxin peroxidase activity |
| 598 | 1AXg8251.t1 | 2397 | 1BXg10028.t1 | None | hydrolase activity, acting on carbon-nitrogen (but not peptide) bonds, metabolic process |
| 599 | 1AXg6457.t1 | 2398 | 1BXg5328.t1 | None | integral component of membrane, membrane, transmembrane transport |
| 600 | 1AXg11201.t1 | 2399 | 1BXg8976.t1 | None | None |
| 601 | 1AXg21445.t1 | 2400 | 1BXg11743.t1 | Ribosome, RP-SAe, RPSA | cytosolic small ribosomal subunit, ribosomal small subunit assembly, structural constituent of ribosome, translation |
| 602 | 1AXg12610.t1 | 2401 | 1BXg3489.t1 | None | acid phosphatase activity, dephosphorylation, integral component of membrane |
| 603 | 1AXg81.t1 | 2402 | 1BXg10975.t1 | None | None |
| 604 | 1AXg3188.t1 | 2403 | 1BXg9954.t1 | None | None |
| 605 | 1AXg7341.t1 | 2404 | 1BXg10389.t1 | None | None |
| 606 | 1AXg8340.t1 | 2405 | 1BXg5140.t1 | Oxidative phosphorylation, ppa | aerobic respiration, cellular metabolic process, cytoplasm, inorganic diphosphatase activity, magnesium ion binding, mitochondrion, phosphate-containing compound metabolic process |

TABLE 701-continued

| Differential secreted protein abundance between SYM00577 and SYM00300. | | | | | |
|---|---|---|---|---|---|
| 607 | 1AXg6585.t1 | 2406 | 1BXg10114.t1 | FTR, efeU | high-affinity iron ion transmembrane transport, high-affinity iron permease complex, integral component of membrane, iron ion transmembrane transporter activity, metabolic process, transferase activity |
| 608 | 1AXg1785.t1 | 2407 | 1BXg1175.t1 | Amino sugar and nucleotide sugar metabolism, Glycosaminoglycan degradation, Glycosphingolipid biosynthesis-ganglio series, Glycosphingolipid biosynthesis-globo series, HEXA_B, Lysosome, Other glycan degradation | beta-N-acetylhexosaminidase activity, carbohydrate metabolic process |
| 609 | 1AXg2827.t1 | 2408 | 1BXg9091.t1 | map | aminopeptidase activity, fumagillin biosynthetic process, metal ion binding, metalloexopeptidase activity, proteolysis |
| 610 | 1AXg3285.t1 | 2409 | 1BXg8264.t1 | None | cell part |
| 611 | 1AXg7102.t1 | 2410 | 1BXg5569.t1 | None | None |
| 612 | 1AXg9751.t1 | 2411 | 1BXg1036.t1 | E3.6.3.6, Oxidative phosphorylation | ATP binding, ATP biosynthetic process, hydrogen ion transmembrane transport, hydrogen-exporting ATPase activity, phosphorylative mechanism, integral component of membrane, metal ion binding |
| 613 | 1AXg3114.t1 | 2412 | 1BXg11816.t1 | None | hydrolase activity, positive regulation of translation, positive regulation of translational elongation, positive regulation of translational termination, ribosome binding, RNA binding, translation elongation factor activity, translational elongation, translational frameshifting |
| 614 | 1AXg2047.t1 | 2413 | 1BXg2549.t1 | None | carbohydrate metabolic process, cell wall, cell wall organization, hydrolase activity, hydrolyzing O-glycosyl compounds, transferase activity |
| 615 | 1AXg524.t1 | 2414 | 1BXg8254.t1 | None | integral component of membrane, transmembrane transport |
| 616 | 1AXg5090.t1 | 2415 | 1BXg2954.t1 | SNARE interactions in vesicular transport, STX1B_2_3, Synaptic vesicle cycle | integral component of membrane, vesicle-mediated transport |
| 617 | 1AXg6524.t1 | 2416 | 1BXg2065.t1 | Alzheimer's disease, Cardiac muscle contraction, Huntington's disease, Non-alcoholic fatty liver disease (NAFLD), Oxidative phosphorylation, | 2 iron, 2 sulfur cluster binding, aerobic respiration, hydrogen ion transmembrane transport, metal ion binding, mitochondrial electron transport, ubiquinol to cytochrome c, mitochondrial respiratory chain complex III, ubiquinol-cytochrome-c reductase |

TABLE 701-continued

Differential secreted protein abundance between SYM00577 and SYM00300.

| | | | | | |
|---|---|---|---|---|---|
| | | | | Parkinson's disease, Two-component system, UQCRFS1, RIP1, petA | activity |
| 618 | 1AXg9485.t1 | 2417 | 1BXg5765.t1 | None | ATP binding, ATPase activity, endoplasmic reticulum, integral component of membrane, metabolic process |
| 619 | 1AXg3460.t1 | 2418 | 1BXg4685.t1 | Biosynthesis of amino acids, hisG, Histidine metabolism | ATP phosphoribosyltransferase activity, cytosol, histidine biosynthetic process, magnesium ion binding |
| 620 | 1AXg3259.t1 | 2419 | 1BXg8229.t1 | PMPCB, MAS1 | metal ion binding, metalloendopeptidase activity, mitochondrial processing peptidase complex, protein processing involved in protein targeting to mitochondrion |
| 621 | 1AXg7607.t1 | 2420 | 1BXg7629.t1 | None | integral component of membrane |
| 622 | 1AXg3160.t1 | 2421 | 1BXg1334.t1 | PHO84 | inorganic phosphate transmembrane transporter activity, integral component of membrane, phosphate ion transport, transmembrane transport |
| 623 | 1AXg459.t1 | 2422 | 1BXg8019.t1 | E3.2.1.101 | catalytic activity, membrane |
| 624 | 1AXg11134.t1 | 2423 | 1BXg6417.t1 | None | cytoplasmic part, endomembrane system, integral component of membrane, intracellular membrane-bounded organelle, transmembrane transport |
| 625 | 1AXg14833.t1 | 2424 | 1BXg6900.t1 | Calcium signaling pathway, cGMP-PKG signaling pathway, HTLV-I infection, Huntington's disease, Parkinson's disease, SLC25A4S, ANT | ADP transport, ATP:ADP antiporter activity, DNA repair, integral component of membrane, kinetochore assembly, mitochondrial ATP transmembrane transport, mitochondrial inner membrane |
| 626 | 1AXg2308.t1 | 2425 | 1BXg10725.t1 | None | NAD(P)+ transhydrogenase activity, single-organism process |
| 627 | 1AXg7369.t1 | 2426 | 1BXg10420.t1 | SLC25A23S | 3'-phospho-5'-adenylyl sulfate transmembrane transport, 3'-phosphoadenosine 5'-phosphosulfate transmembrane transporter activity, 5'-adenylyl sulfate transmembrane transport, 5'-adenylyl sulfate transmembrane transporter activity, integral component of membrane, intracellular ribonucleoprotein complex, mitochondrion, ribosome, structural constituent of ribosome, translation |
| 628 | 1AXg1858.t1 | 2427 | 1BXg1886.t1 | None | intracellular part |
| 629 | 1AXg8166.t1 | 2428 | 1BXg7974.t1 | None | membrane |
| 630 | 1AXg2960.t1 | 2429 | 1BXg5945.t1 | None | None |
| 631 | 1AXg4213.t1 | 2430 | 1BXg1766.t1 | None | membrane |
| 632 | 1AXg4083.t1 | 2431 | 1BXg3283.t1 | None | integral component of membrane, plasma membrane, transport |
| 633 | 1AXg3175.t1 | 2432 | 1BXg2690.t1 | E3.2.1.— | carbohydrate metabolic process, cellulose binding, extracellular region, |

TABLE 701-continued

Differential secreted protein abundance between SYM00577 and SYM00300.

| | | | | | |
|---|---|---|---|---|---|
| | | | | | hydrolase activity, hydrolyzing O-glycosyl compounds |
| 634 | 1AXg11576.t1 | 2433 | 1BXg11481.t1 | None | flavin adenine dinucleotide binding, oxidation-reduction process, oxidoreductase activity, acting on CH—OH group of donors |
| 635 | 1AXg511.t1 | 2434 | 1BXg3351.t1 | None | oxidoreductase activity |
| 636 | 1AXg8734.t1 | 2435 | 1BXg11562.t1 | None | chitin binding, chitin catabolic process, chitinase activity, extracellular region, pathogenesis, polysaccharide catabolic process |
| 637 | 1AXg6748.t1 | 2436 | 1BXg4362.t1 | E3.2.1.58, Starch and sucrose metabolism | endoplasmic reticulum, fungal-type cell wall beta-glucan biosynthetic process, glucan endo-1,6-beta-glucosidase activity, integral component of membrane, regulation of cell shape |
| 638 | 1AXg10079.t1 | 2437 | 1BXg2701.t1 | HSPA5, BIP, Prion diseases, Protein export, Protein processing in endoplasmic reticulum, Thyroid hormone synthesis | 'de novo' posttranslational protein folding, ATP binding, ATPase activity, ER-associated ubiquitin-dependent protein catabolic process, Golgi apparatus, karyogamy involved in conjugation with cellular fusion, luminal surveillance complex, nuclear membrane, posttranslational protein targeting to membrane, translocation, response to unfolded protein, SRP-dependent cotranslational protein targeting to membrane, translocation, unfolded protein binding |
| 639 | 1AXg10129.t1 | 2438 | 1BXg8487.t1 | None | None |
| 482 | 1AXg10578.t1 | 2439 | 1BXg12089.t1 | None | aspartic-type endopeptidase activity, proteolysis |
| 640 | 1AXg12554.t1 | 2440 | 1BXg3576.t1 | Ribosome, RP-S13e, RPS13 | cytoplasmic translation, cytosolic small ribosomal subunit, maturation of SSU-rRNA from tricistronic rRNA transcript (SSU-rRNA, 5.8S rRNA, LSU-rRNA), mycelium development, small ribosomal subunit rRNA binding, structural constituent of ribosome |
| 641 | 1AXg15417.t1 | 2441 | 1BXg6538.t1 | Protein processing in endoplasmic reticulum, UBE2D_E, UBC4, UBC5, Ubiquitin mediated proteolysis | acid-amino acid ligase activity, APC-Cdc20 complex activity, ATP binding, cytosol, nuclear SCF ubiquitin ligase complex, positive regulation of mitotic metaphase/anaphase transition, protein processing, protein ubiquitination involved in ubiquitin-dependent protein catabolic process, SCF-dependent proteasomal ubiquitin-dependent protein catabolic process, ubiquitin conjugating enzyme activity |
| 642 | 1AXg4473.t1 | 2442 | 1BXg9969.t1 | SLC39A1_2_3, ZIP1_2_3 | cellular response to zinc ion starvation, endoplasmic reticulum, high-affinity zinc II ion transport, high-affinity |

TABLE 701-continued

Differential secreted protein abundance between SYM00577 and SYM00300.

| | | | | | |
|---|---|---|---|---|---|
| | | | | | zinc uptake transmembrane transporter activity, integral component of plasma membrane, regulation of transcription from RNA polymerase II promoter in response to iron ion starvation |
| 643 | 1AXg13171.t1 | 2443 | 1BXg1289.t1 | E3.2.1.28, treA, treF, Starch and sucrose metabolism | alpha,alpha-trehalase activity, trehalose metabolic process |
| 644 | 1AXg4544.t1 | 2444 | 1BXg4073.t1 | Ribosome, RP-L9e, RPL9 | ribosome, rRNA binding, structural constituent of ribosome, translation |
| 645 | 1AXg13885.t1 | 2445 | 1BXg12241.t1 | Ether lipid metabolism, Glycerophospholipid metabolism, Inositol phosphate metabolism, plcC, Thyroid hormone signaling pathway | hydrolase activity, acting on ester bonds, metabolic process |
| 646 | 1AXg8079.t1 | 2446 | 1BXg7852.t1 | None | hydrolase activity, metabolic process |
| 647 | 1AXg1002.t1 | 2447 | 1BXg8071.t1 | Alzheimer's disease, ATPeFOD, ATP5H, ATP7, Huntington's disease, Oxidative phosphorylation, Parkinson's disease | ATP synthesis coupled proton transport, mitochondrial proton-transporting ATP synthase, stator stalk, protein complex assembly, proton-transporting ATP synthase activity, rotational mechanism, proton-transporting ATPase activity, rotational mechanism |
| 648 | 1AXg14938.t1 | 2448 | 1BXg3779.t1 | ARF1, Endocytosis, Legionellosis, Vibrio cholerae infection | Golgi apparatus, GTP binding, hydrolase activity, intracellular protein transport, metabolic process, small GTPase mediated signal transduction |
| 649 | 1AXg2148.t1 | 2449 | 1BXg11881.t1 | Adherens junction, Amyotrophic lateral sclerosis (ALS), Axon guidance, B cell receptor signaling pathway, Bacterial invasion of epithelial cells, cAMP signaling pathway, Chemokine signaling pathway, Choline metabolism in cancer, Colorectal cancer, Epithelial cell signaling in *Helicobacter pylori* infection, Fc epsilon RI signaling pathway, Fc gamma R-mediated phagocytosis, | ascospore formation, cell division, conidium formation, developmental pigmentation, endomembrane system, fungal-type vacuole membrane, GTP binding, GTPase activity, intracellular protein transport, metabolic process, nucleocytoplasmic transport, pathogenesis, plasma membrane, small GTPase mediated signal transduction |

TABLE 701-continued

Differential secreted protein abundance between SYM00577 and SYM00300.

| | | | | | |
|---|---|---|---|---|---|
| | | | | Focal adhesion, Leukocyte transendothelial migration, MAPK signaling pathway, Natural killer cell mediated cytotoxicity, Neurotrophin signaling pathway, Non-alcoholic fatty liver disease (NAFLD), Osteoclast differentiation, Pancreatic cancer, Pancreatic secretion, Pathways in cancer, Phagosome, PI3K-Akt signaling pathway, Proteoglycans in cancer, RAC1, Rap1 signaling pathway, Ras signaling | |
| 650 | 1AXg7481.t1 | 2450 | 1BXg6855.t1 | None | integral component of membrane, membrane, transmembrane transport |
| 651 | 1AXg9624.t1 | 2451 | 1BXg7238.t1 | None | anchored component of membrane, carbohydrate metabolic process, fungal-type cell wall, hydrolase activity, plasma membrane, transferase activity |
| 652 | 1AXg7771.t1 | 2452 | 1BXg7838.t1 | None | proteolysis, serine-type endopeptidase activity |
| 653 | 1AXg1042.t1 | 2453 | 1BXg8113.t1 | None | membrane |
| 654 | 1AXg10247.t1 | 2454 | 1BXg3602.t1 | None | None |
| 493 | 1AXg12742.t1 | 2455 | 1BXg2905.t1 | None | hydrolase activity, hydrolyzing O-glycosyl compounds, mycelium development, organic substance metabolic process |
| 655 | 1AXg15299.t1 | 2456 | 1BXg10457.t1 | K07975 | cellular bud, cytosol, establishment or maintenance of actin cytoskeleton polarity, establishment or maintenance of cell polarity regulating cell shape, GTP binding, GTPase activity, membrane, metabolic process, microtubule cytoskeleton organization, nucleus, positive regulation of exocytosis, positive regulation of formin-nucleated actin cable assembly, protein transport, regulation of cell separation after cytokinesis, small GTPase mediated signal transduction |
| 656 | 1AXg16181.t1 | 2457 | 1BXg12075.t1 | E3.2.1.101 | carbohydrate catabolic process, hydrolase activity, mannan endo-1,6-alpha-mannosidase activity |
| 657 | 1AXg4820.t1 | 2458 | 1BXg705.t1 | None | None |
| 658 | 1AXg4879.t1 | 2459 | 1BXg4499.t1 | Amoebiasis, Endocytosis, | cytosol, fungal-type vacuole membrane, GTP binding, |

TABLE 701-continued

| Differential secreted protein abundance between SYM00577 and SYM00300. | | | | | |
|---|---|---|---|---|---|
| | | | | Phagosome, RAB7A, *Salmonella* infection, Tuberculosis | GTPase activity, intracellular protein transport, mitochondrial outer membrane, nucleocytoplasmic transport, piecemeal microautophagy of nucleus, plasma membrane, positive regulation of vacuole fusion, non-autophagic, protein localization to vacuole, regulation of endocytosis, retrograde transport, endosome to Golgi, small GTPase mediated signal transduction, vacuolar acidification, vacuole inheritance, vesicle fusion with vacuole |
| 659 | 1AXg5864.t1 | 2460 | 1BXg10898.t1 | APRT, apt, Purine metabolism | adenine phosphoribosyltransferase activity, adenine salvage, AMP salvage, cytosol |
| 660 | 1AXg8547.t1 | 2461 | 1BXg10270.t1 | Ribosome, RPL10Ae, RPL10A | large ribosomal subunit, RNA binding, structural constituent of ribosome, translation |
| 661 | 1AXg2128.t1 | 2462 | 1BXg11919.t1 | None | carboxypeptidase activity, membrane |
| 662 | 1AXg7452.t1 | 2463 | 1BXg6885.t1 | cdd, CDA, Drug metabolism - other enzymes, Pyrimidine metabolism | cytidine deaminase activity, cytidine deamination, cytoplasm, zinc ion binding |
| 663 | 1AXg4563.t1 | 2464 | 1BXg4094.t1 | ribH, RIB4, Riboflavin metabolism | 6,7-dimethyl-8-ribityllumazine synthase activity, mitochondrial intermembrane space, riboflavin binding, riboflavin biosynthetic process, riboflavin synthase complex, transferase activity |
| 664 | 1AXg10907.t1 | 2465 | 1BXg5915.t1 | None | cytosol, GU repeat RNA binding, intracellular part, microsatellite binding, nucleus, RNA binding, sequence-specific DNA binding, single-stranded telomeric DNA binding |
| 665 | 1AXg4299.t1 | 2466 | 1BXg1953.t1 | Acute myeloid leukemia, Alcoholism, Aldosterone-regulated sodium reabsorption, Axon guidance, B cell receptor signaling pathway, Bladder cancer, Central carbon metabolism in cancer, Chemokine signaling pathway, Choline metabolism in cancer, Cholinergic synapse, Chronic myeloid leukemia, Colorectal cancer, Dorso- | GTP binding, GTPase activity, intracellular, intracellular protein transport, metabolic process, nucleocytoplasmic transport, plasma membrane, small GTPase mediated signal transduction |

TABLE 701-continued

Differential secreted protein abundance between SYM00577 and SYM00300.

| | | | | | |
|---|---|---|---|---|---|
| | | | | ventral axis formation, Endometrial cancer, ErbB signaling pathway, Estrogen signaling pathway, Fc epsilon RI signaling pathway, FoxO signaling pathway, Gap junction, Glioma, GnRH signaling pathway, Hepatitis B, Hepatitis C, HTLV-I infection, Insulin signaling pathway, KRAS, KRAS2, Long-term depression, Long-term potentiation, MAPK signaling pathway, MAPK signaling pathway - fly, Melanogenesis, Melanoma, MicroRNAs in cancer, Natural killer cell mediated | |
| 666 | 1AXg9261.t1. | 2467 | 1BXg10439.t1 | E3.4.21.48 | dibasic protein processing, serine-type endopeptidase activity |
| 667 | 1AXg9193.t1 | 2468 | 1BXg8760.t1 | None | chitosanase activity, extracellular region, polysaccharide catabolic process |
| 668 | 1AXg4669.t1 | 2469 | 1BXg10567.t1 | None | hydrolase activity, acting on carbon-nitrogen (but not peptide) bonds, integral component of membrane, metabolic process |
| 669 | 1AXg19989.t1 | 2470 | 1BXg9824.t1 | glgB, Starch and sucrose metabolism | 1,4-alpha-glucan branching enzyme activity, ATP binding, ATP hydrolysis coupled proton transport, ATP synthesis coupled proton transport, cation binding, cytoplasm, glycogen biosynthetic process, hydrolase activity, hydrolyzing O-glycosyl compounds, proton-transporting ATP synthase activity, rotational mechanism, proton-transporting ATP synthase complex, catalytic core F(1) |
| 670 | 1AXg2882.t1 | 2471 | 1BXg10869.t1 | Glycerophospholipid metabolism, PLB | lysophospholipase activity, phospholipid catabolic process |
| 671 | 1AXg5521.t1 | 2472 | 1BXg1647.t1 | Ribosome, RPS4e, RPS4 | ribosome, rRNA binding, structural constituent of ribosome, translation |
| 672 | 1AXg2908.t1 | 2473 | 1BXg6003.t1 | AXL2 | None |
| 673 | 1AXg6960.t1 | 2474 | 1BXg9737.t1 | None | aspartic-type endopeptidase activity, proteolysis |

TABLE 701-continued

Differential secreted protein abundance between SYM00577 and SYM00300.

| SEQ ID Beneficial | A.mean | B.mean | Fold-change | absFC | FDR q-value |
|---|---|---|---|---|---|
| 502 | 0 | 0.37 | −8.5 | 8.5 | 0.03 |
| 487 | 0.3 | 0 | 8.2 | 8.2 | 0.02 |
| 503 | 0 | 0.24 | −7.9 | 7.9 | 0.01 |
| 504 | 0 | 0.24 | −7.9 | 7.9 | 0.02 |
| 505 | 0.16 | 0 | 7.4 | 7.4 | 0.05 |
| 506 | 0 | 0.13 | −7.1 | 7.1 | 0.02 |
| 507 | 0 | 0.12 | −6.9 | 6.9 | 0.01 |
| 508 | 0 | 0.12 | −6.9 | 6.9 | 0.02 |
| 509 | 0 | 0.12 | −6.9 | 6.9 | 0.03 |
| 510 | 0 | 0.12 | −6.9 | 6.9 | 0.04 |
| 511 | 0 | 0.1 | −6.7 | 6.7 | 0.02 |
| 512 | 0 | 0.1 | −6.7 | 6.7 | 0.02 |
| 513 | 0 | 0.09 | −6.6 | 6.6 | 0.02 |
| 514 | 0.1 | 0 | 6.6 | 6.6 | 0.02 |
| 515 | 0 | 0.1 | −6.6 | 6.6 | 0.02 |
| 516 | 0 | 0.09 | −6.6 | 6.6 | 0.02 |
| 517 | 0 | 0.09 | −6.5 | 6.5 | 0.02 |
| 518 | 0.09 | 0 | 6.5 | 6.5 | 0.05 |
| 519 | 0 | 0.08 | −6.4 | 6.4 | 0.02 |
| 520 | 0 | 0.09 | −6.4 | 6.4 | 0.02 |
| 521 | 0.08 | 0 | 6.3 | 6.3 | 0.02 |
| 522 | 0 | 0.06 | −6 | 6 | 0.01 |
| 523 | 0 | 0.24 | −6 | 6 | 0.02 |
| 524 | 0 | 0.06 | −6 | 6 | 0.03 |
| 525 | 0 | 0.06 | −6 | 6 | 0.03 |
| 526 | 0 | 0.06 | −6 | 6 | 0.04 |
| 494 | 0.23 | 0 | 5.9 | 5.9 | 0.02 |
| 527 | 0 | 0.06 | −5.9 | 5.9 | 0.04 |
| 528 | 0.05 | 0 | 5.8 | 5.8 | 0.02 |
| 529 | 0 | 0.06 | −5.8 | 5.8 | 0.02 |
| 530 | 0.05 | 0 | 5.8 | 5.8 | 0.02 |
| 531 | 0.06 | 0 | 5.8 | 5.8 | 0.03 |
| 532 | 0 | 0.05 | −5.8 | 5.8 | 0.04 |
| 533 | 0 | 0.05 | −5.7 | 5.7 | 0.02 |
| 534 | 0 | 0.05 | −5.7 | 5.7 | 0.02 |
| 535 | 0 | 0.05 | −5.7 | 5.7 | 0.03 |
| 536 | 0 | 0.05 | −5.6 | 5.6 | 0.02 |
| 537 | 0 | 0.05 | −5.6 | 5.6 | 0.02 |
| 538 | 0 | 0.05 | −5.6 | 5.6 | 0.02 |
| 539 | 0 | 0.05 | −5.6 | 5.6 | 0.03 |
| 540 | 0 | 0.05 | −5.6 | 5.6 | 0.03 |
| 541 | 0 | 0.05 | −5.5 | 5.5 | 0.02 |
| 542 | 0 | 0.04 | −5.4 | 5.4 | 0.01 |
| 543 | 0 | 0.04 | −5.4 | 5.4 | 0.04 |
| 544 | 0 | 0.04 | −5.4 | 5.4 | 0.04 |
| 545 | 0 | 0.04 | −5.3 | 5.3 | 0.02 |
| 546 | 0 | 0.04 | −5.3 | 5.3 | 0.05 |
| 547 | 0 | 0.04 | −5.2 | 5.2 | 0.02 |
| 548 | 0 | 0.04 | −5.2 | 5.2 | 0.02 |
| 549 | 0 | 0.04 | −5.2 | 5.2 | 0.02 |
| 550 | 0.03 | 0 | 5.1 | 5.1 | 0.02 |
| 551 | 0.01 | 0.19 | −5 | 5 | 0.01 |
| 552 | 0 | 0.03 | −5 | 5 | 0.02 |
| 553 | 0 | 0.03 | −5 | 5 | 0.04 |
| 554 | 0 | 0.03 | −4.9 | 4.9 | 0.02 |
| 555 | 0 | 0.03 | −4.9 | 4.9 | 0.02 |
| 556 | 0 | 0.03 | −4.9 | 4.9 | 0.03 |
| 557 | 0 | 0.03 | −4.9 | 4.9 | 0.04 |
| 558 | 0 | 0.03 | −4.9 | 4.9 | 0.04 |
| 559 | 0 | 0.03 | −4.8 | 4.8 | 0.02 |
| 560 | 0 | 0.03 | −4.8 | 4.8 | 0.02 |
| 561 | 0 | 0.03 | −4.8 | 4.8 | 0.04 |
| 562 | 0 | 0.03 | −4.7 | 4.7 | 0.02 |
| 563 | 0 | 0.02 | −4.6 | 4.6 | 0.02 |
| 564 | 0 | 0.02 | −4.5 | 4.5 | 0.02 |
| 565 | 0 | 0.02 | −4.5 | 4.5 | 0.02 |
| 566 | 0.02 | 0 | 4.5 | 4.5 | 0.02 |
| 567 | 0.02 | 0 | 4.5 | 4.5 | 0.03 |
| 568 | 0 | 0.02 | −4.5 | 4.5 | 0.03 |
| 569 | 0 | 0.02 | −4.4 | 4.4 | 0.02 |
| 570 | 0 | 0.02 | −4.4 | 4.4 | 0.03 |
| 478 | 0.98 | 0.05 | 4.4 | 4.4 | 0.04 |
| 571 | 0 | 0.02 | −4.4 | 4.4 | 0.05 |
| 572 | 0.36 | 0.02 | 4.3 | 4.3 | 0.02 |
| 573 | 0 | 0.02 | −4.3 | 4.3 | 0.02 |

TABLE 701-continued

Differential secreted protein abundance between SYM00577 and SYM00300.

| | | | | | |
|---|---|---|---|---|---|
| 574 | 0 | 0.02 | −4.3 | 4.3 | 0.02 |
| 575 | 0 | 0.02 | −4.3 | 4.3 | 0.04 |
| 576 | 0 | 0.02 | −4.2 | 4.2 | 0.01 |
| 577 | 0 | 0.02 | −4.2 | 4.2 | 0.05 |
| 578 | 0 | 0.02 | −4.1 | 4.1 | 0.03 |
| 480 | 0.55 | 0.03 | 4 | 4 | 0.02 |
| 579 | 0.02 | 0 | 4 | 4 | 0.03 |
| 580 | 0.02 | 0 | 4 | 4 | 0.03 |
| 581 | 0.02 | 0 | 4 | 4 | 0.03 |
| 582 | 0 | 0.02 | −4 | 4 | 0.04 |
| 583 | 0 | 0.02 | −4 | 4 | 0.05 |
| 584 | 0 | 0.07 | −3.9 | 3.9 | 0 |
| 585 | 0 | 0.07 | −3.9 | 3.9 | 0 |
| 586 | 0 | 0.01 | −3.9 | 3.9 | 0.02 |
| 587 | 0.06 | 0 | 3.9 | 3.9 | 0.03 |
| 588 | 0.01 | 0.09 | −3.9 | 3.9 | 0.04 |
| 589 | 0 | 0.01 | −3.8 | 3.8 | 0.02 |
| 590 | 0 | 0.01 | −3.8 | 3.8 | 0.02 |
| 591 | 0 | 0.01 | −3.8 | 3.8 | 0.03 |
| 592 | 0 | 0.01 | −3.8 | 3.8 | 0.04 |
| 593 | 0.14 | 0.01 | 3.8 | 3.8 | 0.04 |
| 594 | 0 | 0.01 | −3.7 | 3.7 | 0.02 |
| 595 | 0.01 | 0 | 3.7 | 3.7 | 0.02 |
| 596 | 0.01 | 0 | 3.7 | 3.7 | 0.02 |
| 597 | 0 | 0.01 | −3.7 | 3.7 | 0.02 |
| 598 | 0 | 0.01 | −3.7 | 3.7 | 0.03 |
| 599 | 0 | 0.01 | −3.7 | 3.7 | 0.03 |
| 600 | 0.2 | 0.01 | 3.7 | 3.7 | 0.05 |
| 601 | 0 | 0.01 | −3.6 | 3.6 | 0.03 |
| 602 | 0.05 | 0 | 3.6 | 3.6 | 0.04 |
| 603 | 0 | 0.01 | −3.6 | 3.6 | 0.04 |
| 604 | 0.01 | 0 | 3.5 | 3.5 | 0.02 |
| 605 | 0 | 0.01 | −3.5 | 3.5 | 0.03 |
| 606 | 0 | 0.01 | −3.5 | 3.5 | 0.04 |
| 607 | 0 | 0.01 | −3.5 | 3.5 | 0.04 |
| 608 | 0.02 | 0.17 | −3.4 | 3.4 | 0.01 |
| 609 | 0.01 | 0 | 3.4 | 3.4 | 0.02 |
| 610 | 0 | 0.01 | −3.4 | 3.4 | 0.02 |
| 611 | 0 | 0.01 | −3.4 | 3.4 | 0.02 |
| 612 | 0 | 0.01 | −3.4 | 3.4 | 0.02 |
| 613 | 0 | 0.01 | −3.4 | 3.4 | 0.03 |
| 614 | 0.05 | 0.46 | −3.3 | 3.3 | 0.02 |
| 615 | 0 | 0.01 | −3.3 | 3.3 | 0.02 |
| 616 | 0 | 0.01 | −3.3 | 3.3 | 0.02 |
| 617 | 0 | 0.01 | −3.3 | 3.3 | 0.03 |
| 618 | 0.01 | 0 | 3.3 | 3.3 | 0.04 |
| 619 | 0 | 0.05 | −3.2 | 3.2 | 0.01 |
| 620 | 0 | 0.01 | −3.2 | 3.2 | 0.02 |
| 621 | 0 | 0.01 | −3.2 | 3.2 | 0.02 |
| 622 | 0.01 | 0.1 | −3.1 | 3.1 | 0 |
| 623 | 0.03 | 0 | 3.1 | 3.1 | 0.01 |
| 624 | 0 | 0.01 | −3.1 | 3.1 | 0.02 |
| 625 | 0 | 0.01 | −3.1 | 3.1 | 0.02 |
| 626 | 0 | 0.01 | −3.1 | 3.1 | 0.02 |
| 627 | 0 | 0.01 | −3.1 | 3.1 | 0.04 |
| 628 | 0 | 0.01 | −3.1 | 3.1 | 0.05 |
| 629 | 0 | 0.01 | −3.1 | 3.1 | 0.05 |
| 630 | 0.13 | 0.02 | 3 | 3 | 0.01 |
| 631 | 0 | 0.01 | −3 | 3 | 0.02 |
| 632 | 0 | 0.01 | −3 | 3 | 0.02 |
| 633 | 0.01 | 0 | 3 | 3 | 0.03 |
| 634 | 0 | 0.01 | −3 | 3 | 0.04 |
| 635 | 0.1 | 0.01 | 2.9 | 2.9 | 0.01 |
| 636 | 0 | 0.01 | −2.9 | 2.9 | 0.02 |
| 637 | 0 | 0.01 | −2.9 | 2.9 | 0.05 |
| 638 | 0 | 0.01 | −2.8 | 2.8 | 0.02 |
| 639 | 0 | 0.01 | −2.8 | 2.8 | 0.05 |
| 482 | 0.53 | 0.08 | 2.7 | 2.7 | 0.02 |
| 640 | 0.01 | 0 | 2.7 | 2.7 | 0.02 |
| 641 | 0.01 | 0 | 2.7 | 2.7 | 0.02 |
| 642 | 0.01 | 0.06 | −2.6 | 2.6 | 0.01 |
| 643 | 0.03 | 0 | 2.6 | 2.6 | 0.02 |
| 644 | 0.01 | 0 | 2.6 | 2.6 | 0.02 |
| 645 | 0.06 | 0.36 | −2.5 | 2.5 | 0 |
| 646 | 0.01 | 0.05 | −2.5 | 2.5 | 0.02 |
| 647 | 0 | 0 | 2.4 | 2.4 | 0.02 |
| 648 | 0 | 0 | 2.4 | 2.4 | 0.02 |
| 649 | 0 | 0 | 2.4 | 2.4 | 0.02 |

TABLE 701-continued

Differential secreted protein abundance between SYM00577 and SYM00300.

| | | | | | |
|---|---|---|---|---|---|
| 650 | 0 | 0 | −2.4 | 2.4 | 0.02 |
| 651 | 0.01 | 0.06 | −2.4 | 2.4 | 0.03 |
| 652 | 0.11 | 0.02 | 2.4 | 2.4 | 0.03 |
| 653 | 0.02 | 0.1 | −2.3 | 2.3 | 0.01 |
| 654 | 0 | 0.02 | −2.3 | 2.3 | 0.02 |
| 493 | 0.21 | 1.08 | −2.3 | 2.3 | 0.02 |
| 655 | 0 | 0 | 2.3 | 2.3 | 0.02 |
| 656 | 0 | 0 | −2.3 | 2.3 | 0.02 |
| 657 | 0.19 | 0.95 | −2.3 | 2.3 | 0.02 |
| 658 | 0 | 0 | 2.3 | 2.3 | 0.02 |
| 659 | 0 | 0 | 2.3 | 2.3 | 0.02 |
| 660 | 0 | 0 | 2.3 | 2.3 | 0.02 |
| 661 | 0.02 | 0 | 2.2 | 2.2 | 0.01 |
| 662 | 0.09 | 0.02 | 2.2 | 2.2 | 0.03 |
| 663 | 0.02 | 0.08 | −2.2 | 2.2 | 0.04 |
| 664 | 0 | 0 | 2.1 | 2.1 | 0.02 |
| 665 | 0 | 0 | 2.1 | 2.1 | 0.02 |
| 666 | 0.01 | 0.03 | −2.1 | 2.1 | 0.02 |
| 667 | 0.17 | 0.04 | 2.1 | 2.1 | 0.02 |
| 668 | 0 | 0 | −2.1 | 2.1 | 0.03 |
| 669 | 0 | 0 | −2.1 | 2.1 | 0.05 |
| 670 | 0.06 | 0.01 | 2 | 2 | 0 |
| 671 | 0 | 0 | 2 | 2 | 0.02 |
| 672 | 0.02 | 0 | 2 | 2 | 0.02 |
| 673 | 0.1 | 0.03 | 2 | 2 | 0.05 |

This table describes the differential protein expression between pairs of orthologous proteins from a genus, where one member of the pair has a beneficial effect on plant growth and the other has a neutral effect. "A.mean" represents the average normalized spectral counts between biological replicates of the beneficial member of the pair. "B.mean" represents the average normalized spectral counts between biological replicates of the neutral member of the pair. "Fold change" represents the fold change difference between the two organisms. "FDR q-value" represents the false discovery rate corrected q-value.

A total of 892 proteins were detected across all *Acremonium* samples with two or more unique peptides at the false discovery rates indicated above.

SYM15774 Secreted Proteomic Analysis

TABLE 702

25 most abundant proteins secreted by SYM15774; "Median Abundance" represents the median value across three biological replicates in units of spectra per hundred spectra

| SEQ ID | Protein ID | Median Abundance | GO Terms | KEGG Terms |
|---|---|---|---|---|
| 4510 | 3AXg6236.t1 | 1.09684 | GO: 0005576: extracellular region | none |
| 4511 | 3AXg9048.t1 | 1.031017 | GO: 0000287: magnesium ion binding; GO: 0006400: tRNA modification; GO: 0008193: tRNA guanylyltransferase activity; GO: 0016787: hydrolase activity | none |
| 4512 | 3AXg678.t1 | 0.62687 | GO: 0016787: hydrolase activity | none |
| 4513 | 3AXg934.t1 | 0.558301 | GO: 0003735: structural constituent of ribosome; GO: 0005840: ribosome; GO: 0006412: translation | KEGG Orthology: K02927: RP-L40e, RPL40: large subunit ribosomal protein L40e; KEGG PATHWAY: ko03010: Ribosome: |
| 4514 | 3AXg7460.t1 | 0.527389 | GO: 0005886: plasma membrane; GO: 0005975: carbohydrate metabolic process; GO: 0016021: integral component of membrane; GO: 0016740: transferase activity; GO: 0016787: hydrolase activity; GO: 0031225: anchored component of membrane | none |
| 4515 | 3AXg10862.t1 | 0.523646 | GO: 0004650: polygalacturonase activity; GO: 0005576: extracellular region; GO: 0005975: carbohydrate metabolic process; GO: 0071555: cell wall organization | KEGG Orthology: K01213: E3.2.1.67: galacturan 1,4-alpha-galacturonidase [EC: 3.2.1.67]; KEGG PATHWAY: ko00040: Pentose and glucuronate interconversions:; KEGG PATHWAY: ko00500: Starch and sucrose metabolism: |
| 4516 | 3AXg8590.t1 | 0.400556 | GO: 0008061: chitin binding | KEGG Orthology: K00799: GST, gst: glutathione S-transferase [EC: 2.5.1.18]; KEGG PATHWAY: ko00480: Glutathione metabolism:; |

TABLE 702-continued

| 25 most abundant proteins secreted by SYM15774; "Median Abundance" represents the median value across three biological replicates in units of spectra per hundred spectra | | | | |
|---|---|---|---|---|
| SEQ ID | Protein ID | Median Abundance | GO Terms | KEGG Terms |
| | | | | KEGG PATHWAY: ko00980: Metabolism of xenobiotics by cytochrome P450:; KEGG PATHWAY: ko00982: Drug metabolism - cytochrome P450:; KEGG PATHWAY: ko05204: Chemical carcinogenesis: It has been estimated that exposure to environmental chemical carcinogens may contribute significantly to the causation of a sizable fraction, perhaps a majority, of human cancers. Human carcinogens act through a variety of genotoxic and non-genotoxic mechanisms. Genotoxic carcinogens can attack biological macromolecules such as DNA and RNA either directly or indirectly through metabolism, resulting in the formation of adducts with these macromolecules. If DNA adducts escape cellular repair mechanisms and persist, they may lead to miscoding, resulting in permanent mutations. Non-genotoxic carcinogens act by the mechanisms such as induction of inflammation, immunosuppression, formation of reactive oxygen species, activation of receptors, and epigenetic silencing. Together, these genotoxic and non-genotoxic mechanisms can alter signal-transduction pathways that finally result in hypermutability, genomic instability, loss of proliferation control, and resistance to apoptosis - some of the characteristic features of cancer cells. |
| 4517 | 3AXg5014.t1 | 0.375314 | GO: 0004553: hydrolase activity, hydrolyzing O-glycosyl compounds; GO: 0005975: carbohydrate metabolic process | none |
| 4518 | 3AXg2998.t1 | 0.374684 | GO: 0016614: oxidoreductase activity, acting on CH—OH group of donors; GO: 0018130: heterocycle biosynthetic process; GO: 0044550: secondary metabolite biosynthetic process; GO: 0050660: flavin adenine dinucleotide binding; GO: 0055114: oxidation-reduction process; GO: 1901362: organic cyclic compound biosynthetic process | none |
| 4519 | 3AXg4073.t1 | 0.311962 | GO: 0005975: carbohydrate metabolic process; GO: 0016787: hydrolase activity | none |
| 4520 | 3AXg3348.t1 | 0.291735 | GO: 0006629: lipid metabolic process; GO: 0008081: phosphoric diester hydrolase activity | none |
| 4521 | 3AXg1507.t1 | 0.287808 | GO: 0005886: plasma membrane; GO: 0005975: carbohydrate metabolic process; GO: 0016021: integral component of membrane; GO: 0016740: transferase activity; GO: 0031225: anchored component of membrane | none |
| 4522 | 3AXg2571.t1 | 0.275402 | GO: 0008152: metabolic process; GO: 0016787: hydrolase activity | none |
| 4523 | 3AXg9962.t1 | 0.272744 | GO: 0016020: membrane | none |
| 4524 | 3AXg965.t1 | 0.254561 | GO: 0003723: RNA binding; GO: 0004521: endoribonuclease activity; GO: 0016020: membrane; | none |

TABLE 702-continued 25 most abundant proteins secreted by SYM15774; "Median Abundance" represents the median value across three biological replicates in units of spectra per hundred spectra

| SEQ ID | Protein ID | Median Abundance | GO Terms | KEGG Terms |
|---|---|---|---|---|
| | | | GO: 0090502: RNA phosphodiester bond hydrolysis, endonucleolytic | |
| 4525 | 3AXg5987.t1 | 0.252385 | GO: 0004252: serine-type endopeptidase activity; GO: 0005576: extracellular region; GO: 0006508: proteolysis; GO: 0008240: tripeptidyl-peptidase activity | KEGG Orthology: K01279: TPP1, CLN2: tripeptidyl-peptidase I [EC: 3.4.14.9]; KEGG PATHWAY: ko04142: Lysosome: Lysosomes are membrane-delimited organelles in animal cells serving as the cell's main digestive compartment to which all sorts of macromolecules are delivered for degradation. They contain more than 40 hydrolases in an acidic environment (pH of about 5). After synthesis in the ER, lysosomal enzymes are decorated with mannose-6-phosphate residues, which are recognized by mannose-6-phosphate receptors in the trans-Golgi network. They are packaged into clathrin-coated vesicles and are transported to late endosomes. Substances for digestion are acquired by the lysosomes via a series of processes including endocytosis, phagocytosis, and autophagy. |
| 4526 | 3AXg8810.t1 | 0.232932 | GO: 0004252: serine-type endopeptidase activity; GO: 0006508: proteolysis | KEGG Orthology: K01279: TPP1, CLN2: tripeptidyl-peptidase I [EC: 3.4.14.9]; KEGG PATHWAY: ko04142: Lysosome: Lysosomes are membrane-delimited organelles in animal cells serving as the cell's main digestive compartment to which all sorts of macromolecules are delivered for degradation. They contain more than 40 hydrolases in an acidic environment (pH of about 5). After synthesis in the ER, lysosomal enzymes are decorated with mannose-6-phosphate residues, which are recognized by mannose-6-phosphate receptors in the trans-Golgi network. They are packaged into clathrin-coated vesicles and are transported to late endosomes. Substances for digestion are acquired by the lysosomes via a series of processes including endocytosis, phagocytosis, and autophagy. |
| 4527 | 3AXg1658.t1 | 0.226403 | GO: 0016614: oxidoreductase activity, acting on CH—OH group of donors; GO: 0050660: flavin adenine dinucleotide binding; GO: 0055114: oxidation-reduction process | none |
| 4528 | 3AXg2961.t1 | 0.220484 | GO: 0016491: oxidoreductase activity; GO: 0046872: metal ion binding; GO: 0055114: oxidation-reduction process | KEGG Orthology: K00505: TYR: tyrosinase [EC: 1.14.18.1]; KEGG PATHWAY: ko00350: Tyrosine metabolism:; KEGG PATHWAY: ko00740: Riboflavin metabolism:; KEGG PATHWAY: ko00950: Isoquinoline alkaloid biosynthesis: Isoquinoline alkaloids are tyrosine-derived plant alkaloids with an isoquinoline skeleton. Among them benzylisoquinoline alkaloids form an important group with potent pharmacological activity, including analgesic compounds of morphine and codeine, and anti-infective agents of berberine, palmatine, and magnoflorine. Biosynthesis of isoquinoline alkaloids proceeds via |

TABLE 702-continued 25 most abundant proteins secreted by SYM15774; "Median Abundance" represents the median value across three biological replicates in units of spectra per hundred spectra

| SEQ ID | Protein ID | Median Abundance | GO Terms | KEGG Terms |
|---|---|---|---|---|
| | | | | decarboxylation of tyrosine or DOPA to yield dopamine, which together with 4-hydroxyphenylacetaldehyde, an aldehyde derived from tyrosine, is converted to reticuline, an important precursor of various benzylisoquinoline alkaloids.; KEGG PATHWAY: ko00965: Betalain biosynthesis: Betalains are water-soluble nitrogen-containing pigments that are present in plants belonging to the order Caryophyllales (such as cactus and amaranth families) and in higher fungi. They contain betalamic acid as the chromophore and are classified into two types: betacyanins and betaxanthins. Betacyanins contain a cyclo-DOPA residue and exhibit red/violet coloration, while betaxanthins contain different amino acids or amino side chains and exhibit a yellow/orange coloration. The condensation of betalamic acid with amino acids (including cyclo-DOPA or amines) in plants is a spontaneous reaction, not an enzyme-catalyzed reaction.; KEGG PATHWAY: ko04916: Melanogenesis: Cutaneous melanin pigment plays a critical role in camouflage, mimicry, social communication, and protection against harmful effects of solar radiation. Melanogenesis is under complex regulatory control by multiple agents. The most important positive regulator of melanogenesis is the MC1 receptor with its ligands melanocortic peptides. MC1R activates the cyclic AMP (cAMP) response-element binding protein (CREB). Increased expression of MITF and its activation by phosphorylation (P) stimulate the transcription of tyrosinase (TYR), tyrosinase-related protein 1 (TYRP1), and dopachrome tautomerase (DCT), which produce melanin. Melanin synthesis takes place within specialized intracellular organelles named melanosomes. Melanin-containing melanosomes then move from the perinuclear region to the dendrite tips and are transferred to keratinocytes by a still not well-characterized mechanism. |
| 4529 | 3AXg1976.t1 | 0.215291 | GO: 0004190: aspartic-type endopeptidase activity; GO: 0006508: proteolysis | none |
| 4530 | 3AXg11128.t1 | 0.213705 | GO: 0005619: ascospore wall; GO: 0005783: endoplasmic reticulum; GO: 0030476: ascospore wall assembly | none |
| 4531 | 3AXg4486.t1 | 0.20608 | GO: 0008152: metabolic process; GO: 0016491: oxidoreductase activity; GO: 0016787: hydrolase activity; GO: 0046872: metal ion binding | none |

TABLE 702-continued

| 25 most abundant proteins secreted by SYM15774; "Median Abundance" represents the median value across three biological replicates in units of spectra per hundred spectra | | | | |
|---|---|---|---|---|
| SEQ ID | Protein ID | Median Abundance | GO Terms | KEGG Terms |
| 4532 | 3AXg6046.t1 | 0.205931 | GO: 0005975: carbohydrate metabolic process; GO: 0008810: cellulase activity | none |
| 4533 | 3AXg3384.t1 | 0.192121 | GO: 0003824: catalytic activity | none |
| 4534 | 3AXg2856.t1 | 0.187827 | GO: 0006508: proteolysis; GO: 0008236: serine-type peptidase activity | none |

SYM15774 Versus SYM01331

TABLE 703

| Differential secreted protein abundance between SYM15774 and SYM01331. | | | | | | | | | |
|---|---|---|---|---|---|---|---|---|---|
| SEQ ID Beneficial | A. protein | SEQ ID Neutral | B. protein | KEGG | GO | A. mean | B. mean | Fold-change | FDR q-value |
| 4535 | 3AXg4278.t1 | 4337 | 3BXg6074.t1 | E3.1.1.73 | carboxylic ester hydrolase activity | 0.136 | 0 | 7.1 | 1.20E−02 |
| 4536 | 3AXg230.t1 | 4338 | 3BXg7469.t1 | Axon guidance, CFL, Fc gamma R-mediated phagocytosis, Pertussis, Regulation of actin cytoskeleton | actin cortical patch, actin filament binding, actin filament depolymerization, actin filament severing, ATP binding, cell division site, cell tip, endocytosis, Golgi to plasma membrane protein transport, integral component of membrane, protein refolding | 0.041 | 0 | 5.4 | 1.20E−02 |
| 4537 | 3AXg6225.t1 | 4339 | 3BXg6585.t1 | Arginine and proline metabolism, beta-Alanine metabolism, MPAO, PAO1 | oxidation-reduction process, oxidoreductase activity | 0.028 | 0 | 4.9 | 1.20E−02 |
| 4538 | 3AXg8418.t1 | 4340 | 3BXg7838.t1 | None | flavin adenine dinucleotide binding, oxidation-reduction process, oxidoreductase activity, acting on CH—OH group of donors, phosphatidylinositol binding | 0.015 | 0 | 4 | 1.20E−02 |
| 4539 | 3AXg6767.t1 | 4341 | 3BXg3303.t1 | None | cell wall, cell wall modification, hydrolase activity, acting on ester bonds, metabolic process, pectinesterase activity | 0.045 | 0.003 | 3.4 | 1.20E−02 |
| 4519 | 3AXg4073.t1 | 4342 | 3BXg8531.t1 | None | carbohydrate metabolic process, hydrolase activity | 0.297 | 0.054 | 2.4 | 1.20E−02 |
| 4540 | 3AXg10237.t1 | 4343 | 3BXg1101.t1 | XEG | cellulase activity, polysaccharide catabolic process | 0.127 | 0.03 | 2 | 1.20E−02 |
| 4541 | 3AXg6263.t1 | 4344 | 3BXg11238.t1 | None | None | 0.204 | 0.049 | 2 | 1.20E−02 |
| 4542 | 3AXg5745.t1 | 4345 | 3BXg6273.t1 | None | fungal-type cell wall, fungal-type vacuole, metallopeptidase activity, proteolysis | 0.054 | 0.246 | −2.2 | 1.20E−02 |
| 4543 | 3AXg10791.t1 | 4346 | 3BXg9786.t1 | bglX, Cyanoamino acid metabolism, Phenylpropanoid biosynthesis, Starch | beta-glucosidase activity, carbohydrate metabolic process | 0.003 | 0.094 | −4.4 | 1.20E−02 |

TABLE 703-continued

| Differential secreted protein abundance between SYM15774 and SYM01331. | | | | | | | | | |
|---|---|---|---|---|---|---|---|---|---|
| SEQ ID Beneficial | A. protein | SEQ ID Neutral | B. protein | KEGG | GO | A. mean | B. mean | Fold-change | FDR q-value |
| | | | | and sucrose metabolism | | | | | |
| 4544 | 3AXg7602.t1 | 4347 | 3BXg11695.t1 | None | aspartic-type endopeptidase activity, proteolysis | 0 | 0.06 | −5.9 | 1.20E−02 |
| 4545 | 3AXg8955.t1 | 4348 | 3BXg2490.t1 | None | None | 0 | 0.132 | −7.1 | 1.20E−02 |
| 4546 | 3AXg1865.t1 | 4349 | 3BXg9015.t1 | None | carbohydrate metabolic process, hydrolase activity, hydrolyzing O-glycosyl compounds | 0 | 0.145 | −7.2 | 1.20E−02 |
| 4547 | 3AXg10977.t1 | 4350 | 3BXg7338.t1 | None | None | 0.062 | 0.009 | 2.6 | 1.30E−02 |
| 4548 | 3AXg8244.t1 | 4351 | 3BXg2216.t1 | E3.4.11.10 | aminopeptidase activity, extracellular region, metal ion binding, nuclear pore, nucleocytoplasmic transport, proteolysis, structural constituent of nuclear pore | 0 | 0.003 | −2 | 1.30E−02 |
| 4549 | 3AXg2047.t1 | 4352 | 3BXg7322.t1 | E3.1.1.73 | hydrolase activity, metabolic process | 0 | 0.007 | −3 | 1.30E−02 |
| 4550 | 3AXg2487.t1 | 4353 | 3BXg4014.t1 | CTSA, Lysosome, Renin-angiotensin system | proteolysis, serine-type carboxypeptidase activity | 0 | 0.018 | −4.2 | 1.30E−02 |
| 4551 | 3AXg3683.t1 | 4354 | 3BXg679.t1 | None | metallocarboxypeptidase activity, proteolysis, zinc ion binding | 0 | 0.054 | −5.8 | 1.30E−02 |
| 4552 | 3AXg5735.t1 | 4355 | 3BXg6263.t1 | E3.4.21.48 | dibasic protein processing, serine-type endopeptidase activity | 0 | 0.07 | −6.2 | 1.30E−02 |
| 4553 | 3AXg8371.t1 | 4356 | 3BXg11001.t1 | E4.2.2.10 | extracellular region, pectin lyase activity, polysaccharide catabolic process | 0 | 0.171 | −7.4 | 1.30E−02 |
| 4554 | 3AXg8798.t1 | 4357 | 3BXg4519.t1 | None | integral component of membrane, membrane, negative regulation of G2/M transition of mitotic cell cycle | 0.041 | 0 | 5.4 | 1.40E−02 |
| 4555 | 3AXg3404.t1 | 4358 | 3BXg4400.t1 | None | choline dehydrogenase activity, flavin adenine dinucleotide binding, oxidation-reduction process | 0.169 | 0.004 | 5 | 1.40E−02 |
| 4556 | 3AXg3735.t1 | 4359 | 3BXg4453.t1 | None | membrane | 0.023 | 0 | 4.6 | 1.40E−02 |
| 4557 | 3AXg9146.t1 | 4360 | 3BXg2444.t1 | None | integral component of membrane | 0.017 | 0 | 4.2 | 1.40E−02 |
| 4558 | 3AXg10088.t1 | 4361 | 3BXg1846.t1 | None | endonuclease activity, exonuclease activity, integral component of membrane, nucleic acid phosphodiester bond hydrolysis | 0.075 | 0.009 | 3 | 1.40E−02 |
| 4559 | 3AXg10485.t1 | 4362 | 3BXg821.t1 | Amino sugar and nucleotide sugar metabolism, Glycosaminoglycan degradation, Glycosphingolipid biosynthesis - ganglio series, Glycosphingolipid biosynthesis - globo series, HEXA_B, | beta-N-acetylglucosaminidase activity, carbohydrate metabolic process, extracellular region, N-acetylglucosamine catabolic process | 0.027 | 0.156 | −2.5 | 1.40E−02 |

TABLE 703-continued

| Differential secreted protein abundance between SYM15774 and SYM01331. | | | | | | | | | |
|---|---|---|---|---|---|---|---|---|---|
| SEQ ID Beneficial | A. protein | SEQ ID Neutral | B. protein | KEGG | GO | A. mean | B. mean | Fold-change | FDR q-value |
| | | | | Lysosome, Other glycan degradation | | | | | |
| 4560 | 3AXg8514.t1 | 4363 | 3BXg7997.t1 | None | choline dehydrogenase activity, flavin adenine dinucleotide binding, oxidation-reduction process | 0.074 | 0.551 | −2.9 | 1.40E−02 |
| 4561 | 3AXg8930.t1 | 4364 | 3BXg5868.t1 | None | integral component of membrane | 0 | 0.008 | −3.2 | 1.40E−02 |
| 4562 | 3AXg6329.t1 | 4365 | 3BXg3212.t1 | E1.1.99.1, betA, CHDH, Glycine, serine and threonine metabolism | alcohol metabolic process, choline dehydrogenase activity, DNA binding, flavin adenine dinucleotide binding, metal ion binding, oxidation-reduction process, regulation of transcription, DNA-templated | 0.039 | 0.388 | −3.3 | 1.40E−02 |
| 4563 | 3AXg9850.t1 | 4366 | 3BXg11232.t1 | None | catalytic activity, chromatin silencing by small RNA, cytosol, endoplasmic reticulum unfolded protein response, nucleus | 0 | 0.023 | −4.6 | 1.40E−02 |
| 4564 | 3AXg1923.t1 | 4367 | 3BXg9196.t1 | None | hydrolase activity, metabolic process | 0 | 0.033 | −5.1 | 1.40E−02 |
| 4565 | 3AXg6350.t1 | 4368 | 3BXg12502.t1 | None | proteolysis, serine-type peptidase activity | 0.015 | 0.67 | −5.4 | 1.40E−02 |
| 4566 | 3AXg9423.t1 | 4369 | 3BXg390.t1 | Betalain biosynthesis, Isoquinoline alkaloid biosynthesis, Melanogenesis, Riboflavin metabolism, TYR, Tyrosine metabolism | ion binding, metabolic process, metal ion binding, oxidation-reduction process, oxidoreductase activity | 0 | 0.048 | −5.6 | 1.40E−02 |
| 4567 | 3AXg5033.t1 | 4370 | 3BXg7845.t1 | None | cellular process, membrane, metabolic process, single-organism process | 0 | 0.098 | −6.6 | 1.40E−02 |
| 4568 | 3AXg4645.t1 | 4371 | 3BXg8440.t1 | None | None | 0 | 0.121 | −6.9 | 1.40E−02 |
| 4527 | 3AXg1658.t1 | 4372 | 3BXg6710.t1 | None | flavin adenine dinucleotide binding, oxidation-reduction process, oxidoreductase activity, acting on CH—OH group of donors | 0.219 | 0 | 7.8 | 1.50E−02 |
| 4569 | 3AXg8951.t1 | 4373 | 3BXg5043.t1 | None | hydrolase activity, acting on ester bonds, nucleic acid metabolic process | 0.169 | 0 | 7.4 | 1.50E−02 |
| 4570 | 3AXg3962.t1 | 4374 | 3BXg2058.t1 | None | flavin adenine dinucleotide binding, oxidation-reduction process, oxidoreductase activity, acting on CH—OH group of donors | 0.098 | 0 | 6.6 | 1.50E−02 |
| 4571 | 3AXg9121.t1 | 4375 | 3BXg2385.t1 | E3.1.1.11, Pentose and glucuronate interconversions, Starch and sucrose metabolism | aspartyl esterase activity, cell wall, cell wall modification, extracellular region, pectin catabolic process, pectinesterase activity | 0.098 | 0 | 6.6 | 1.50E−02 |

TABLE 703-continued

| Differential secreted protein abundance between SYM15774 and SYM01331. | | | | | | | | | |
|---|---|---|---|---|---|---|---|---|---|
| SEQ ID Beneficial | A. protein | SEQ ID Neutral | B. protein | KEGG | GO | A. mean | B. mean | Fold-change | FDR q-value |
| 4572 | 3AXg6312.t1 | 4376 | 3BXg3233.t1 | None | flavin adenine dinucleotide binding, oxidation-reduction process, oxidoreductase activity, acting on CH—OH group of donors | 0.059 | 0 | 5.9 | 1.50E−02 |
| 4573 | 3AXg4810.t1 | 4377 | 3BXg1560.t1 | E3.2.1.4, Starch and sucrose metabolism | carbohydrate metabolic process, hydrolase activity, hydrolyzing O-glycosyl compounds | 0.049 | 0 | 5.7 | 1.50E−02 |
| 4574 | 3AXg1577.t1 | 4378 | 3BXg3030.t1 | None | hydrolase activity, metabolic process | 0.026 | 0 | 4.8 | 1.50E−02 |
| 4575 | 3AXg5120.t1 | 4379 | 3BXg10267.t1 | EEF1B | cytosol, eukaryotic translation elongation factor 1 complex, guanyl-nucleotide exchange factor activity, maintenance of translational fidelity, negative regulation of actin filament bundle assembly, positive regulation of GTPase activity, regulation of translational termination, translation elongation factor activity, translational elongation | 0.015 | 0 | 4 | 1.50E−02 |
| 4576 | 3AXg2881.t1 | 4380 | 3BXg6431.t1 | msrA | cellular response to hydrogen peroxide, cytosol, integral component of membrane, L-methionine biosynthetic process from methionine sulphoxide, L-methionine-(S)-S-oxide reductase activity, nucleus, oxidation-reduction process, peptide-methionine (S)-S-oxide reductase activity, protein repair | 0.005 | 0 | 2.7 | 1.50E−02 |
| 4577 | 3AXg2995.t1 | 4381 | 3BXg8638.t1 | Influenza A, Neuroactive ligand-receptor interaction, Pancreatic secretion, Protein digestion and absorption, PRSS | proteolysis, serine-type endopeptidase activity | 0.071 | 0.01 | 2.7 | 1.50E−02 |
| 4578 | 3AXg6701.t1 | 4382 | 3BXg7716.t1 | Epstein-Barr virus infection, HTLV-I infection, RAN, Ribosome biogenesis in eukaryotes, RNA transport | cytosol, GTP binding, GTPase activity, intracellular'protein transport, membrane, metabolic process, negative regulation of G2/M transition of mitotic cell cycle, nuclear pore, nucleocytoplasmic transport, small GTPase mediated signal transduction, structural | 0.005 | 0 | 2.7 | 1.50E−02 |

TABLE 703-continued

Differential secreted protein abundance between SYM15774 and SYM01331.

| SEQ ID Beneficial | A. protein | SEQ ID Neutral | B. protein | KEGG | GO | A. mean | B. mean | Fold-change | FDR q-value |
|---|---|---|---|---|---|---|---|---|---|
| | | | | | constituent of nuclear pore | | | | |
| 4579 | 3AXg10558.t1 | 4383 | 3BXg10095.t1 | None | None | 0.005 | 0 | 2.6 | 1.50E−02 |
| 4580 | 3AXg9106.t1 | 4384 | 3BXg2351.t1 | None | cytoplasm | 0.004 | 0 | 2.3 | 1.50E−02 |
| 4581 | 3AXg573.t1 | 4385 | 3BXg5286.t1 | None | aspartic-type endopeptidase activity, membrane, proteolysis | 0.044 | 0.009 | 2.2 | 1.50E−02 |
| 4525 | 3AXg5987.t1 | 4386 | 3BXg5319.t1 | Lysosome, TPP1, CLN2 | extracellular region, proteolysis, serine-type endopeptidase activity, tripeptidyl-peptidase activity | 0.261 | 0.057 | 2.2 | 1.50E−02 |
| 4582 | 3AXg10624.t1 | 4387 | 3BXg1050.t1 | None | choline dehydrogenase activity, flavin adenine dinucleotide binding, integral component of membrane, oxidation-reduction process, transmembrane transport, transporter activity | 0.172 | 0.038 | 2.1 | 1.50E−02 |
| 4520 | 3AXg3348.t1 | 4388 | 3BXg5195.t1 | None | lipid metabolic process, phosphoric diester hydrolase activity | 0.286 | 0.065 | 2.1 | 1.50E−02 |
| 4583 | 3AXg1574.t1 | 4389 | 3BXg791.t1 | None | ATP binding, calmodulin binding, calmodulin-dependent protein kinase activity, cytosol, glucose catabolic process, manganese ion binding, negative regulation of calcineurin-NFAT signaling cascade, negative regulation of G2/M transition of mitotic cell cycle, negative regulation of transcription by transcription factor localization, negative regulation of transcription from RNA polymerase II promoter, nucleus, phosphoglycerate mutase activity, protein phosphorylation, regulation of nuclear division | 0.003 | 0 | 2 | 1.50E−02 |
| 4584 | 3AXg3704.t1 | 4390 | 3BXg4116.t1 | None | None | 0.04 | 0.176 | −2.1 | 1.50E−02 |
| 4585 | 3AXg7050.t1 | 4391 | 3BXg10636.t1 | E3.2.1.101 | catalytic activity, hydrolase activity | 0.014 | 0.064 | −2.1 | 1.50E−02 |
| 4586 | 3AXg11147.t1 | 4392 | 3BXg3457.t1 | None | defense response to bacterium, defense response to fungus, spore wall | 0.01 | 0.065 | −2.6 | 1.50E−02 |
| 4587 | 3AXg809.t1 | 4393 | 3BXg9916.t1 | None | acetyltransferase activity, metabolic process, transferase activity | 0 | 0.016 | −4.1 | 1.50E−02 |
| 4588 | 3AXg1606.t1 | 4394 | 3BXg8171.t1 | Betalain biosynthesis, Isoquinoline alkaloid biosynthesis, Melanogenesis, Riboflavin metabolism, | metabolic process, N-acetyltransferase activity, oxidation-reduction process, oxidoreductase | 0 | 0.038 | −5.3 | 1.50E−02 |

TABLE 703-continued

| SEQ ID Beneficial | A. protein | SEQ ID Neutral | B. protein | KEGG | GO | A. mean | B. mean | Fold-change | FDR q-value |
|---|---|---|---|---|---|---|---|---|---|
| Differential secreted protein abundance between SYM15774 and SYM01331. | | | | | | | | | |
| | | | | TYR, Tyrosine metabolism | activity, transferase activity, transferring acyl groups | | | | |
| 4589 | 3AXg5600.t1 | 4395 | 3BXg3227.t1 | None | None | 0 | 0.086 | −6.4 | 1.50E−02 |
| 4590 | 3AXg676.t1 | 4396 | 3BXg6951.t1 | None | None | 0 | 0.319 | −8.3 | 1.50E−02 |
| 4591 | 3AXg8215.t1 | 4397 | 3BXg2453.t1 | None | None | 0.002 | 0.054 | −4.3 | 1.70E−02 |
| 4592 | 3AXg4581.t1 | 4398 | 3BXg7071.t1 | None | hydrolase activity, metabolic process | 0.076 | 0 | 6.3 | 1.80E−02 |
| 4593 | 3AXg3000.t1 | 4399 | 3BXg8643.t1 | None | flavin adenine dinucleotide binding, oxidation-reduction process, oxidoreductase activity, oxidoreductase activity, acting on CH—OH group of donors | 0 | 0.042 | −5.4 | 1.80E−02 |
| 4594 | 3AXg3931.t1 | 4400 | 3BXg1983.t1 | None | choline dehydrogenase activity, flavin adenine dinucleotide binding, oxidation-reduction process | 0.081 | 0 | 6.4 | 1.90E−02 |
| 4595 | 3AXg3946.t1 | 4401 | 3BXg1965.t1 | None | copper ion binding, oxidation-reduction process, oxidoreductase activity | 0.025 | 0 | 4.7 | 1.90E−02 |
| 4596 | 3AXg1894.t1 | 4402 | 3BXg9149.t1 | None | carbohydrate metabolic process, catalytic activity | 0.016 | 0 | 4 | 2.00E−02 |
| 4597 | 3AXg3686.t1 | 4403 | 3BXg689.t1 | None | copper ion binding, oxidation-reduction process, oxidoreductase activity | 0.022 | 0.166 | −2.9 | 2.00E−02 |
| 4598 | 3AXg9632.t1 | 4404 | 3BXg8688.t1 | None | beta-N-acetylhexosaminidase activity, carbohydrate metabolic process, integral component of membrane | 0 | 0.026 | −4.8 | 2.00E−02 |
| 4599 | 3AXg7875.t1 | 4405 | 3BXg925.t1 | E3.1.3.25, IMPA, suhB, Inositol phosphate metabolism, Phosphatidylinositol signaling system, Streptomycin biosynthesis | DNA binding, integral component of membrane, phosphatidylinositol phosphorylation | 0 | 0.031 | −5 | 2.00E−02 |
| 4600 | 3AXg6708.t1 | 4406 | 3BXg7541.t1 | None | membrane | 0 | 0.036 | −5.2 | 2.00E−02 |
| 4601 | 3AXg7523.t1 | 4407 | 3BXg2252.t1 | None | hydrolase activity, metabolic process | 0.029 | 0.007 | 2 | 2.10E−02 |
| 4602 | 3AXg9481.t1 | 4408 | 3BXg11985.t1 | Amino sugar and nucleotide sugar metabolism, E3.2.1.14 | carbohydrate metabolic process, chitin catabolic process, chitinase activity, hydrolase activity, hydrolyzing O-glycosyl compounds, organic substance metabolic process, transferase activity, transferring glycosyl groups | 0.059 | 0.345 | −2.5 | 2.10E−02 |
| 4603 | 3AXg11091.t1 | 4409 | 3BXg13016.t1 | None | hydrolase activity, hydrolyzing O-glycosyl compounds, metabolic process | 0 | 0.007 | −3 | 2.10E−02 |
| 4604 | 3AXg505.t1 | 4410 | 3BXg6843.t1 | Amino sugar and nucleotide sugar metabolism, Butirosin and neomycin biosynthesis, | ATP binding, carbohydrate phosphorylation, cellular glucose homeostasis, cytosol, | 0 | 0.011 | −3.6 | 2.10E−02 |

TABLE 703-continued

Differential secreted protein abundance between SYM15774 and SYM01331.

| SEQ ID Beneficial | A. protein | SEQ ID Neutral | B. protein | KEGG | GO | A. mean | B. mean | Fold-change | FDR q-value |
|---|---|---|---|---|---|---|---|---|---|
| | | | | Carbohydrate digestion and absorption, Carbon metabolism, Central carbon metabolism in cancer, Fructose and mannose metabolism, Galactose metabolism, Glycolysis/ Gluconeogenesis, HIF-1 signaling pathway, HK, Insulin signaling pathway, Starch and sucrose metabolism, Streptomycin biosynthesis, Type II diabetes mellitus | fructokinase activity, fructose 6-phosphate metabolic process, glucokinase activity, glucose 6-phosphate metabolic process, glucose binding, glycolytic fermentation, glycolytic process, integral component of membrane, mannokinase activity, mannose metabolic process, nuclear pore, nucleocytoplasmic transport, structural constituent of nuclear pore | | | | |
| 4605 | 3AXg671.t1 | 4411 | 3BXg6947.t1 | None | FMN binding, membrane, oxidation-reduction process, oxidoreductase activity | 0 | 0.015 | −4 | 2.10E−02 |
| 4606 | 3AXg907.t1 | 4412 | 3BXg10711.t1 | None | None | 0 | 0.048 | −5.6 | 2.10E−02 |
| 4607 | 3AXg10465.t1 | 4413 | 3BXg14385.t1 | E3.2.1.58, Starch and sucrose metabolism | carbohydrate metabolic process, hydrolase activity, hydrolyzing O-glycosyl compounds, integral component of membrane, transmembrane transport | 0 | 0.235 | −7.9 | 2.10E−02 |
| 4608 | 3AXg1008.t1 | 4414 | 3BXg9515.t1 | None | choline dehydrogenase activity, flavin adenine dinucleotide binding, oxidation-reduction process | 0.068 | 0 | 6.1 | 2.20E−02 |
| 4609 | 3AXg2591.t1 | 4415 | 3BXg1833.t1 | Betalain biosynthesis, Isoquinoline alkaloid biosynthesis, Melanogenesis, Riboflavin metabolism, TYR, Tyrosine metabolism | metal ion binding, oxidation-reduction process, oxidoreductase activity | 0.126 | 0.023 | 2.4 | 2.20E−02 |
| 4610 | 3AXg4824.t1 | 4416 | 3BXg1527.t1 | None | None | 0.04 | 0 | 5.4 | 2.30E−02 |
| 4518 | 3AXg2998.t1 | 4417 | 3BXg8641.t1 | None | flavin adenine dinucleotide binding, heterocycle biosynthetic process, organic cyclic compound biosynthetic process, oxidation-reduction process, oxidoreductase activity, acting on CH—OH group of donors, secondary metabolite biosynthetic process | 0.37 | 0.038 | 3.3 | 2.30E−02 |
| 4611 | 3AXg8768.t1 | 4418 | 3BXg429.t1 | None | hydrolase activity, metabolic process | 0.011 | 0.145 | −3.6 | 2.30E−02 |
| 4612 | 3AXg11131.t1 | 4419 | 3BXg7381.t1 | None | None | 0 | 0.021 | −4.5 | 2.30E−02 |
| 4613 | 3AXg3576.t1 | 4420 | 3BXg5515.t1 | None | None | 0 | 0.063 | −6 | 2.30E−02 |
| 4614 | 3AXg10565.t1 | 4421 | 3BXg10107.t1 | None | metallocarboxypeptidase activity, proteolysis, zinc ion binding | 0.016 | 0 | 4.1 | 2.50E−02 |

TABLE 703-continued

| Differential secreted protein abundance between SYM15774 and SYM01331. | | | | | | | | | |
|---|---|---|---|---|---|---|---|---|---|
| SEQ ID Beneficial | A. protein | SEQ ID Neutral | B. protein | KEGG | GO | A. mean | B. mean | Fold-change | FDR q-value |
| 4615 | 3AXg4536.t1 | 4422 | 3BXg3121.t1 | Galactose metabolism, malZ, Starch and sucrose metabolism | carbohydrate binding, carbohydrate metabolic process, cellular process, glucosidase activity, hydrolase activity, hydrolyzing O-glycosyl compounds, integral component of membrane | 0.047 | 0.003 | 3.8 | 2.50E−02 |
| 4616 | 3AXg4165.t1 | 4423 | 3BXg6890.t1 | bglX, Cyanoamino acid metabolism, Phenylpropanoid biosynthesis, Starch and sucrose metabolism | hydrolase activity, hydrolyzing O-glycosyl compounds, integral component of membrane, polysaccharide catabolic process | 0 | 0.01 | −3.4 | 2.50E−02 |
| 4617 | 3AXg8420.t1 | 4424 | 3BXg7817.t1 | yteR, yesR | hydrolase activity, metabolic process | 0.007 | 0.147 | −4.3 | 2.50E−02 |
| 4618 | 3AXg6634.t1 | 4425 | 3BXg5671.t1 | None | acid phosphatase activity, dephosphorylation | 0.004 | 0.022 | −2.1 | 2.60E−02 |
| 4619 | 3AXg5462.t1 | 4426 | 3BXg503.t1 | None | carbohydrate metabolic process, hydrolase activity | 0 | 0.03 | −5 | 2.60E−02 |
| 4620 | 3AXg9660.t1 | 4427 | 3BXg10410.t1 | None | copper ion binding, oxidation-reduction process, oxidoreductase activity | 0 | 0.032 | −5 | 2.60E−02 |
| 4621 | 3AXg736.t1 | 4428 | 3BXg7066.t1 | None | biosynthetic process, carbohydrate metabolic process, cellulose binding, extracellular region, hydrolase activity, hydrolyzing O-glycosyl compounds, positive regulation of GTPase activity, pyridoxal phosphate binding, regulation of Rho protein signal transduction, Rho guanyl-nucleotide exchange factor activity | 0 | 0.062 | −6 | 2.60E−02 |
| 4622 | 3AXg3304.t1 | 4429 | 3BXg5239.t1 | None | None | 0.07 | 0 | 6.1 | 2.70E−02 |
| 4511 | 3AXg9048.t1 | 4430 | 3BXg11565.t1 | None | hydrolase activity, magnesium ion binding, tRNA guanylyltransferase activity, tRNA modification | 0.974 | 0.079 | 3.6 | 2.70E−02 |
| 4623 | 3AXg2688.t1 | 4431 | 3BXg10864.t1 | AMPK signaling pathway, Fructose and mannose metabolism, HIF-1 signaling pathway, PFKFB | 6-phosphofructo-2-kinase activity, ATP binding, carbohydrate phosphorylation, cytosol, dephosphorylation, fructose 2,6-bisphosphate metabolic process, fructose metabolic process, fructose-2,6-bisphosphate 2-phosphatase activity | 0.01 | 0 | 3.5 | 2.70E−02 |
| 4624 | 3AXg9670.t1 | 4432 | 3BXg5175.t1 | CTSA, Lysosome, Renin-angiotensin system | fungal-type vacuole, nuclear pore, nucleocytoplasmic transport, phytochelatin biosynthetic process, | 0.005 | 0.046 | −3 | 2.70E−02 |

TABLE 703-continued

| Differential secreted protein abundance between SYM15774 and SYM01331. | | | | | | | | | |
|---|---|---|---|---|---|---|---|---|---|
| SEQ ID Beneficial | A. protein | SEQ ID Neutral | B. protein | KEGG | GO | A. mean | B. mean | Fold-change | FDR q-value |
| | | | | | proteolysis, serine-type carboxypeptidase activity, structural constituent of nuclear pore | | | | |
| 4625 | 3AXg2904.t1 | 4433 | 3BXg6481.t1 | E3.2.1.58, Starch and sucrose metabolism | carbohydrate metabolic process, hydrolase activity, hydrolyzing O-glycosyl compounds, membrane part | 0 | 0.021 | −4.5 | 2.70E−02 |
| 4626 | 3AXg10815.t1 | 4434 | 3BXg9780.t1 | None | heme binding, oxidation-reduction process, peroxidase activity, response to oxidative stress | 0.125 | 0 | 7 | 2.90E−02 |
| 4627 | 3AXg2002.t1 | 4435 | 3BXg2128.t1 | CNBP | nucleic acid binding, zinc ion binding | 0.026 | 0 | 4.8 | 3.10E−02 |
| 4628 | 3AXg3713.t1 | 4436 | 3BXg4131.t1 | None | hydrolase activity, metabolic process | 0.026 | 0 | 4.7 | 3.10E−02 |
| 4629 | 3AXg3872.t1 | 4437 | 3BXg4226.t1 | COPB1, SEC26 | COPI vesicle coat, cytosol, ER to Golgi transport vesicle, ER to Golgi vesicle-mediated transport, intracellular protein transport, kinase activity, phosphorylation, structural molecule activity | 0.022 | 0 | 4.5 | 3.10E−02 |
| 4630 | 3AXg6318.t1 | 4438 | 3BXg3226.t1 | None | hydrolase activity, hydrolase activity, acting on glycosyl bonds, organic substance metabolic process, oxidoreductase activity, primary metabolic process, single-organism metabolic process | 0.012 | 0 | 3.7 | 3.10E−02 |
| 4631 | 3AXg10010.t1 | 4439 | 3BXg11186.t1 | None | dephosphorylation, phosphatase activity | 0 | 0.088 | −6.5 | 3.10E−02 |
| 4632 | 3AXg1263.t1 | 4440 | 3BXg1724.t1 | None | chitin binding, copper ion binding, oxidation-reduction process, oxidoreductase activity | 0.03 | 0 | 4.9 | 3.20E−02 |
| 4633 | 3AXg8122.t1 | 4441 | 3BXg9830.t1 | None | None | 0.024 | 0 | 4.6 | 3.20E−02 |
| 4515 | 3AXg10862.t1 | 4442 | 3BXg9632.t1 | E3.2.1.67, Pentose and glucuronate interconversions, Starch and sucrose metabolism | carbohydrate metabolic process, cell wall organization, extracellular region, polygalacturonase activity | 0.552 | 0.095 | 2.5 | 3.20E−02 |
| 4634 | 3AXg5813.t1 | 4443 | 3BXg1361.t1 | Ascorbate and aldarate metabolism, Caprolactam degradation, Carbon metabolism, Degradation of aromatic compounds, E3.1.1.17, gnl, RGN, Pentose phosphate pathway | hydrolase activity, metabolic process | 0 | 0.12 | −6.9 | 3.40E−02 |
| 4635 | 3AXg2285.t1 | 4444 | 3BXg5413.t1 | None | heme binding, integral component of membrane, oxidation-reduction process, peroxidase | 0.045 | 0 | 5.5 | 3.60E−02 |

TABLE 703-continued

| SEQ ID Beneficial | A. protein | SEQ ID Neutral | B. protein | KEGG | GO | A. mean | B. mean | Fold-change | FDR q-value |
|---|---|---|---|---|---|---|---|---|---|
| Differential secreted protein abundance between SYM15774 and SYM01331. | | | | | | | | | |
| | | | | | activity, response to oxidative stress | | | | |
| 4636 | 3AXg3048.t1 | 4445 | 3BXg8570.t1 | None | copper ion binding, endoplasmic reticulum, ferrous iron import into cell, metal ion binding, oxidation-reduction process, oxidoreductase activity | 0 | 0.01 | −3.5 | 3.60E−02 |
| 4637 | 3AXg3573.t1 | 4446 | 3BXg5567.t1 | None | None | 0 | 0.019 | −4.4 | 3.60E−02 |
| 4638 | 3AXg457.t1 | 4447 | 3BXg2952.t1 | gcvH, GCSH, Glycine, serine and threonine metabolism, Glyoxylate and dicarboxylate metabolism | glycine cleavage complex, glycine decarboxylation via glycine cleavage system, mitochondrion, one-carbon metabolic process, oxidation-reduction process, protein lipoylation | 0.039 | 0 | 5.3 | 3.90E−02 |
| 4639 | 3AXg2903.t1 | 4448 | 3BXg6482.t1 | None | None | 0 | 0.017 | −4.1 | 3.90E−02 |
| 4640 | 3AXg10837.t1 | 4449 | 3BXg9608.t1 | None | cellular process, membrane part, pectin catabolic process, pectin lyase activity | 0 | 0.043 | −5.5 | 3.90E−02 |
| 4641 | 3AXg10151.t1 | 4450 | 3BXg10552.t1 | None | 1,3-beta-glucanosyltransferase activity, anchored component of membrane, ascospore wall assembly, carbohydrate metabolic process, endoplasmic reticulum, hydrolase activity, integral component of membrane, plasma membrane | 0.058 | 0 | 5.9 | 4.10E−02 |
| 4642 | 3AXg9889.t1 | 4451 | 3BXg7932.t1 | None | extracellular region, mannan catabolic process, mannan endo-1,4-beta-mannosidase activity | 0.009 | 0 | 3.4 | 4.10E−02 |
| 4643 | 3AXg6766.t1 | 4452 | 3BXg3304.t1 | None | integral component of membrane, transmembrane transport | 0.061 | 0 | 6 | 4.20E−02 |
| 4644 | 3AXg9025.t1 | 4453 | 3BXg3854.t1 | None | carbon-nitrogen ligase activity, with glutamine asamido-N-donor, metabolic process, transferase activity | 0.015 | 0 | 4 | 4.20E−02 |
| 4645 | 3AXg9960.t1 | 4454 | 3BXg7994.t1 | ABC.MR | ATP binding, ATPase activity, coupled to transmembrane movement of substances, integral component of membrane, isomerase activity, metabolic process, mitochondrion, transmembrane transport | 0 | 0.041 | −5.4 | 4.20E−02 |
| 4646 | 3AXg8755.t1 | 4455 | 3BXg86.t1 | None | acid phosphatase activity, dephosphorylation, heme binding, integral component | 0.011 | 0 | 3.6 | 4.30E−02 |

TABLE 703-continued

| Differential secreted protein abundance between SYM15774 and SYM01331. | | | | | | | | | |
|---|---|---|---|---|---|---|---|---|---|
| SEQ ID Beneficial | A. protein | SEQ ID Neutral | B. protein | KEGG | GO | A. mean | B. mean | Fold-change | FDR q-value |
| | | | | | of membrane, iron ion binding, membrane, oxidation-reduction process, oxidoreductase activity, acting on paired donors, with incorporation or reduction of molecular oxygen | | | | |
| 4647 | 3AXg1998.t1 | 4456 | 3BXg2125.t1 | None | aminopeptidase activity, integral component of membrane, metallopeptidase activity, proteolysis, zinc ion binding | 0 | 0.019 | −4.3 | 4.30E−02 |
| 4648 | 3AXg4651.t1 | 4457 | 3BXg12484.t1 | Nicotinate and nicotinamide metabolism, Purine metabolism, Pyrimidine metabolism, surE | hydrolase activity, integral component of membrane, metabolic process, substrate-specific transmembrane transporter activity, transmembrane transport | 0.031 | 0 | 5 | 4.40E−02 |
| 4649 | 3AXg1281.t1 | 4458 | 3BXg5746.t1 | Antigen processing and presentation, Endocytosis, Epstein-Barr virus infection, Estrogen signaling pathway, HSPA1_8, Influenza A, Legionellosis, MAPK signaling pathway, Measles, Protein processing in endoplasmic reticulum, Spliceosome, Toxoplasmosis | ATP binding | 0.027 | 0 | 4.8 | 4.50E−02 |
| 4650 | 3AXg2954.t1 | 4459 | 3BXg10202.t1 | None | cutiriase activity, extracellular region, metabolic process | 0.02 | 0 | 4.4 | 4.50E−02 |
| 4651 | 3AXg8116.t1 | 4460 | 3BXg9765.t1 | E3.2.1.8, xynA | endo-1,4-beta-xylanase activity, polysaccharide catabolic process | 0 | 0.047 | −5.6 | 4.50E−02 |
| 4652 | 3AXg9229.t1 | 4461 | 3BXg511.t1 | None | cell cycle, cell division, cyclin-dependent protein serine/threonine kinase regulator activity, integral component of membrane, regulation of protein kinase activity | 0.02 | 0 | 4.4 | 4.60E−02 |
| 4653 | 3AXg5237.t1 | 4462 | 3BXg5596.t1 | Aminobenzoate degradation, Folate biosynthesis, phoD, Two-component system | metabolic process, oxidation-reduction process | 0.067 | 0 | 6.1 | 4.70E−02 |
| 4654 | 3AXg9949.t1 | 4463 | 3BXg5805.t1 | None | None | 0.061 | 0 | 6 | 5.00E−02 |
| 4655 | 3AXg11247.t1 | 4464 | 3BXg648.t1 | None | integral component of membrane | 0.009 | 0 | 3.3 | 5.00E−02 |
| 4656 | 3AXg9208.t1 | 4465 | 3BXg534.t1 | None | integral component of membrane, membrane | 0.011 | 0.168 | −3.8 | 5.00E−02 |
| 4657 | 3AXg7858.t1 | 4466 | 3BXg1035.t1 | None | flavin adenine dinucleotide binding, membrane, oxidation-reduction process, | 0 | 0.076 | −6.3 | 5.00E−02 |

TABLE 703-continued

| Differential secreted protein abundance between SYM15774 and SYM01331. | | | | | | | |
|---|---|---|---|---|---|---|---|
| SEQ ID Beneficial A. protein | SEQ ID Neutral B. protein | KEGG | GO | A. mean | B. mean | Fold-change | FDR q-value |
| | | | oxidoreductase activity, acting on CH—OH group of donors | | | | |

This table describes the differential protein expression between pairs of orthologous proteins from a genus, where one member of the pair has a beneficial effect on plant growth and the other has a neutral effect. "A.mean" represents the average normalized spectral counts between biological replicates of the beneficial member of the pair. "B.mean" represents the average normalized spectral counts between biological replicates of the neutral member of the pair. "Fold change" represents the fold change difference between the two organisms. "FDR q-value" represents the false discovery rate corrected q-value.

A total of 697 proteins were detected across all *Phoma* samples with two or more unique peptides at the false discovery rates indicated above.

SYM01004 Secreted Proteomic Analysis

TABLE 704

| 25 most abundant proteins secreted by SYM01004; "Median Abundance" represents the median value across three biological replicates in units of spectra per hundred spectra | | | | |
|---|---|---|---|---|
| SEQ ID | Protein ID | Median Abundance | GO Terms | KEGG Terms |
| 4742 | 5AYg748.t1 | 0.999348 | GO: 0005198: structural molecule activity; GO: 0005576: extracellular region; GO: 0009420: bacterial-type flagellum filament; GO: 0071973: bacterial-type flagellum-dependent cell motility | KEGG Orthology: K02406: fliC: flagellin; KEGG PATHWAY: ko02020: Two-component system: Two-component signal transduction systems enable bacteria to sense, respond, and adapt to changes in their environment or in their intracellular state. Each two-component system consists of a sensor protein-histidine kinase (HK) and a response regulator (RR). In the prototypical two-component pathway, the sensor HK phosphorylates its own conserved His residue in response to a signal(s) in the environment. Subsequently, the phosphoryl group of HK is transferred onto a specific Asp residue on the RR. The activated RR can then effect changes in cellular physiology, often by regulating gene expression. Two-component pathways thus often enable cells to sense and respond to stimuli by inducing changes in transcription.; KEGG PATHWAY: ko02040: Flagellar assembly:; KEGG PATHWAY: ko04626: Plant-pathogen interaction: Plants lack animal-like adaptive immunity mechanisms, and therefore have evolved a specific system with multiple layers against invading pathogens. The primary response includes the perception of pathogens by cell-surface pattern-recognition receptors (PRRs) and is referred to as PAMP-triggered immunity (PTI). Activation of FLS2 and EFR triggers MAPK signaling pathway that activates defense genes for antimictobial compounds. The increase in the cytosolic Ca2+ concentration is also a regulator for production of reactive oxygen species and localized programmed cell death/hypersensitive response. The secondary response is called effector-triggered immunity (ETI). Pathogens can acquire the ability to suppress PTI by directly injecting effector proteins into the plant cell through secretion systems. In addition, pathogens can manipulate plant hormone signaling pathways to evade host immune responses using coronatine toxin. Some plants possess specific intracellular surveillance proteins (R proteins) to monitor the presence of pathogen virulence proteins. This ETI occurs with localized programmed cell death to arrest pathogen growth, resulting in cultivar-specific disease resistance.; KEGG PATHWAY: ko05132: |

TABLE 704-continued 25 most abundant proteins secreted by SYM01004; "Median Abundance" represents the median value across three biological replicates in units of spectra per hundred spectra

| SEQ ID | Protein ID | Median Abundance | GO Terms | KEGG Terms |
|---|---|---|---|---|
| | | | | *Salmonella* infection: *Salmonella* infection usually presents as a self-limiting gastroenteritis or the more severe typhoid fever and bacteremia. The common disease-causing *Salmonella* species in human is a single species, *Salmonella enterica*, which has numerous serovars.; KEGG PATHWAY: ko05134: Legionellosis: Legionellosis is a potentially fatal infectious disease caused by the bacterium *Legionella pneumophila* and other *legionella* species. Two distinct clinical and epidemiological syndromes are associated with *Legionella* species: Legionnaires' disease is the more severe form of the infection, which may involve pneumonia, and Pontiac fever is a milder respiratory illness. |
| 4743 | 5AYg747.t1 | 0.973878 | GO: 0005198: structural molecule activity; GO: 0005576: extracellular region; GO: 0009420: bacterial-type flagellum filament; GO: 0071973: bacterial-type flagellum-dependent cell motility | KEGG Orthology: K02406: fliC: flagellin; KEGG PATHWAY: ko02020: Two-component system: Two-component signal transduction systems enable bacteria to sense, respond, and adapt to changes in their environment or in their intracellular state. Each two-component system consists of a sensor protein-histidine kinase (HK) and a response regulator (RR). In the prototypical two-component pathway, the sensor HK phosphorylates its own conserved His residue in response to a signal(s) in the environment. Subsequently, the phosphoryl group of HK is transferred onto a specific Asp residue on the RR. The activated RR can then effect changes in cellular physiology, often by regulating gene expression. Two-component pathways thus often enable cells to sense and respond to stimuli by inducing changes in transcription.; KEGG PATHWAY: ko02040: Flagellar assembly:; KEGG PATHWAY: ko04626: Plant-pathogen interaction: Plants lack animal-like adaptive immunity mechanisms, and therefore have evolved a specific system with multiple layers against invading pathogens. The primary response includes the perception of pathogens by cell-surface pattern-recognition receptors (PRRs) and is referred to as PAMP-triggered immunity (PTI). Activation of FLS2 and EFR triggers MAPK signaling pathway that activates defense genes for antimictobial compounds. The increase in the cytosolic Ca2+ concentration is also a regulator for production of reactive oxygen species and localized programmed cell death/hypersensitive response. The secondary response is called effector-triggered immunity (ETI). Pathogens can acquire the ability to suppress PTI by directly injecting effector proteins into the plant cell through secretion systems. In addition, pathogens can manipulate plant hormone signaling pathways to evade host immune responses using coronatine toxin. Some plants possess specific intracellular surveillance proteins (R proteins) to monitor the presence of pathogen virulence proteins. This ETI occurs with localized programmed cell death to arrest pathogen growth, resulting in cultivar-specific disease resistance.; KEGG PATHWAY: ko05132: *Salmonella* infection: *Salmonella* infection usually presents as a self-limiting gastroenteritis or the more severe typhoid fever and bacteremia. The common disease-causing *Salmonella* species in human is a single species, *Salmonella enterica*, which has numerous serovars.; KEGG PATHWAY: ko05134: Legionellosis: Legionellosis is a potentially fatal infectious disease caused by the bacterium |

TABLE 704-continued

| 25 most abundant proteins secreted by SYM01004; "Median Abundance" represents the median value across three biological replicates in units of spectra per hundred spectra | | | | |
|---|---|---|---|---|
| SEQ ID | Protein ID | Median Abundance | GO Terms | KEGG Terms |
| | | | | *Legionella* pneumophila and other *legionella* species. Two distinct clinical and epidemiological syndromes are associated with *Legionella* species: Legionnaires' disease is the more severe form of the infection, which may involve pneumonia, and Pontiac fever is a milder respiratory illness. |
| 4744 | 5AYg746.t1 | 0.393566 | GO: 0005198: structural molecule activity; GO: 0005576: extracellular region; GO: 0009420: bacterial-type flagellum filament; GO: 0071973: bacterial-type flagellum-dependent cell motility | KEGG Orthology: K02406: fliC: flagellin; KEGG PATHWAY: ko02020: Two-component system: Two-component signal transduction systems enable bacteria to sense, respond, and adapt to changes in their environment or in their intracellular state. Each two-component system consists of a sensor protein-histidine kinase (HK) and a response regulator (RR). In the prototypical two-component pathway, the sensor HK phosphorylates its own conserved His residue in response to a signal(s) in the environment. Subsequently, the phosphoryl group of HK is transferred onto a specific Asp residue on the RR. The activated RR can then effect changes in cellular physiology, often by regulating gene expression. Two-component pathways thus often enable cells to sense and respond to stimuli by inducing changes in transcription.; KEGG PATHWAY: ko02040: Flagellar assembly:; KEGG PATHWAY: ko04626: Plant-pathogen interaction: Plants lack animal-like adaptive immunity mechanisms, and therefore have evolved a specific system with multiple layers against invading pathogens. The primary response includes the perception of pathogens by cell-surface pattern-recognition receptors (PRRs) and is referred to as PAMP-triggered immunity (PTI). Activation of FLS2 and EFR triggers MAPK signaling pathway that activates defense genes for antimictobial compounds. The increase in the cytosolic Ca2+ concentration is also a regulator for production of reactive oxygen species and localized programmed cell death/hypersensitive response. The secondary response is called effector-triggered immunity (ETI). Pathogens can acquire the ability to suppress PTI by directly injecting effector proteins into the plant cell through secretion systems. In addition, pathogens can manipulate plant hormone signaling pathways to evade host immune responses using coronatine toxin. Some plants possess specific intracellular surveillance proteins (R proteins) to monitor the presence of pathogen virulence proteins. This ETI occurs with localized programmed cell death to arrest pathogen growth, resulting in cultivar-specific disease resistance.; KEGG PATHWAY: ko05132: *Salmonella* infection: *Salmonella* infection usually presents as a self-limiting gastroenteritis or the more severe typhoid fever and bacteremia. The common disease-causing *Salmonella* species in human is a single species, *Salmonella enterica*, which has numerous serovars.; KEGG PATHWAY: ko05134: Legionellosis: Legionellosis is a potentially fatal infectious disease caused by the bacterium *Legionella pneumophila* and other *legionella* species. Two distinct clinical and epidemiological syndromes are associated with *Legionella* species: Legionnaires' disease is the more severe form of the infection, which may involve pneumonia, and Pontiac fever is a milder respiratory illness. |

TABLE 704-continued 25 most abundant proteins secreted by SYM01004; "Median Abundance" represents the median value across three biological replicates in units of spectra per hundred spectra

| SEQ ID | Protein ID | Median Abundance | GO Terms | KEGG Terms |
|---|---|---|---|---|
| 4745 | 5AYg329.t1 | 0.208236 | GO: 0004519: endonuclease activity; GO: 0004550: nucleoside diphosphate kinase activity; GO: 0005524: ATP binding; GO: 0005737: cytoplasm; GO: 0006165: nucleoside diphosphate phosphorylation; GO: 0006183: GTP biosynthetic process; GO: 0006228: UTP biosynthetic process; GO: 0006241: CTP biosynthetic process; GO: 0046872: metal ion binding; GO: 0090305: nucleic acid phosphodiester bond hydrolysis | KEGG Orthology: K00940: ndk, NME: nucleoside-diphosphate kinase [EC: 2.7.4.6]; KEGG PATHWAY: ko00230: Purine metabolism:; KEGG PATHWAY: ko00240: Pyrimidine metabolism: |
| 4746 | 5AYg1483.t1 | 0.204231 | GO: 0015288: porin activity; GO: 0016020: membrane; GO: 0055085: transmembrane transport | none |
| 4747 | 5AYg1901.t1 | 0.201732 | GO: 0004970: ionotropic glutamate receptor activity; GO: 0006810: transport; GO: 0016020: membrane; GO: 0030288: outer membrane-bounded periplasmic space; GO: 0035235: ionotropic glutamate receptor signaling pathway | KEGG Orthology: K02030: ABC.PA.S: polar amino acid transport system substrate-binding protein |
| 4748 | 5AYg2621.t1 | 0.184662 | GO: 0003735: structural constituent of ribosome; GO: 0005840: ribosome; GO: 0006412: translation | KEGG Orthology: K02884: RP-L19, MRPL19, rplS: large subunit ribosomal protein L19; KEGG PATHWAY: ko03010: Ribosome: |
| 4749 | 5AYg1882.t1 | 0.177 | GO: 0003735: structural constituent of ribosome; GO: 0005840: ribosome; GO: 0006412: translation | KEGG Orthology: K02879: RP-L17, MRPL17, rplQ: large subunit ribosomal protein L17; KEGG PATHWAY: ko03010: Ribosome: |
| 4750 | 5AYg89.t1 | 0.175201 | GO: 0000049: tRNA binding; GO: 0003735: structural constituent of ribosome; GO: 0006412: translation; GO: 0015935: small ribosomal subunit; GO: 0019843: rRNA binding | KEGG Orthology: K02992: RP-S7, MRPS7, rpsG: small subunit ribosomal protein S7; KEGG PATHWAY: ko03010: Ribosome: |
| 4751 | 5AYg1281.t1 | 0.167696 | GO: 0006935: chemotaxis; GO: 0042597: periplasmic space | KEGG Orthology: K10546: ABC.GGU.S, chvE: putative multiple sugar transport system substrate-binding protein; KEGG PATHWAY: ko02010: ABC transporters: The ATP-binding cassette (ABC) transporters form one of the largest known protein families, and are widespread in bacteria, archaea, and eukaryotes. They couple ATP hydrolysis to active transport of a wide variety of substrates such as ions, sugars, lipids, sterols, peptides, proteins, and drugs. The structure of a prokaryotic ABC transporter usually consists of three components; typically two integral membrane proteins each having six transmembrane segments, two peripheral proteins that bind and hydrolyze ATP, and a periplasmic (or lipoprotein) substrate-binding protein. Many of the genes for the three components form operons as in fact observed in many bacterial and archaeal genomes. On the other hand, in a typical eukaryotic ABC transporter, the membrane spanning protein and the ATP-binding protein are fused, formirig |

TABLE 704-continued

| 25 most abundant proteins secreted by SYM01004; "Median Abundance" represents the median value across three biological replicates in units of spectra per hundred spectra | | | | |
|---|---|---|---|---|
| SEQ ID | Protein ID | Median Abundance | GO Terms | KEGG Terms |
| | | | | a multi-domain protein with the membrane-spanning domain (MSD) and the nucleotide-binding domain (NBD). |
| 4752 | 5AYg777.t1 | 0.156177 | GO: 0000413: protein peptidyl-prolyl isomerization; GO: 0003755: peptidyl-prolyl cis-trans isomerase activity; GO: 0006457: protein folding | KEGG Orthology: K03768: PPIB, ppiB: peptidyl-prolyl cis-trans isomerase B (cyclophilin B) [EC: 5.2.1.8] |
| 4753 | 5AYg1692.t1 | 0.155178 | GO: 0003677: DNA binding; GO: 0005737: cytoplasm; GO: 0006355: regulation of transcription, DNA-templated | KEGG Orthology: K03704: cspA: cold shock protein (beta-ribbon, CspA family) |
| 4754 | 5AYg1247.t1 | 0.152662 | GO: 0006865: amino acid transport | KEGG Orthology: K01999: livK: branched-chain amino acid transport system substrate-binding protein; KEGG PATHWAY: ko02010: ABC transporters: The ATP-binding cassette (ABC) transporters form one of the largest known protein families, and are widespread in bacteria, archaea, and eukaryotes. They couple ATP hydrolysis to active transport of a wide variety of substrates such as ions, sugars, lipids, sterols, peptides, proteins, and drugs. The structure of a prokaryotic ABC transporter usually consists of three components; typically two integral membrane proteins each having six transmembrane segments, two peripheral proteins that bind and hydrolyze ATP, and a periplasmic (or lipoprotein) substrate-binding protein. Many of the genes for the three components form operons as in fact observed in many bacterial and archaeal genomes. On the other hand, in a typical eukaryotic ABC transporter, the membrane spanning protein and the ATP-binding protein are fused, forming a multi-domain protein with the membrane-spanning domain (MSD) and the nucleotide-binding domain (NBD). |
| 4755 | 5AYg2256.t1 | 0.149078 | GO: 0016021: integral component of membrane | KEGG Orthology: K16079: omp31: outer membrane immunogenic protein |
| 4756 | 5AYg208.t1 | 0.14751 | GO: 0003735: structural constituent of ribosome; GO: 0006412: translation; GO: 0015935: small ribosomal subunit; GO: 0019843: rRNA binding | KEGG Orthology: K02986: RP-54, rpsD: small subunit ribosomal protein S4; KEGG PATHWAY: ko03010: Ribosome: |
| 4757 | 5AYg1876.t1 | 0.146416 | GO: 0000049: tRNA binding; GO: 0003735: structural constituent of ribosome; GO: 0005840: ribosome; GO: 0006412: translation; GO: 0019843: rRNA binding | KEGG Orthology: K02931: RP-L5, MRPL5, rplE: large subunit ribosomal protein L5; KEGG PATHWAY: ko03010: Ribosome: |
| 4758 | 5AYg998.t1 | 0.145775 | GO: 0004801: sedoheptulose-7-phosphate: D-glyceraldehyde-3-phosphate glyceronetransferase activity; GO: 0005737: cytoplasm; GO: 0005975: carbohydrate metabolic process; GO: 0006098: pentose-phosphate shunt | KEGG Orthology: K00616: E2.2.1.2, talA, talB: transaldolase [EC: 2.2.1.2]; KEGG PATHWAY: ko00030: Pentose phosphate pathway: The pentose phosphate pathway is a process of glucose turnover that produces NADPH as reducing equivalents and pentoses as essential parts of nucleotides. There are two different phases in the pathway. One is irreversible oxidative phase in which glucose-6P is converted to ribulose-5P by oxidative decarboxylation, and NADPH is generated [MD: M00006]. The other is reversible non-oxidative phase in which phosphorylated sugars are interconverted to generate xylulose-5P, ribulose-5P, and ribose-5P [MD: M00007]. Phosphoribosyl pyrophosphate (PRPP) formed from ribose-5P [MD: M00005] is an activated compound used in the biosynthesis of histidine and purine/pyrimidine nucleotides. This |

TABLE 704-continued 25 most abundant proteins secreted by SYM01004; "Median Abundance" represents the median value across three biological replicates in units of spectra per hundred spectra

| SEQ ID | Protein ID | Median Abundance | GO Terms | KEGG Terms |
|---|---|---|---|---|
| | | | | pathway map also shows the Entner-Doudoroff pathway where 6-P-gluconate is dehydrated and then cleaved into pyruvate and glyceraldehyde-3P [MD: M00008].; KEGG PATHWAY: ko01200: Carbon metabolism: Carbon metabolism is the most basic aspect of life. This map presents an overall view of central carbon metabolism, where the number of carbons is shown for each compound denoted by a circle, excluding a cofactor (CoA, CoM, THF, or THMPT) that is replaced by an asterisk. The map contains carbon utilization pathways of glycolysis (map00010), pentose phosphate pathway (map00030), and citrate cycle (map00020), and six known carbon fixation pathways (map00710 and map00720) as well as some pathways of methane metabolism (map00680). The six carbon fixation pathways are: (1) reductive pentose phosphate cycle (Calvin cycle) in plants and cyanobacteria that perform oxygenic photosynthesis, (2) reductive citrate cycle in photosynthetic green sulfur bacteria and some chemolithoautotrophs, (3) 3-hydroxypropionate bi-cycle in photosynthetic green nonsulfur bacteria, two variants of 4-hydroxybutyrate pathways in Crenarchaeota called (4) hydroxypropionate-hydroxybutyrate cycle and (5) dicarboxylate-hydroxybutyrate cycle, and (6) reductive acetyl-CoA pathway in methanogenic bacteria.; KEGG PATHWAY: ko01230: Biosynthesis of amino acids: This map presents a modular architecture of the biosynthesis pathways of twenty amino acids, which may be viewed as consisting of the core part and its extensions. The core part is the KEGG module for conversion of three-carbon compounds from glyceraldehyde-3P to pyruvate [MD: M00002], together with the pathways around serine and glycine. This KEGG module is the most conserved one in the KEGG MODULE database and is found in almost all the completely sequenced genomes. The extensions are the pathways containing the reaction modules RM001, RM033, RM032, and RM002 for biosynthesis of branched-chain amino acids (left) and basic amino acids (bottom), and the pathways for biosynthesis of histidine and aromatic amino acids (top right). It is interesting to note that the so-called essential amino acids that cannot be synthesized in human and other organisms generally appear in these extensions. Furthermore, the bottom extension of basic amino acids appears to be most divergent containing multiple pathways for lysine biosynthesis and multiple gene sets for arginine biosynthesis. |
| 4759 | 5AYg1162.t1 | 0.144833 | GO: 0006006: glucose metabolic process; GO: 0016620: oxidoreductase activity, acting on the aldehyde or oxo group of donors, NAD or NADP as acceptor; GO: 0050661: NADP binding; GO: 0051287: NAD binding; GO: 0055114: oxidation-reduction process | KEGG Orthology: K00134: GAPDH, gapA: glyceraldehyde 3-phosphate dehydrogenase [EC: 1.2.1.12]; KEGG PATHWAY: ko00010: Glycolysis/Gluconeogenesis: Glycolysis is the process of converting glucose into pyruvate and generating small amounts of ATP (energy) and NADH (reducing power). It is a central pathway that produces important precursor metabolites: six-carbon compounds of glucose-6P and fructose-6P and three-carbon compounds of glycerone-P, glyceraldehyde-3P, glycerate-3P, phosphoenolpyruvate, and pyruvate [MD: M00001]. Acetyl-CoA, another important precursor metabolite, is produced by oxidative decarboxylation of pyruvate [MD: M00307]. When the enzyme genes of this pathway are. examined in completely sequenced genomes, |

TABLE 704-continued

| 25 most abundant proteins secreted by SYM01004; "Median Abundance" represents the median value across three biological replicates in units of spectra per hundred spectra | | | | |
|---|---|---|---|---|
| SEQ ID | Protein ID | Median Abundance | GO Terms | KEGG Terms |
| | | | | the reaction steps of three-carbon compounds from glycerone-P to pyruvate form a conserved core module [MD: M00002], which is found in almost all organisms and which sometimes contains operon structures in bacterial genomes. Gluconeogenesis is a synthesis pathway of glucose from noncarbohydrate precursors. It is essentially a reversal of glycolysis with minor variations of alternative paths [MD: M00003].; KEGG PATHWAY: ko00710: Carbon fixation in photosynthetic organisms:; KEGG PATHWAY: ko01200: Carbon metabolism: Carbon metabolism is the most basic aspect of life. This map presents an overall view of central carbon metabolism, where the number of carbons is shown for each compound denoted by a circle, excluding a cofactor (CoA, CoM, THF, or THMPT) that is replaced by an asterisk. The map contains carbon utilization pathways of glycolysis (map00010), pentose phosphate pathway (map00030), and citrate cycle (map00020), and six known carbon fixation pathways (map00710 and map00720) as well as some pathways of methane metabolism (map00680). The six carbon fixation pathways are: (1) reductive pentose phosphate cycle (Calvin cycle) in plants and cyanobacteria that perform oxygenic photosynthesis, (2) reductive citrate cycle in photosynthetic green sulfur bacteria and some chemolithoautotrophs, (3) 3-hydroxypropionate bi-cycle in photosynthetic green nonsulfur bacteria, two variants of 4-hydroxybutyrate pathways in Crenarchaeota called (4) hydroxypropionate-hydroxybutyrate cycle and (5) dicarboxylate-hydroxybutyrate cycle, and (6) reductive acetyl-CoA pathway in methanogenic bacteria.; KEGG PATHWAY: ko01230: Biosynthesis of amino acids: This map presents a modular architecture of the biosynthesis pathways of twenty amino acids, which may be viewed as consisting of the core part and its extensions. The core part is the KEGG module for conversion of three-carbon compounds from glyceraldehyde-3P to pyruvate [MD: M00002], together with the pathways around serine and glycine. This KEGG module is the most conserved one in the KEGG MODULE database and is found in almost all the completely sequenced genomes. The extensions are the pathways containing the reaction modules RM001, RM033, RM032, and RM002 for biosynthesis of branched-chain amino acids (left) and basic amino acids (bottom), and the pathways for biosynthesis of histidine and aromatic amino acids (top right). It is interesting to note that the so-called essential amino acids that cannot be synthesized in human and other organisms generally appear in these extensions. Furthermore, the bottom extension of basic amino acids appears to be most divergent containing multiple pathways for lysine biosynthesis and multiple gene sets for arginine biosynthesis.; KEGG PATHWAY: ko04066: HIF-1 signaling pathway: Hypoxia-inducible factor 1 (HIF-1) is a transcription factor that functions as a master regulator of oxygen homeostasis. It consists of two subunits: an inducibly-expressed HIF-1alpha subunit and a constitutively-expressed HIF-1beta subunit. Under normoxia, HIF-1 alpha undergoes hydroxylation at specific prolyl residues which leads to an immediate ubiquitination and subsequent proteasomal degradation of the subunit. In contrast, under |

TABLE 704-continued 25 most abundant proteins secreted by SYM01004; "Median Abundance" represents the median value across three biological replicates in units of spectra per hundred spectra

| SEQ ID | Protein ID | Median Abundance | GO Terms | KEGG Terms |
|---|---|---|---|---|
| | | | | hypoxia, HIF-1 alpha subunit becomes stable and interacts with coactivators such as p300/CBP to modulate its transcriptional activity. Eventually, HIF-1 acts as a master regulator of numerous hypoxia-inducible genes under hypoxic conditions. The target genes of HIF-1 encode proteins that increase O2 delivery and mediate adaptive responses to O2 deprivation. Despite its name, HIF-1 is induced not only in response to reduced oxygen availability but also by other stimulants, such as nitric oxide, or various growth factors.; KEGG PATHWAY: ko05010: Alzheimer's disease: Alzheimer's disease (AD) is a chronic disorder that slowly destroys neurons and causes serious cognitive disability. AD is associated with senile plaques and neurofibrillary tangles (NFTs). Amyloid-beta (Abeta), a major component of senile plaques, has various pathological effects on cell and organelle function. The extracellular Abeta oligomers may activate caspases through activation of cell surface death receptors. Alternatively, intracellular Abeta may contribute to pathology by facilitating tau hyper-phosphorylation, disrupting mitochondria function, and triggering calcium dysfunction. To date genetic studies have revealed four genes that may be linked to autosomal dominant or familial early onset AD (FAD). These four genes include: amyloid precursor protein (APP), presenilin 1 (PS1), presenilin 2 (PS2) and apolipoprotein E (ApoE). All mutations associated with APP and PS proteins can lead to an increase in the production of Abeta peptides, specfically the more amyloidogenic form, Abeta42. FAD-linked PS1 mutation downregulates the unfolded protein response and leads to vulnerability to ER stress. |
| 4760 | 5AYg287.t1 | 0.138824 | GO: 0003677: DNA binding; GO: 0030261: chromosome condensation | KEGG Orthology: K03530: hupB: DNA-binding protein HU-beta |
| 4761 | 5AYg677.t1 | 0.137328 | GO: 0005524: ATP binding; GO: 0005737: cytoplasm; GO:0016491: oxidoreductase activity; GO: 0042026: protein refolding; GO: 0051082: unfolded protein binding; GO: 0055114: oxidation-reduction process | KEGG Orthology: K04077: groEL, HSPD1: chaperonin GroEL; KEGG PATHWAY: ko03018: RNA degradation: The correct processing, quality control and turnover of cellular RNA molecules are critical to many aspects in the expression of genetic information. In eukaryotes, two major pathways of mRNA decay exist and both pathways are initiated by poly(A) shortening of the mRNA. In the 5' to 3' pathway, this is followed by decapping which then permits the 5' to 3' exonucleolytic degradation of transcripts. In the 3' to 5' pathway, the exosome, a large multisubunit complex, plays a key role. The exosome exists in archaeal cells, too. In bacteria, endoribonuclease E, a key enzyme involved in RNA decay and processing, organizes a protein complex called degradosome. RNase E or R interacts with the phosphate-dependent exoribonuclease polynucleotide phosphorylase, DEAD-box helicases, and additional factors in the RNA-degrading complex.; KEGG PATHWAY: ko04940: Type I diabetes mellitus: Type I diabetes mellitus is a disease that results from. autoimmune destruction of the insulin-producing beta-cells. Certain beta-cell proteins act as autoantigens after being processed by antigen-presenting cell (APC), such as macrophages and dendritic cells, and presented in a complex with MHC-II molecules on the surface of the APC. Then immunogenic signals from APC activate CD4+ T cells, predominantly |

TABLE 704-continued 25 most abundant proteins secreted by SYM01004; "Median Abundance" represents the median value across three biological replicates in units of spectra per hundred spectra

| SEQ ID | Protein ID | Median Abundance | GO Terms | KEGG Terms |
|---|---|---|---|---|
| | | | | of the Th1 subset. Antigen-activated Th1 cells produce IL-2 and IFNgamma. They activate macrophages and cytotoxic CD8+ T cells, and these effector cells may kill islet beta-cells by one or both of two types of mechanisms: (1) direct interactions of antigen-specific cytotoxic T cells with a beta-cell autoantigen-MHC-I complex on the beta-cell, and (2) non-specific inflammatory mediators, such as free radicals/oxidants and cytokines (IL-1, TNFalpha, TNFbeta, IFNgamma).; KEGG PATHWAY: ko05134: Legionellosis: Legionellosis is a potentially fatal infectious disease caused by the bacterium *Legionella pneumophila* and other *legionella* species. Two distinct clinical and epidemiological syndromes are associated with *Legionella* species: Legionnaires' disease is the more severe form of the infection, which may involve pneumonia, and Pontiac fever is a milder respiratory illness.; KEGG PATHWAY: ko05152: Tuberculosis: Tuberculosis, or TB, is an infectious disease caused by *Mycobacterium tuberculosis*. One third of the world's population is thought to be infected with TB. About 90% of those infected result in latent infections, and about 10% of latent infections develop active diseases when their immune system is impaired due to the age, other diseases such as AIDS or exposure to immunosuppressive drugs. TB is transmitted thrciugh the air and primarily attacks the lungs, then it can spread by the circulatory system to other parts of body. Once TB bacilli have entered the host by the respiratory route and infected macrophages in the lungs, they interfere with phagosomal maturation, antigen presentation, apoptosis and host immune system to establish persistent or latent infection. |
| 4762 | 5AYg2260.t1 | 0.135 | GO: 0043190: ATP-binding cassette (ABC) transporter complex; GO: 0055085: transmembrane transport | KEGG Orthology: K12368: dppA: dipeptide transport system substrate-binding protein; KEGG PATHWAY: ko02010: ABC transporters: The ATP-binding cassette (ABC) transporters form one of the largest known protein families, and are widespread in bacteria, archaea, and eukaryotes. They couple ATP hydrolysis to active transport of a wide variety of substrates such as ions, sugars, lipids, sterols, peptides, proteins, and drugs. The structure of a prokaryotic ABC transporter usually consists of three components; typically two integral membrane proteins each having six transmembrane segments, two peripheral proteins that bind and hydrolyze ATP, and a periplasmic (or lipoprotein) substrate-binding protein. Many of the genes for the three components form operons as in fact observed in many bacterial and archaeal genomes. On the other hand, in a typical eukaryotic ABC transporter, the membrane spanning protein and the ATP-binding protein are fused, forming a multi-domain protein with the membrane-spanning domain (MSD) and the nucleotide-binding domain (NBD).; KEGG PATHWAY: ko02030: Bacterial chemotaxis: Chemotaxis is the process by which cells sense chemical gradients in their environment and then move towards more favorable conditions. In chemotaxis, events at the receptors control autophosphorylation of the CheA histidine kinase, and the phosphohistidine is the substrate for the response regulator CheY, which catalyzes the transfer of the phosphoryl |

TABLE 704-continued 25 most abundant proteins secreted by SYM01004; "Median Abundance" represents the median value across three biological replicates in units of spectra per hundred spectra

| SEQ ID | Protein ID | Median Abundance | GO Terms | KEGG Terms |
|---|---|---|---|---|
| | | | | group to a conserved aspartate. The resulting CheY-P can interact with the switch mechanism in the motor. This interaction causes a change in behavior, such as in direction or speed of rotation of flagella. |
| 4763 | 5AYg980.t1 | 0.133866 | GO: 0016021: integral component of membrane | KEGG Orthology: K16079: omp31: outer membrane immunogenic protein |
| 4764 | 5AYg2744.t1 | 0.131774 | GO: 0000413: protein peptidyl-prolyl isomerization; GO: 0003755: peptidyl-prolyl cis-trans isomerase activity | KEGG Orthology: K03769: ppiC: peptidyl-prolyl cis-trans isomerase C [EC:5.2.1.8] |
| 4765 | 5AYg2575.t1 | 0.130147 | GO: 0003735: structural constituent of ribosome; GO: 0005840: ribosome; GO: 0006412: translation; GO: 0019843: rRNA binding | KEGG Orthology: K02899: RP-L27, MRPL27, rpmA: large subunit ribosomal protein L27; KEGG PATHWAY: ko03010: Ribosome: |
| 4766 | 5AYg676.t1 | 0.128736 | GO: 0005524: ATP binding; GO: 0005737: cytoplasm; GO: 0006457: protein folding | KEGG Orthology: K04078: groES, HSPE1: chaperonin GroES |

SYM01004 Versus SYM00091

TABLE 705

Differential secreted protein abundance between SYM01004 and SYM00091.

| SEQ ID Beneficial | A.protein | SEQ ID Neutral | B.protein | KEGG | GO | A.mean | B.mean | Fold-change | FDR q-value |
|---|---|---|---|---|---|---|---|---|---|
| 4734 | 5AYg1329.t1 | 4671 | 5BYg3790.t1 | ade, Purine metabolism | adenine catabolic process, adenine deaminase activity | 0.057 | 0 | 5.9 | 3.90E−02 |
| 4735 | 5AYg1185.t1 | 4672 | 5BYg649.t1 | Biosynthesis of amino acids, Carbon metabolism, Glycine, serine and threonine metabolism, Methane metabolism, serA, PHGDH | L-serine biosynthetic process, NAD binding, oxidation-reduction process, phosphoglycerate dehydrogenase activity | 0 | 0.009 | −3.3 | 4.90E−02 |
| 4736 | 5AYg1107.t1 | 4673 | 5BYg1291.t1 | ABC transporters, ABC.MS.S, msmX, msmK, malK, sugC, ggtA, msiK | ATP binding, ATP-binding cassette (ABC) transporter complex, ATPase activity, carbohydrate transport, hydrolase activity, acting on acid anhydrides, catalyzing transmembrane movement of substances, metabolic process, transmembrane transport, transporter activity | 0.008 | 0 | 3.2 | 4.40E−02 |
| 4737 | 5AYg12621.t1 | 4674 | 5BYg1034.t1 | None | integral component of membrane, transport, transporter activity | 0 | 0.007 | −3.1 | 4.00E−02 |
| 4738 | 5AYg1075.t1 | 4675 | 5BYg577.t1 | E2.4.1.1, glgP, PYG, Insulin signaling pathway, Starch and sucrose metabolism | carbohydrate metabolic process, glycogen phosphorylase activity, pyridoxal phosphate binding | 0 | 0.007 | −2.9 | 3.00E−02 |
| 4739 | 5AYg1184.t1 | 4676 | 5BYg648.t1 | Biosynthesis of amino acids, Carbon metabolism, Glycine, serine and threonine metabolism, Methane metabolism, serC, PSAT1, Vitamin B6 metabolism | cytoplasm, L-serine biosynthetic process, O-phospho-L-serine:2-oxoglutarate aminotransferase activity | 0.036 | 0.005 | 2.7 | 4.90E−02 |
| 4740 | 5AYg126.t1 | 4677 | 5BYg3243.t1 | Carbon metabolism, GLDC, gcvP, Glycine, serine and threonine | glycine decarboxylation via glycine cleavage system, glycine dehydrogenase | 0.032 | 0.006 | 2.2 | 3.90E−02 |

TABLE 705-continued

| Differential secreted protein abundance between SYM01004 and SYM00091. | | | | | | | | | |
|---|---|---|---|---|---|---|---|---|---|
| SEQ ID Beneficial | A.protein | SEQ ID Neutral | B.protein | KEGG | GO | A.mean | B.mean | Fold-change | FDR q-value |
| | | | | metabolism | (decarboxylating) activity, lyase activity, oxidation-reduction process | | | | |
| 4741 | 5AYg124.t1 | 14678 | 5BYg3241.t1 | K09796 | None | 0.019 | 0.004 | 2.1 | 3.90E−02 |

This table describes the differential protein expression between pairs of orthologous proteins from a genus, where one member of the pair has a beneficial effect on plant growth and the other has a neutral effect. "A.mean" represents the average normalized spectral counts between biological replicates of the beneficial member of the pair. "B.mean" represents the average normalized spectral counts between biological replicates of the neutral member of the pair. "Fold change" represents the fold change difference between the two organisms. "FDR q-value" represents the false discovery rate corrected q-value.

A total of 1390 proteins were detected across all *Agrobacterium* samples with two or more unique peptides at the false discovery rates indicated above.

KEGG Pathway Enrichment of Beneficial Fungi Versus Neutral Fungi

TABLE 706

| KEGG Pathway enrichment of beneficial fungi versus neutral fungi | | | | | | | | |
|---|---|---|---|---|---|---|---|---|
| Category | KEGG ID | Name | Description | SEQ ID Beneficial | A.Protein.ID | SEQ ID Neutral | B.Protein.ID | FDR q-value |
| KEGG PATHWAY | ko00500 | Starch and sucrose metabolism | none | 643; 2293; 2292; 874; 480; 2288; 487; 2285; 580; 2279; 4543; 4515; 4669; 4668; 4666; 4615; 4573; 4661; 4659; 4571 | 1AXg13171.t1, 1AXg2246.t1, 1AXg2742.t1, 1AXg2815.t1, 1AXg3149.t1, 1AXg4053.t1, 1AXg5358.t1, 1AXg5538.t1, 1AXg5751.t1, 1AXg8814.t1, 3AXg10791.t1, 3AXg10862.t1, 3AXg1436.t1, 3AXg192.t1, 3AXg2790.t1, 3AXg4536.t1, 3AXg4810.t1, 3AXg6314.t1, 3AXg7872.t1, 3AXg9121.t1 | 4104; 4126; 4125; 2443; 4097; 4122; 2349; 4118; 2382; 2436; 2377; 2350; 2721; 2470; 4508; 4413; 4507; 4505; 4422; 4500; 4433; 4410; 4423; 4491; 4487; 4442; 4346; 4484 | 1BXg10106.t1, 1BXg10460.t1, 1BXg10656.t1, 1BXg1289.t1, 1BXg135.t1, 1BXg1561.t1, 1BXg2692.t1, 1BXg3232.t1, 1BXg3531.t1, 1BXg4362.t1, 1BXg4998.t1, 1BXg5592.t1, 1BXg9114.t1, 1BXg9824.t1, 3BXg11320.t1, 3BXg14385.t1, 3BXg1864.t1, 3BXg2317.t1, 3BXg3121.t1, 3BXg3387.t1, 3BXg6481.t1, 3BXg6843.t1, 3BXg6890.t1, 3BXg7356.t1, 3BXg928.t1, 3BXg9632.t1, 3BXg9786.t1, 3BXg9960.t1 | 2.92E−10 |
| KEGG Orthology | K08257 | E3.2.1.101 | mannan endo-1,6-alpha-mannosidase [EC: 3.2.1.101] | 2277; 528; 623; 2278; 4663; 4585 | 1AXg10033.t1, 1AXg4291.t1, 1AXg459.t1, 1AXg9931.t1, 3AXg512.t1, 3AXg7050.t1 | 2457; 4121; 4112; 2422; 4391; 4499; 4492 | 1BXg12075.t1, 1BXg1595.t1, 1BXg6031.t1, 1BXg8019.t1, 3BXg10636.t1, 3BXg3817.t1, 3BXg7176.t1 | 2.62E−05 |
| KEGG Orthology | K18576 | XEG | xyloglucan-specific endo-beta-1,4-glucanase [EC: 3.2.1.151] | 2273; 1249; 4540 | 1AXg6048.t1, 1AXg9842.t1, 3AXg10237.t1 | 2390; 4109; 3093; 4509; 4343 | 1BXg307.t1, 1BXg8240.t1, 1BXg9770.t1, 3BXg10794.t1, 3BXg1101.t1 | 4.04E−05 |
| KEGG PATHWAY | ko00040 | Pentose and glucuronate interconversions | none | 480; 4515; 4666; 4571 | 1AXg3149.t1, 3AXg10862.t1, 3AXg2790.t1, 3AXg9121.t1 | 4099; 2377; 4106; 4442 | 1BXg12260.t1, 1BXg4998.t1, 1BXg941.t1, 3BXg9632.t1 | 0.000335 |
| KEGG Orthology | K00505 | TYR | tyrosinase [EC: 1.14.18.1] | 2275; 4609; 4528; 4660 | 1AXg11951.t1, 3AXg2591.t1, 3AXg2961.t1, 3AXg6319.t1 | 4096; 4113; 4415; 4501; 4369; | 1BXg5424.t1, 1BXg5696.t1, 3BXg1833.t1, 3BXg3225.t1, 3BXg390.t1, | 0.002931 |

TABLE 706-continued

KEGG Pathway enrichment of beneficial fungi versus neutral fungi

| Category | KEGG ID | Name | Description | SEQ ID Beneficial | A.Protein.ID | SEQ ID Neutral | B.Protein.ID | FDR q-value |
|---|---|---|---|---|---|---|---|---|
| | | | | | | 4498; 4495; 4394; 4488 | 3BXg3977.t1, 3BXg6039.t1, 3BXg8171.t1, 3BXg8955.t1 | |
| KEGG PATHWAY | ko00052 | Galactose metabolism | none | 874; 2291; 4669; 4615; 4661 | 1AXg2815.t1, 1AXg325.t1, 3AXg1436.t1, 3AXg4536.t1, 3AXg6314.t1 | 4097; 2382; 2350; 2721; 4508; 4422; 4496; 4494; 4410; 4491; 4484 | 1BXg135.t1, 1BXg3531.t1, 1BXg5592.t1, 1BXg9114.t1, 3BXg11320.t1, 3BXg3121.t1, 3BXg5975.t1, 3BXg6701.t1, 3BXg6843.t1, 3BXg7356.t1, 3BXg9960.t1 | 0.003136 |
| KEGG PATHWAY | ko00965 | Betalain biosynthesis | Betalains are water-soluble nitrogen-containing pigments that are present in plants belonging to the order Caryophyllales (such as cactus and amaranth families) and in higher fungi. They contain betalamic acid as the chromophore and are classified into two types: betacyanins and betaxanthins. Betacyanins contain a cyclo-DOPA residue and exhibit red/violet coloration, while betaxanthins contain different amino acids or amino side chains and exhibit a yellow/orange coloration. The condensation of betalamic acid with amino acids (including cyclo-DOPA or amines) in plants is a spontaneous reaction, not an enzyme-catalyzed reaction. | 2275; 4609; 4528; 4660 | 1AXg11951.t1, 3AXg2591.t1, 3AXg2961.t1, 3AXg6319.t1 | 4096; 4113; 4415; 4501; 4369; 4498; 4495; 4394; 4488 | 1BXg5424.t1, 1BXg5696.t1, 3BXg1833.t1, 3BXg3225.t1, 3BXg390.t1, 3BXg3977.t1, 3BXg6039.t1, 3BXg8171.t1, 3BXg8955.t1 | 0.003618 |
| KEGG PATHWAY | ko04916 | Melanogenesis | Cutaneous melanin pigment plays a critical role in camouflage, mimicry, social communication, and protection against harmful effects of solar radiation. Melanogenesis is under complex regulatory control by multiple agents. The most important | 2275; 665; 4609; 4528; 4660 | 1AXg11951.t1, 1AXg4299.t1, 3AXg2591.t1, 3AXg2961.t1, 3AXg6319.t1 | 2320; 4096; 4113; 4415; 4501; 4369; 4498; 4495; 4394; 4488 | 1BXg11664.t1, 1BXg5424.t1, 1BXg5696.t1, 3BXg1833.t1, 3BXg3225.t1, 3BXg390.t1, 3BXg3977.t1, 3BXg6039.t1, 3BXg8171.t1, 3BXg8955.t1 | 0.005636 |

TABLE 706-continued

| KEGG Pathway enrichment of beneficial fungi versus neutral fungi | | | | | | | | |
|---|---|---|---|---|---|---|---|---|
| Category | KEGG ID | Name | Description | SEQ ID Beneficial | A.Protein.ID | SEQ ID Neutral | B.Protein.ID | FDR q-value |
| | | | positive regulator of melanogenesis is the MC1 receptor with its ligands melanocortic peptides. MC1R activates the cyclic AMP (cAMP) response-element binding protein (CREB). Increased expression of MITF and its activation by phosphorylation (P) stimulate the transcription of tyrosinase (TYR), tyrosinase-related protein 1 (TYRP1), and dopachrome tautomerase (DCT), which produce melanin. Melanin synthesis takes place within specialized intracellular organelles named melanosomes. Melanin-containing melanosomes then move from the perinuclear region to the dendrite tips and are transferred to keratinocytes by a still not well-characterized mechanism. | | | | | |
| KEGG PATHWAY | ko04142 | Lysosome | Lysosomes are membrane-delimited organelles in animal cells serving as the cell's main digestive compartment to which all sorts of macromolecules are delivered for degradation. They contain more than 40 hydrolases in an acidic environment (pH of about 5). After synthesis in the ER, lysosomal enzymes are decorated with mannose-6-phosphate residues, which are recognized by mannose-6-phosphate receptors in the | 521; 2295; 608; 2290; 2289; 2286; 2282; 4559; 4670; 4665; 4525; 4526; 4624 | 1AXg11059.t1, 1AXg12307.t1, 1AXg1785.t1, 1AXg3652.t1, 1AXg3653.t1, 1AXg5534.t1, 1AXg7972.t1, 3AXg10485.t1, 3AXg10865.t1, 3AXg3114.t1, 3AXg5987.t1, 3AXg8810.t1, 3AXg9670.t1 | 4102; 4124; 2407; 4116; 4111; 4107; 4506; 4353; 4497; 4432; 4386; 4362; 4485 | 1BXg10249.t1, 1BXg11338.t1, 1BXg1175.t1, 1BXg4075.t1, 1BXg7402.t1, 1BXg9090.t1, 3BXg2203.t1, 3BXg4014.t1, 3BXg4508.t1, 3BXg5175.t1, 3BXg5319.t1, 3BXg821.t1, 3BXg9634.t1 | 0.009426 |

TABLE 706-continued

KEGG Pathway enrichment of beneficial fungi versus neutral fungi

| Category | KEGG ID | Name | Description | SEQ ID Beneficial | A.Protein.ID | SEQ ID Neutral | B.Protein.ID | FDR q-value |
|---|---|---|---|---|---|---|---|---|
| | | | trans-Golgi network. They are packaged into clathrin-coated vesicles and are transported to late endosomes. Substances for digestion are acquired by the lysosomes via a series of processes including endocytosis, phagocytosis, and autophagy. | | | | | |
| KEGG PATHWAY | ko00950 | Isoquinoline alkaloid biosynthesis | Isoquinoline alkaloids are tyrosine-derived plant alkaloids with an isoquinoline skeleton. Among them benzylisoquinoline alkaloids form an important group with potent pharmacological activity, including analgesic compounds of morphine and codeine, and anti-infective agents of berberine, palmatine, and magnoflorine. Biosynthesis of isoquinoline alkaloids proceeds via decarboxylation of tyrosine or DOPA to yield dopamine, which together with 4-hydroxyphenylacetaldehyde, an aldehyde derived from tyrosine, is converted to reticuline, an important precursor of various benzylisoquinoline alkaloids. | 2275; 1342; 4609; 4528; 4660 | 1AXg11951.t1, 1AXg7766.t1, 3AXg2591.t1, 3AXg2961.t1, 3AXg6319.t1 | 4098; 4119; 4096; 4113; 4108; 3185; 4415; 4501; 4369; 4498; 4495; 4493; 4394; 4488 | 1BXg12278.t1, 1BXg2903.t1, 1BXg5424.t1, 1BXg5696.t1, 1BXg8510.t1, 1BXg886.t1, 3BXg1833.t1, 3BXg3225.t1, 3BXg390.t1, 3BXg3977.t1, 3BXg6039.t1, 3BXg6827.t1, 3BXg8171.t1, 3BXg8955.t1 | 0.011241 |
| KEGG PATHWAY | ko00630 | Glyoxylate and dicarboxylate metabolism | none | 2272; 4638; 4658 | 1AXg6636.t1, 3AXg457.t1, 3AXg9876.t1 | 4103; 2315; 4110; 4490 | 1BXg10186.t1, 1BXg2840.t1, 1BXg7797.t1, 3BXg7921.t1 | 0.011241 |
| KEGG PATHWAY | ko00740 | Riboflavin metabolism | none | 2275; 485; 496; 663; 2283; 2280; 4609; 4528; 4660 | 1AXg11951.t1, 1AXg1240.t1, 1AXg13882.t1, 1AXg4563.t1, 1AXg5998.t1, 1AXg8556.t1, 3AXg2591.t1, 3AXg2961.t1, 3AXg6319.t1 | 4100; 4123; 4117; 2464; 4096; 4114; 2477; 4113; 4415; 4503; 4501; | 1BXg11698.t1, 1BXg11921.t1, 1BXg3956.t1, 1BXg4094.t1, 1BXg5424.t1, 1BXg5433.t1, 1BXg5689.t1, 1BXg5696.t1, 3BXg1833.t1, 3BXg246.t1, 3BXg3225.t1, | 0.011241 |

TABLE 706-continued

| KEGG Pathway enrichment of beneficial fungi versus neutral fungi | | | | | | | | |
|---|---|---|---|---|---|---|---|---|
| Category | KEGG ID | Name | Description | SEQ ID Beneficial | A.Protein.ID | SEQ ID Neutral | B.Protein.ID | FDR q-value |
| | | | | | | 4369; 4498; 4469; 4495; 4489; 4394; 4488 | 3BXg390.t1, 3BXg3977.t1, 3BXg443.t1, 3BXg6039.t1, 3BXg8118.t1, 3BXg8171.t1, 3BXg8955.t1 | |
| KEGG PATHWAY | ko00520 | Amino sugar and nucleotide sugar metabolism | none | 2276; 2296; 608; 2294; 2287; 2284; 2281; 2279; 4559; 4667; 4664; 4662; 4602 | 1AXg10429.t1, 1AXg11997.t1, 1AXg1785.t1, 1AXg2013.t1, 1AXg5017.t1, 1AXg5996.t1, 1AXg8113.t1, 1AXg8814.t1, 3AXg10485.t1, 3AXg2394.t1, 3AXg407.t1, 3AXg618.t1, 3AXg9481.t1 | 4101; 2407; 4122; 2483; 4120; 2382; 2322; 4115; 2350; 4105; 4408; 4505; 4502; 4410; 4362; 4486 | 1BXg11696.t1, 1BXg1175.t1, 1BXg1561.t1, 1BXg2454.t1, 1BXg2483.t1, 1BXg3531.t1, 1BXg3931.t1, 1BXg4950.t1, 1BXg5592.t1, 1BXg9514.t1, 3BXg11985.t1, 3BXg2317.t1, 3BXg251.t1, 3BXg6843.t1, 3BXg821.t1, 3BXg9283.t1 | 0.041684 |
| KEGG PATHWAY | ko00350 | Tyrosine metabolism | none | 2275; 1342; 4609; 4528; 4660 | 1AXg11951.t1, 1AXg7766.t1, 3AXg2591.t1, 3AXg2961.t1, 3AXg6319.t1 | 4098; 4119; 4096; 4113; 4108; 3185; 4415; 4501; 4369; 4498; 4495; 4493; 4394; 4488 | 1BXg12278.t1, 1BXg2903.t1, 1BXg5424.t1, 1BXg5696.t1, 1BXg8510.t1, 1BXg886.t1, 3BXg1833.t1, 3BXg3225.t1, 3BXg390.t1, 3BXg3977.t1, 3BXg6039.t1, 3BXg6827.t1, 3BXg8171.t1, 3BXg8955.t1 | 0.045141 |
| KEGG PATHWAY | ko00240 | Pyrimidine metabolism | none | 2274; 1124; 662; 4648 | 1AXg2750.t1, 1AXg5630.t1, 1AXg7452.t1, 3AXg4651.t1 | 2968; 2326; 2352; 2463; 4504 | 1BXg1133.t1, 1BXg4339.t1, 1BXg5639.t1, 1BXg6885.t1, 3BXg2357.t1 | 0.064093 |

Gene Ontology Enrichment of Beneficial Fungi Versus Neutral Fungi

TABLE 707

| GO enrichment of beneficial fungi versus neutral fungi | | | | | | |
|---|---|---|---|---|---|---|
| GO Term | Description | SEQ ID Beneficial | A.Protein.ID | SEQ ID Neutral | B.Protein.ID | FDR q-value |
| GO: 0005576 | extracellular region | 478; 4917; 4918; 874; 633; 2291; 2287; 2285; 2284; 4947; 2281; 667; 497; 4948; 4877; 4919; 4878; 4559; 4879; 4920; 4515; 4880; 4921; 4666; 4650; 4922; 4923; 4881; 4525; 4510; 4661; 4882; 4924; 4925; 4571; 4883; | 1AXg10805.t1, 1AXg1317.t1, 1AXg21242.t1, 1AXg2815.t1, 1AXg3175.t1, 1AXg325.t1, 1AXg5017.t1, 1AXg5538.t1, 1AXg5996.t1, 1AXg8019.t1, 1AXg8113.t1, 1AXg9193.t1, 1AXg9750.t1, 1AXg9874.t1, 3AXg10204.t1, 3AXg10215.t1, 3AXg10410.t1, 3AXg10485.t1, | 4926; 2435; 4101; 4099; 4859; 4927; 4858; 2345; 4928; 4929; 4115; 2377; 4895; 4930; 4896; 4109; 2468; 2721; | 1BXg1054.t1, 1BXg11562.t1, 1BXg11696.t1, 1BXg12260.t1, 1BXg1692.t1, 1BXg177.t1, 1BXg2047.t1, 1BXg2053.t1, 1BXg4311.t1, 1BXg4617.t1, 1BXg4950.t1, 1BXg4998.t1, 1BXg6497.t1, 1BXg6576.t1, 1BXg7924.t1, 1BXg8240.t1, 1BXg8760.t1, 1BXg9114.t1, | 1.82E−14 |

TABLE 707-continued

GO enrichment of beneficial fungi versus neutral fungi

| GO Term | Description | SEQ ID Beneficial | A.Protein.ID | SEQ ID Neutral | B.Protein.ID | FDR q-value |
|---|---|---|---|---|---|---|
| | | 4658; 4642 | 3AXg10796.t1, 3AXg10814.t1, 3AXg10862.t1, 3AXg2666.t1, 3AXg2755.t1, 3AXg2790.t1, 3AXg2954.t1, 3AXg5176.t1, 3AXg5370.t1, 3AXg5893.t1, 3AXg5987.t1, 3AXg6236.t1, 3AXg6314.t1, 3AXg7257.t1, 3AXg7674.t1, 3AXg8315.t1, 3AXg9121.t1, 3AXg9736.t1, 3AXg9876.t1, 3AXg9889.t1 | 4932; 4897; 4356; 4898; 4933; 4468; 4934; 4351; 4935; 4899; 4900; 4386; 4936; 4901; 4428; 4902; 4490; 4362; 4937; 4442; 4938 | 3BXg10428.t1, 3BXg10792.t1, 3BXg11001.t1, 3BXg11147.t1, 3BXg11837.t1, 3BXg12052.t1, 3BXg14356.t1, 3BXg2216.t1, 3BXg2769.t1, 3BXg3018.t1, 3BXg3920.t1, 3BXg5319.t1, 3BXg5448.t1, 3BXg6241.t1, 3BXg7066.t1, 3BXg7579.t1, 3BXg7921.t1, 3BXg821.t1, 3BXg9358.t1, 3BXg9632.t1, 3BXg9781.t1 | |
| GO: 0008812 | choline dehydrogenase activity | 4608; 4582 4555; 4594 4562; 4829 4560 | 3AXg1008.t1, 3AXg10624.t1, 3AXg3404.t1, 3AXg3931.t1, 3AXg6329.t1, 3AXg8145.t1, 3AXg8514.t1 | 4387; 4365; 4358; 4811; 4363 | 3BXg1050.t1, 3BXg3212.t1, 3BXg4400.t1, 3BXg5049.t1, 3BXg7997.t1 | 3.00E−06 |
| GO: 0005618 | cell wall | 4939; 614; 934; 4571; 4940 | 1AXg12959.t1, 1AXg2047.t1, 1AXg6047.t1, 3AXg9121.t1, 3AXg9980.t1 | 2413; 4475; 4341 | 1BXg2549.t1, 3BXg11145.t1, 3BXg3303.t1 | 1.22E−05 |
| GO: 0016614 | oxidoreductase activity, acting on CH—OH group of donors | 4803; 4876; 4865; 4864; 4863; 4840; 4527; 4518; 4570; 4884; 4885; 4886; 4572; 4887; 4888; 4538 | 1AXg11202.t1, 1AXg1148.t1, 1AXg7074.t1, 1AXg7314.t1, 1AXg8008.t1, 3AXg10359.t1, 3AXg1658.t1, 3AXg2998.t1, 3AXg3962.t1, 3AXg5234.t1, 3AXg5286.t1, 3AXg6307.t1, 3AXg6312.t1, 3AXg7030.t1, 3AXg7536.t1, 3AXg8418.t1 | 2433; 4857; 4844; 4843; 4824; 4466; 4823; 4479; 4906; 4907; 4908; 4909; 4910; 4417; 4399; 4911 | 1BXg11481.t1, 1BXg3389.t1, 1BXg8979.t1, 1BXg9251.t1, 3BXg10091.t1, 3BXg1035.t1, 3BXg10533.t1, 3BXg13120.t1, 3BXg3860.t1, 3BXg5594.t1, 3BXg7349.t1, 3BXg7537.t1, 3BXg8146.t1, 3BXg8641.t1, 3BXg8643.t1, 3BXg9353.t1 | 2.62E−05 |
| GO: 0000272 | polysaccharide catabolic process | 2293; 2284; 2273; 667; 1249; 4540; 4668; 4941; 4923 | 1AXg2246.t1, 1AXg5996.t1, 1AXg6048.t1, 1AXg9193.t1, 1AXg9842.t1, 3AXg10237.t1, 3AXg192.t1, 3AXg2760.t1, 3AXg5370.t1 | 4125; 2435; 4101; 2349; 4928; 2468; 3093; 4509; 4356; 4343; 4500; 4942; 4423; 4460 | 1BXg10656.t1, 1BXg11562.t1, 1BXg11696.t1, 1BXg2692.t1, 1BXg4311.t1, 1BXg8760.t1, 1BXg9770.t1, 3BXg10794.t1, 3BXg11001.t1, 3BXg1101.t1, 3BXg3387.t1, 3BXg6628.t1, 3BXg6890.t1, 3BXg9765.t1 | 3.30E−05 |
| GO: 0045490 | pectin catabolic process | 4948; 4666; 4943; 4571 | 1AXg9874.t1, 3AXg2790.t1, 3AXg5277.t1, 3AXg9121.t1 | 4099; 4937; 4449 | 1BXg12260.t1, 3BXg9358.t1, 3BXg9608.t1 | 3.30E−05 |
| GO: 0004252 | serine-type endopeptidase activity | 4804; 652; 4947; 666; 4670; 4921; 4577; 4834; 4922; 4525; 4526 | 1AXg11086.t1, 1AXg7771.t1, 1AXg8019.t1, 1AXg9261.t1, 3AXg10865.t1, 3AXg2755.t1, 3AXg2995.t1, 3AXg3480.t1, | 2467; 4850; 2452; 4814; 4497; 4386; 4936; 4355; | 1BXg10439.t1, 1BXg782.t1, 1BXg7838.t1, 3BXg1720.t1, 3BXg4508.t1, 3BXg5319.t1, 3BXg5448.t1, 3BXg6263.t1, | 3.92E−05 |

TABLE 707-continued

GO enrichment of beneficial fungi versus neutral fungi

| GO Term | Description | SEQ ID Beneficial | A.Protein.ID | SEQ ID Neutral | B.Protein.ID | FDR q-value |
|---|---|---|---|---|---|---|
| | | | 3AXg5176.t1, 3AXg5987.t1, 3AXg8810.t1 | 4944; 4381; 4485; 4945 | 3BXg6633.t1, 3BXg8638.t1, 3BXg9634.t1, 3BXg9880.t1 | |
| GO: 0006979 | response to oxidative stress | 2272; 4626; 4635 | 1AXg6636.t1, 3AXg10815.t1, 3AXg2285.t1 | 4103; 4860; 4946 | 1BXg10186.t1, 1BXg11947.t1, 3BXg8947.t1 | 1.11E−04 |
| GO: 0030248 | cellulose binding | 478; 4917; 4918; 633; 2291; 2287; 2285; 2281; 497; 4920; 4924; 4925 | 1AXg10805.t1, 1AXg1317.t1, 1AXg21242.t1, 1AXg3175.t1, 1AXg325.t1, 1AXg5017.t1, 1AXg5538.t1, 1AXg8113.t1, 1AXg9750.t1, 3AXg10814.t1, 3AXg7674.t1, 3AXg8315.t1 | 4926; 4927; 2345; 4929; 4115; 4930; 4933; 4934; 4935; 4428; 4938; | 1BXg1054.t1, 1BXg177.t1, 1BXg2053.t1, 1BXg4617.t1, 1BXg4950.t1, 1BXg6576.t1, 3BXg11837.t1, 3BXg14356.t1, 3BXg2769.t1, 3BXg7066.t1, 3BXg9781.t1 | 1.51E−04 |
| GO: 0016788 | hydrolase activity, acting on ester bonds | 4805; 4873; 496; 645; 4836; 4539; 4569 | 1AXg10964.t1, 1AXg1296.t1, 1AXg13882.t1, 1AXg13885.t1, 3AXg1785.t1, 3AXg6767.t1, 3AXg8951.t1 | 2489; 4862; 2445; 2477; 4852; 4847; 4818; 4467; 4469; 4905 | 1BXg11282.t1, 1BXg11329.t1, 1BXg12241.t1, 1BXg5689.t1, 1BXg6844.t1, 1BXg8700.t1, 3BXg12041.t1, 3BXg3959.t1, 3BXg443.t1, 3BXg5704.t1 | 3.35E−04 |
| GO: 0004190 | aspartic-type endopeptidase activity | 482; 494; 673; 2252; 4919; 4529; 4833; 4581; 4894 | 1AXg10578.t1, 1AXg6959.t1, 1AXg6960.t1, 1AXg9542.t1, 3AXg10215.t1, 3AXg1976.t1, 3AXg3738.t1, 3AXg573.t1, 3AXg9318.t1 | 2439; 4853; 4076; 2323; 2474; 4842; 4932; 4347; 4472; 4385; 4483; 4904 | 1BXg12089.t1, 1BXg5763.t1, 1BXg6565.t1, 1BXg7026.t1, 1BXg9737.t1, 1BXg9738.t1, 3BXg10428.t1, 3BXg11695.t1, 3BXg4394.t1, 3BXg5286.t1, 3BXg8935.t1, 3BXg9882.t1 | 3.46E−04 |
| GO: 0004650 | polygalacturonase activity | 4515; 4666; 4943 | 3AXg10862.t1, 3AXg2790.t1, 3AXg5277.t1 | 2377; 4937; 4442 | 1BXg4998.t1, 3BXg9358.t1, 3BXg9632.t1 | 3.46E−04 |
| GO: 0004185 | serine-type carboxypeptidase activity | 587; 2282; 4838; 4837; 4827; 4826; 4624 | 1AXg11050.t1, 1AXg7972.t1, 3AXg10866.t1, 3AXg1190.t1, 3AXg891.t1, 3AXg9023.t1, 3AXg9670.t1 | 4102; 2386; 4825; 4812; 4353; 4432; 4810; 4807 | 1BXg10249.t1, 1BXg2887.t1, 3BXg10049.t1, 3BXg3887.t1, 3BXg4014.t1, 3BXg5175.t1, 3BXg5715.t1, 3BXg9635.t1 | 0.000484 |
| GO: 0016798 | hydrolase activity, acting on glycosyl bonds | 530; 2296; 4875; 477; 4872; 2292; 480; 2290; 2289; 487; 4891; 4667; 4892; 4893 | 1AXg10268.t1, 1AXg11997.t1, 1AXg12212.t1, 1AXg13463.t1, 1AXg15301.t1, 1AXg2742.t1, 1AXg3149.t1, 1AXg3652.t1, 1AXg3653.t1, 1AXg5358.t1, 1AXg7786.t1, 3AXg2394.t1, 3AXg7003.t1, 3AXg8007.t1 | 4800; 3811; 2483; 4949; 2352; 4849; 2300; 4813; 4480 | 1BXg10455.t1, 1BXg10918.t1, 1BXg2454.t1, 1BXg4330.t1, 1BXg5639.t1, 1BXg817.t1, 1BXg8757.t1, 3BXg2207.t1, 3BXg8858.t1 | 0.000484 |
| GO: 0005507 | copper ion binding | 4802; 1342; 4632; 4597; 4595; 4831 | 1AXg12235.t1, 1AXg7766.t1, 3AXg1263.t1, 3AXg3686.t1, 3AXg3946.t1, 3AXg5094.t1 | 2539; 4098; 4856; 3185; 4427; 4817; 4403 | 1BXg10115.t1, 1BXg12278.t1, 1BXg3746.t1, 1BXg886.t1, 3BXg10410.t1, 3BXg12053.t1, 3BXg689.t1 | 0.000489 |

TABLE 707-continued

GO enrichment of beneficial fungi versus neutral fungi

| GO Term | Description | SEQ ID Beneficial | A.Protein.ID | SEQ ID Neutral | B.Protein.ID | FDR q-value |
|---|---|---|---|---|---|---|
| GO: 0008810 | cellulase activity | 4918; 1249; 4540; 4839; 4941; 4532 | 1AXg21242.t1, 1AXg9842.t1, 3AXg10237.t1, 3AXg10372.t1, 3AXg2760.t1, 3AXg6046.t1 | 4927; 4929; 4930; 4109; 3093; 4509; 4343; 4934; 4942; 4903 | 1BXg177.t1, 1BXg4617.t1, 1BXg6576.t1, 1BXg8240.t1, 1BXg9770.t1, 3BXg10794.t1, 3BXg1101.t1, 3BXg14356.t1, 3BXg6628.t1, 3BXg9093.t1 | 0.000644 |
| GO: 0071555 | cell wall organization | 4939; 614; 934; 4515; 4666; 4659; 4940 | 1AXg12959.t1, 1AXg2047.t1, 1AXg6047.t1, 3AXg10862.t1, 3AXg2790.t1, 3AXg7872.t1, 3AXg9980.t1 | 4099; 2413; 2482; 2377; 4475; 4487; 4937; 4442 | 1BXg12260.t1, 1BXg2549.t1, 1BXg264.t1, 1BXg4998.t1, 3BXg11145.t1, 3BXg928.t1, 3BXg9358.t1, 3BXg9632.t1 | 0.001751 |
| GO: 0008081 | phosphoric diester hydrolase activity | 4520; 4950; 4951 | 3AXg3348.t1, 3AXg429.t1, 3AXg8372.t1 | 2343; 4952; 4953; 4954; 4388 | 1BXg6110.t1, 3BXg10729.t1, 3BXg10989.t1, 3BXg1818.t1, 3BXg5195.t1 | 0.003097 |
| GO: 0004601 | peroxidase activity | 4626; 4635 | 3AXg10815.t1, 3AXg2285.t1 | 2539; 4808; 4946 | 1BXg10115.t1, 3BXg8361.t1, 3BXg8947.t1 | 0.003136 |
| GO: 0044238 | primary metabolic process | 501; 4835; 4630; 4830; 4828 | 1AXg11043.t1, 3AXg3154.t1, 3AXg6318.t1, 3AXg8054.t1, 3AXg8258.t1 | 4798 | 3BXg2943.t1 | 0.008701 |
| GO: 0006629 | lipid metabolic process | 4520; 4950; 4832; 4951 | 3AXg3348.t1, 3AXg429.t1, 3AXg4906.t1, 3AXg8372.t1 | 2339; 2343; 4822; 4952; 4953; 4954; 4388 | 1BXg11161.t1, 1BXg6110.t1, 3BXg10687.t1, 3BXg10729.t1, 3BXg10989.t1, 3BXg1818.t1, 3BXg5195.t1 | 0.022235 |
| GO: 0030246 | carbohydrate binding | 4801; 487; 4615 | 1AXg4233.t1, 1AXg5358.t1, 3AXg4536.t1 | 4097; 4949; 4854; 2332; 4815; 4422; 4489; 4484 | 1BXg135.t1, 1BXg4330.t1, 1BXg5733.t1, 1BXg9970.t1, 3BXg144.t1, 3BXg3121.t1, 3BXg8118.t1, 3BXg9960.t1 | 0.022419 |
| GO: 0008233 | peptidase activity | 567; 489; 1013; 2286 | 1AXg1909.t1, 1AXg3273.t1, 1AXg3484.t1, 1AXg5534.t1 | 4124; 4861; 2858; 4846; 4809 | 1BXg11338.t1, 1BXg11861.t1, 1BXg2151.t1, 1BXg8705.t1, 3BXg7109.t1 | 0.026107 |
| GO: 0016311 | dephosphorylation | 485; 602; 4870; 4869; 4868; 4867; 4866; 4841; 4889; 4623; 4618; 4646; 4890 | 1AXg1240.t1, 1AXg12610.t1, 1AXg2072.t1, 1AXg2679.t1, 1AXg3651.t1, 1AXg5280.t1, 1AXg7026.t1, 3AXg10295.t1, 3AXg2325.t1, 3AXg2688.t1, 3AXg6634.t1, 3AXg8755.t1, 3AXg9415.t1 | 2329; 2401; 4855; 4114; 2478; 4821; 4439; 4816; 4912; 4503; 4913; 4914; 4915; 4425 | 1BXg1583.t1, 1BXg3489.t1, 1BXg4136.t1, 1BXg5433.t1, 1BXg6623.t1, 3BXg10709.t1, 3BXg11186.t1, 3BXg12884.t1, 3BXg23.t1, 3BXg246.t1, 3BXg383.t1, 3BXg4227.t1, 3BXg5208.t1, 3BXg5671.t1 | 0.028109 |
| GO: 0005886 | plasma membrane | 484; 4874; 4871; 649; 665; 658; 651; 4641; 4521; 4955; 4956; 4514; 4957 | 1AXg11973.t1, 1AXg12543.t1, 1AXg20005.t1, 1AXg2148.t1, 1AXg4299.t1, 1AXg4879.t1, 1AXg9624.t1, 3AXg10151.t1, 3AXg1507.t1, 3AXg1833.t1, | 2336; 2431; 2451; 4851; 4848; 4845; 4820; 4819; 4916; 4473 | 1BXg1674.t1, 1BXg3283.t1, 1BXg7238.t1, 1BXg7733.t1, 1BXg8189.t1, 1BXg8837.t1, 3BXg11471.t1, 3BXg11779.t1, 3BXg11859.t1, 3BXg8700.t1 | 0.120452 |

TABLE 707-continued

| GO enrichment of beneficial fungi versus neutral fungi | | | | | | |
|---|---|---|---|---|---|---|
| GO Term | Description | SEQ ID Beneficial | A.Protein.ID | SEQ ID Neutral | B.Protein.ID | FDR q-value |
| GO: 0008168 | methyltransferase activity | 4799; 4663; 4662 | 3AXg3620.t1, 3AXg7460.t1, 3AXg7667.t1 3AXg3246.t1, 3AXg512.t1, 3AXg618.t1 | 4797; 4492 | 3BXg5144.t1, 3BXg7176.t1 | 0.14079 |

These data suggest that numerous biological processes are different in beneficial endophytes, for example as compared to neutral endophytes. Some of these processes include cell wall degradation, starch and sucrose metabolism, and protection from oxidative stress.

One mechanism of entry of endophytes into intact plant tissue is by enzymatic processes involving degradation of cell walls. Beneficial endophytes used in this example show increased levels of secreted proteins that may be involved in such degradation, for example those that fall within the following gene ontology annotations: GO:0005618 (cell wall), GO:0000272 (polysaccharide catabolic process), GO:0045490 (pectin catabolic process), GO:0030248 (cellulose binding), GO:0004650 (polygalacturonase activity), GO:0008810 (cellulase activity), GO:0071555 (cell wall organization), GO:0004185 (serine-type carboxypeptidase activity), GO:0016798 (hydrolase activity, acting on glycosyl bonds), and GO:0030246 (carbohydrate binding). Certain of the proteins that fall within these gene ontology annotations may also be involved in starch and sucrose metabolism.

Beneficial endophytes of the invention secreted proteins that may provide a benefit to the plant, such as proteins involved in protection against oxidative stress (GO:0016614 (oxidoreductase activity, acting on CH—OH group of donors); GO:0006979 (response to oxidative stress); GO:0005507 (copper ion binding), and GO:0004601 (peroxidase activity)).

Example 8: Greenhouse Characterization

Setup and Watering Conditions

A sandy loam growth substrate is mixed in the greenhouse and consisting of 60% loam and 40% mortar sand (Northeast Nursery, Peabody, Mass.). Prior to mixing, loam is sifted through a ⅜" square steel mesh screen to remove larger particles and debris. Half of the appropriate fertilizers and soil treatments to be applied during the season is added to the soil mixture prior to sowing. The remaining components are provided dissolved in irrigation water at the onset of the reproductive stages of development. Substrate surface area per pot is calculated based on pot diameter in order to approximate the "acreage" of individual pots. An equivalent volume of fertilized soil is then gently added to each pot in order to minimize compaction of the soil. The substrate is saturated with water 3-4 hours before sowing.

Commercially available seeds (e.g., seeds described herein) are coated with microbial treatments using the formulation used for field trials and described herein. Treatments included microbial coatings and two controls (non-treated and formulation). Three seeds are sown evenly spaced at the points of a triangle. Soil is then overlaid atop the seeds and an additional 200 mL water was added to moisten the overlaying substrate.

Midseason Measurements and Harvest

Emergence percentage is observed. Further, at various times through the growing season, plants are assessed for onset of and recovery from stress symptoms, for example but not limited to: leaf senescence, anthesis-silking interval, leaf chlorophyll content, grain weight, and total yield.

To compare treated plants to controls, a fully Bayesian robust t-test is performed. Briefly, R (R Core Team, 2015) was used with the BEST package (Kruschke and Meredith, 2015) and JAGS (Plummer, 2003) to perform a Markov Chain Monte Carlo estimation of the posterior distribution the likely differences between the two experimental groups. A 95% highest density interval (HDI) is overlayed onto this distribution to aid in the interpretation of whether the two biological groups truly differ.

Tissue Collection and Processing for Transcriptomics, Hormone, and Metabolomics Analysis In order to assess the effects of endophyte treatment on plant growth at the transcriptomic, phytohormone, and metabolomic levels, plants are harvested. Three pots from each treatment are selected. Once separated, the tissues (roots, stems, leaves, other plant elements as appropriate) from the three pots of each treatment are pooled. For collection, first all loosely attached substrate is removed from the roots by gently tapping and shaking the roots. Any adherent substrate is removed by submerging the roots in water and manually dislodging attached soil and debris. The roots are then blotted dry before being cut from the aerial tissue, followed by separating petioles and leaves from the stem. As tissues are removed from the plant they are immediately bagged and frozen in liquid nitrogen. All harvested tissues are kept in liquid nitrogen or stored at −80° C. until further processing.

To prepare for analyses, the tissues are ground with liquid nitrogen using a pre-chilled mortar and pestle. Approximately 100-200 micrograms of each ground sample pool is transferred to a chilled 1.5 mL microtube for RNA extraction and subsequent transcriptome, phytohormone and metabolite analysis. For proteomic analysis, 3 g of each ground sample pool is used. The remaining ground tissue is then transferred to a chilled 50 mL conical tube and stored in liquid nitrogen or at −80° C. until shipment for further analyses.

Example 9: Assessment of Plant Colonization

The protocols described in this section allow confirmation of successful colonization of plants by endophytes, for example by direct recovery of viable colonies from various tissues of the inoculated plant.

Recovery of Viable Colonies from Seeds

Seeds are surface-sterilized by exposing them to chlorine gas overnight, using the methods described elsewhere. Sterile seeds are then inoculated with submerged in 0.5 OD overnight cultures (Tryptic Soy Broth, TSB) of bacteria and allowed to briefly air dry. The seeds are then placed in tubes filled partially with a sterile sand-vermiculite mixture [(1:1 wt:wt)] and covered with 1 inch of the mixture, watered with sterile water, sealed and incubated in a greenhouse for 7 days. After incubation, various tissues of the plants are harvested and used as donors to isolate bacteria by placing tissue section in a homogenizer (TSB 20%) and mechanical mixing. The slurry is then serially diluted in 10-fold steps to 10-3 and dilutions 1 through 10-3 are plated on TSA 20% plates (1.3% agar). Plates are incubated overnight and pictures are taken of the resulting plates as well as colony counts for CFU. Bacteria are identified visually by colony morphotype and molecular methods described herein. Representative colony morphotypes are also used in colony PCR and sequencing for isolate identification via ribosomal gene sequence analysis as described herein. These trials are repeated twice per experiment, with 5 biological samples per treatment.

Culture-Independent Methods to Confirm Colonization of the Plant or Seeds by Bacteria or Fungi.

One way to detect the presence of endophytes on or within plants or seeds is to use quantitative PCR (qPCR). Internal colonization by the endophyte can be demonstrated by using surface-sterilized plant tissue (including seed) to extract total DNA, and isolate-specific fluorescent MGB probes and amplification primers are used in a qPCR reaction. An increase in the product targeted by the reporter probe at each PCR cycle therefore causes a proportional increase in fluorescence due to the breakdown of the probe and release of the reporter. Fluorescence is measured by a quantitative PCR instrument and compared to a standard curve to estimate the number of fungal or bacterial cells within the plant.

Experimental Description

The design of both species-specific amplification primers, and isolate-specific fluorescent probes are well known in the art. Plant tissues (seeds, stems, leaves, flowers, etc.) are pre-rinsed and surface sterilized using the methods described herein.

Total DNA is extracted using methods known in the art, for example using commercially available Plant-DNA extraction kits, or the following method.

1. Tissue is placed in a cold-resistant container and 10-50 mL of liquid nitrogen is applied. Tissues are then macerated to a powder.

2. Genomic DNA is extracted from each tissue preparation, following a chloroform:isoamyl alcohol 24:1 protocol (Sambrook et al., 1989).

Quantitative PCR is performed essentially as described by Gao et al. (2010) with primers and probe(s) specific to the desired isolate using a quantitative PCR instrument, and a standard curve is constructed by using serial dilutions of cloned PCR products corresponding to the specie-specific PCR amplicon produced by the amplification primers. Data are analyzed using instructions from the quantitative PCR instrument's manufacturer software.

As an alternative to qPCR, Terminal Restriction Fragment Length Polymorphism, (TRFLP) can be performed, essentially as described in Johnston-Monje and Raizada (2011). Group specific, fluorescently labelled primers are used to amplify a subset of the microbial population, especially bacteria, especially fungi, especially archaea, especially viruses. This fluorescently labelled PCR product is cut by a restriction enzyme chosen for heterogeneous distribution in the PCR product population. The enzyme cut mixture of fluorescently labelled and unlabeled DNA fragments is then submitted for sequence analysis on a Sanger sequence platform such as the Applied Biosystems 3730 DNA Analyzer.

Immunological Methods to Detect Microbes in Seeds and Vegetative Tissues

A polyclonal antibody is raised against specific bacteria X or fungus Y strains via standard methods. A polyclonal antibody is also raised against specific GUS and GFP proteins via standard methods. Enzyme-linked immunosorbent assay (ELISA) and immunogold labeling is also conducted via standard methods, briefly outlined below.

Immunofluorescence microscopy procedures involve the use of semi-thin sections of plant element or adult plant tissues transferred to glass objective slides and incubated with blocking buffer (20 mM Tris (hydroxymethyl)-aminomethane hydrochloride (TBS) plus 2% bovine serum albumin, pH 7.4) for 30 min at room temperature. Sections are first coated for 30 min with a solution of primary antibodies and then with a solution of secondary antibodies (goat anti-rabbit antibodies) coupled with fluorescein isothiocyanate (FITC) for 30 min at room temperature. Samples are then kept in the dark to eliminate breakdown of the light-sensitive FITC. After two 5-min washings with sterile potassium phosphate buffer (PB) (pH 7.0) and one with double-distilled water, sections are sealed with mounting buffer (100 mL 0.1 M sodium phosphate buffer (pH 7.6) plus 50 mL double-distilled glycerine) and observed under a light microscope equipped with ultraviolet light and a FITC Texas-red filter.

Ultrathin (50- to 70-nm) sections for TEM microscopy are collected on pioloform-coated nickel grids and are labeled with 15-nm gold-labeled goat anti-rabbit antibody. After being washed, the slides are incubated for 1 h in a 1:50 dilution of 5-nm gold-labeled goat anti-rabbit antibody in IGL buffer. The gold labeling is then visualized for light microscopy using a BioCell silver enhancement kit. Toluidine blue (0.01%) is used to lightly counterstain the gold-labeled sections. In parallel with the sections used for immunogold silver enhancement, serial sections are collected on uncoated slides and stained with 1% toluidine blue. The sections for light microscopy are viewed under an optical microscope, and the ultrathin sections are viewed by TEM.

Example 10: Assessment of Improved Plant Characteristics: Differentially Regulated Hormones Methods For hormone analysis, 100±10 mg tissue is measured into microtubes (chilled with liquid nitrogen), and sent on dry ice to a vendor. Plant hormone analysis is performed per Christiansen et al. (2014) with slight modification. Briefly, hormones are extracted from 100±10 mg of frozen tissue and tissue weights are recorded for quantification. A mixture containing 10 microliters of 2.5 microMolar internal standards and 500 microliters of extraction buffer [1-propanol/H2O/concentrated HCl (2:1:0.002, vol/vol/vol) is added to each sample and vortexed until thawed. Samples are agitated for 30 min at 4° C., then 500 microliters of dichloromethane (CH2Cl2) is added. Samples are agitated again for 30 min at 4° C., and then centrifuged at 13,000×g for 5 min. in darkness. The lower organic layer is removed into a glass vial and the solvent is evaporated by drying samples for 30-40 min under a N2 stream. Samples are re-solubilized in 150 microliters of MeOH, shaken for 1 min and centrifuged at 14,000×g for 2 min. A supernatant of 90 microliters is transferred into the autosampler vial and hormones are analyzed by ultraperformance liquid chromatography, coupled to mass spectrometry (UPLC-MS/MS). Ascentis Express C-18 Column (3 cm×2.1 mm, 2.7 cm) is connected to an API 3200 using electrospray ionization-tandem mass spectrometry (MS/MS) with scheduled multiple reaction monitoring (SMRM). The injection volume is 5 microliters and has a 300 microliters/min mobile phase consisting of Solution A (0.05% acetic acid in water) and Solution B (0.05% acetic acid in acetonitrile) with a gradient consisting of (time-% B): 0.3-1%, 2-45%, 5-100%, 8-100%, 9-1%, 11-stop. Quantitation is carried out with Analyst software (AB Sciex), using the internal standards as a reference for extraction recovery. Leaf, root, and/or other tissue is saved in −62° C. and saved for subsequent gene expression analysis.

Mass spectra of plant hormones are obtained. Fold changes between control and treated samples are calculated by dividing the mass spectrum value from the treated sample by the value from the control sample.

Modulation of hormones related to growth as well as related to resistance to abiotic and biotic stresses are found in plants treated with endophytes as compared to isoline plants lacking such treatment.

Example 11: Assessment of Improved Plant Characteristics and Differentially Regulated Metabolites Methods For metabolite analysis, 150±10 mg of each sample is transferred into 1.5 mL microtubes (chilled in liquid nitrogen) and sent on dry ice to the Proteomics and Metabolomics Facility at Colorado State University. Metabolomics data acquisition is performed per the following methods provided by Dr. Corey Broeckling at CSU. To prepare the samples for analysis, phytohormones are extracted from ground plant material using a biphasic protocol. One mL of a methyl tert-butyl ether (MTBE): methanol:water mixture (6:3:1) is added to each sample then shaken for 1 hour. Next, 250 microliters cold water and a mix of internal standards are added to each sample to promote phase separation. Samples are shaken again for 5 minutes. Samples are then centrifuged at 2,095×g at 4° C. for 15 minutes. The organic top phase is removed for hormone analysis, dried under an inert nitrogen environment, then re-suspended in 400 microliters of 50% acetonitrile. Extracts are then directly analyzed by LC-MS.

For GC-MS, the polar (lower phase) extract is dried using a speedvac, resuspended in 50 microliters of pyridine containing 50 mg/mL of methoxyamine hydrochloride, incubated at 60° C. for 45 min, sonicated for 10 min, and incubated for an additional 45 min at 60° C. Next, 25 microliters of N-methyl-N-trimethylsilyltrifluoroacetamide with 1% trimethylchlorosilane (MSTFA+1% TMCS, Thermo Scientific) is added and samples re incubated at 60° C. for 30 min, centrifuged at 3000×g for 5 min, cooled to room temperature, and 80 microliters of the supernatant is transferred to a 150 microliters glass insert in a GC-MS autosampler vial. Metabolites are detected using a Trace GC Ultra coupled to a Thermo ISQ mass spectrometer (Thermo Scientific). Samples are injected in a 1:10 split ratio twice in discrete randomized blocks. Separation occurs using a 30 m TG-5MS column (Thermo Scientific, 0.25 mm i.d., 0.25 micrometer film thickness) with a 1.2 mL/min helium gas flow rate, and the program consists of 80° C. for 30 sec, a ramp of 15° C. per min to 330° C., and an 8 min hold. Masses between 50-650 m/z re scanned at 5 scans/sec after electron impact ionization. The ionization source is cleaned and retuned and the injection liner replaced between injection replicates. Analysis for plant hormones is performed by UPLC-MS/MS as follows.

Metabolites are detected and mass spectra annotated by comparing to libraries of known spectra including an in-house database at CSU (LC-MS only), the National Institute of Standards and Technology databases, Massbank MS database, and the Golm Metabolite Database. Initial annotation is automated, followed by manual validation of annotations. Following annotation, compounds are identified. After removal of technical artifacts (e.g. siloxane), and ambiguous or vague annotations (e.g. carbohydrate or saccharide), identified compounds remain for analysis. These compounds are assessed for fold change over control plants. Metabolites are grouped by pathways (e.g. carbohydrate metabolism or alkaloid biosynthesis) and the KEGG database and literature are manually referenced to identify pertinent shifts in metabolic patterns in plants treated with microbes. Any compound without an appreciable shift compared to that observed in control plants is removed from further analysis.

Modulation of metabolites related to growth as well as related to resistance to abiotic and biotic stresses are found in plants treated with endophytes as compared to isoline plants lacking such treatment.

Example 12: Efficacy Testing of Endophytes in Crop Production

Method

Whole plants or plant elements, such as seeds, roots, or leaves, from any of the crops useful in the invention are treated with endophytes as described in Examples 3, 4, or 8. They are then sown in a variety in different growing regions for efficacy testing. Trials consist of ten replicate plots for each treatment and control respectively arranged in a spatially balanced randomized complete block design (Van Es et al. 2007). In addition to measuring total yield, metrics such as seedling emergence, normalized difference vegetation index (NDVI) and time to flowering are assessed. Endophytes are applied alone as a seed treatment, as well as in combination with other endophytes.

Results

Crop plants that have been treated with the endophyte(s) of the present invention demonstrate improvements in one or more agronomically-important characteristic, for example but not limited to: disease resistance, drought tolerance, heat tolerance, cold tolerance, salinity tolerance, metal tolerance, herbicide tolerance, chemical tolerance, improved water use efficiency, improved nitrogen utilization, improved nitrogen fixation, pest resistance, herbivore resistance, pathogen resistance, increased yield, increased yield under water-limited conditions, health enhancement, vigor improvement, growth improvement, photosynthetic capability improvement, nutrition enhancement, altered protein content, altered oil content, increased biomass, increased shoot length, increased root length, improved root architecture, improved plant standability, increased plant element weight, altered plant element carbohydrate composition, altered plant element oil composition, number of pods, delayed senescence, stay-green, and altered plant element protein composition.

Example 13: Generating/Isolating Endophytes Compatible with Agrochemicals

The application of pesticides against fungal pathogens of agriculturally-relevant plants is a common practice in agriculture to ensure higher yields. One method of pesticide delivery is to cover the seeds with a coating with pesticides. Although pesticides are meant to deter the growth and propagation of pathogenic microorganisms, they may also affect endophyte populations residing inside of the seed. For this purpose, conferring compatibility mechanisms to endophytic fungi providing beneficial properties which are sensitive to these compounds is desirable for the maintenance of endophytes in the seeds.

Compatibility with pesticides can be intrinsic (naturally pesticide compatible fungi, for example) or acquired (due to mutations in the genetic material of the microorganism, or to the introduction of exogenous DNA by natural DNA transfer).

Fungicides used as protectants are effective only on the seed surface, providing protection against seed surface-borne pathogens and providing some level of control of soil-borne pathogens. These products generally have a relatively short residual. Protectant fungicides such as captan, maneb, thiram, or fludioxonil help control many types of soil-borne pathogens, except root rotting organisms. Systemic fungicides are absorbed into the emerging seedling and inhibit or kill susceptible fungi inside host plant tissues. Systemic fungicides used for seed treatment include the following: azoxystrobin, carboxin, mefenoxam, metalaxyl, thiabendazole, trifloxystrobin, and various triazole fungicides, including difenoconazole, ipconazole, tebuconazole, and triticonazole. Mefenoxam and metalaxyl are primarily used to target the oomycetes such as species of *Pythium* and *Phytophthora.*

Strobilurin analogues, such as azoxystrobin, inhibit mitochondrial respiration by blocking electron transfer at the cytochrome bcl complex. Phenylamides, including metalaxyl, interfere with RNA synthesis in target fungi. Oxathiin systemic fungicides like carboxin inhibits the incorporation of phenylalanine into protein and of uracil into RNA. Azole fungicides BAS 480F, flusilazole, and tebuconazole are inhibitors of sterol 14α-demethylase, and block sterol biosynthesis.

I. Determination of Intrinsic Resilience Against Agrochemicals of Bacteria Cultured from Seeds To test the intrinsic resilience pesticides of bacteria isolated as described herein, minimum inhibitory concentration (MIC) assays are performed on all isolated bacteria of interest, as described in Wiegand, Irith, Kai Hilpert, and Robert E W Hancock. Nature protocols 3.2 (2008): 163-175, which is incorporated herein by reference in its entirety. Briefly, known concentrations of bacterial cells or spores are used to inoculate plates containing solid media with different concentrations of the pesticide, or to inoculate liquid media containing different concentrations of the pesticide (in a 96-well plate). The pesticides are used at the concentration recommended by the manufacturer for seed coating, and two-fold dilutions down to 0.000125 (12 two-fold dilutions). Growth is assessed after incubation for a defined period of time (16-20 h) and compared to cultures grown in the same manner without any pesticides as control. The MIC value is determined as described in Wiegand, Irith, Kai Hilpert, and Robert E W Hancock. Nature protocols 3.2 (2008): 163-175.

II. Determination of Intrinsic Resilience Against Agrochemicals of Fungi Cultured from Seeds To test the intrinsic resilience against pesticides of the fungi isolated as described in this application, minimum inhibitory concentration (MIC) assays are performed on all isolated fungi of interest, as described in Mohiddin, F. A., and M. R. Khan. African Journal of Agricultural Research 8.43 (2013): 5331-5334 (incorporated herein by reference in its entirety), with the following changes: Briefly, double strength potato dextrose agar is prepared containing different concentrations of each pesticide. The pesticides are applied at the concentration recommended by the manufacturer, and also in two fold dilutions to 0.000125× (12 two-fold dilutions). Thereafter, the plates are seeded centrally with a 3 mm disc of 4 days old culture of each fungus that had been centrifuged and rinsed twice in sterile phosphate buffer. PDA plates without a fungicide but inoculated with the fungi serve as a control. The inoculated plates are incubated at 25±2° C. for 5 days. The radial growth of the colony in each treatment is measured and the percent inhibition of growth is calculated as described by Mohiddin, F. A., and M. R. Khan. African Journal of Agricultural Research 8.43 (2013): 5331-5334 (incorporated herein by reference in its entirety). Fungal isolates are classified as resilience against the particular pesticide if their maximum tolerance concentration (MTC) is 2× or above the concentration of pesticides recommended to be used in seed coatings.

III. Generating Fungal Species with Compatibility with Commercial Pesticides Coated onto Seeds When a fungal strain of interest that provides a beneficial property to its plant host is found to be sensitive to a commercially-relevant pesticide, pesticide-compatible variants of the strains need to be generated for use in this application. Generation of compatibility to multiple pesticides or cocktails of pesticides is accomplished by sequentially selecting compatible variants to each individual pesticide and then confirming compatibility with a combination of the pesticides. After each round of selection, fungi are tested for their ability to form symbiotic relationships with the plants and to confirm that they provide a beneficial property on the plant as did the parental strain, with or without application of the pesticide product as described herein.

Generation and isolation of pesticide-compatible strains derived from endophytic strains isolated from seeds and shown to provide beneficiary traits to plants is performed as described by Shapiro-Ilan, David I., et al. Journal of invertebrate pathology 81.2 (2002): 86-93 (incorporated herein by reference in its entirety), with some changes. Briefly, spores of the isolated fungi are collected and solutions containing between ~$1\times10^3$ spores are used to inoculate potato dextrose agar (PDA) plates containing 2, 5, and 10 times the MTC of the particular strain. Plates are incubated for 1-5 days and a single colony from the highest concentration of pesticide which allows growth is inoculated onto a fresh plate with the same pesticide concentration 7 consecutive times. After compatibility has been established, the strain is inoculated onto PDA plates 3 consecutive times and then inoculated onto a PDA plate containing the pesticide to confirm that the compatibility trait is permanent.

Alternatively, if this method fails to provide a compatible strain, a spore suspension is treated with ethyl methanesulfonate to generate random mutants, similarly as described by Leonard, Cory A., Stacy D. Brown, and J. Russell Hayman. International journal of microbiology 2013 (2013), Article ID 901697 (incorporated herein by reference in its entirety) and spores from this culture are used in the experiment detailed above.

To develop fungal endophytes compatible with multiple pesticides or cocktails of pesticides, spores of a strain compatible with one or more pesticides are used to select for variants to a new pesticide as described above. Strains developed this way are tested for retention of the pesticide-compatibility traits by inoculating these strains onto PDA plates containing each single pesticide or combinations of pesticides.

IV. Generating Bacterial Species with Compatibility to Commercial Pesticides Coated onto Seeds When a bacterial strain of interest is found to be sensitive to a commercially-relevant pesticide, generation of pesticide-compatible variants of the strains can be generated for use in this application. Generation of compatible with multiple pesticides or cocktails of pesticides is accomplished by first sequentially selecting variants compatible with incrementally higher concentrations of each individual pesticide (as described by Thomas, Louise, et al. Journal of Hospital Infection 46.4 (2000): 297-303, which is incorporated herein by reference in its entirety). To develop bacterial endophytes compatible with multiple pesticides or cocktails of pesticides, bacterial cells of a strain compatible with one or more pesticides is used to select for variants to a new pesticide as described above. Strains developed this way are tested for retention of the pesticide-compatible traits by inoculating these strains onto PDA plates containing each single pesticide or combinations of pesticides.

After each round of selection, bacteria are tested for their ability to live within plants and for their ability to provide the same beneficial property to the plant as did the parental strain, with or without application of the pesticide product to the plants as described herein.

V. Generation of Pesticide-Compatible Bacteria by Insertion of a Resistance Plasmid Many bacterial plasmids that confer compatible pesticides have been described in the literature (Don, R. H., and J. M. Pemberton. Journal of Bacteriology 145.2 (1981): 681-686; and Fisher, P. R., J. Appleton, and J. M. Pemberton. *Journal of bacteriology* 135.3 (1978): 798-804, each of which is incorporated herein by reference in its entirety)

For cases in which obtaining naturally occurring compatible bacteria is not feasible, use of these plasmids is a possible way to develop endophytic strains compatible with multiple pesticides.

For example, a *Pseudomonas fluorescens* strain that provides anti-nematode properties to plants but is sensitive to the pesticides 2,4-dichlorophenoxyacetic acid and 4-chloro-2-methylphenoxyacetic can be transformed with the plasmid pJP2 (isolated from *Alcaligenes eutrophus*) which provides transmissible compatible with these compounds, as described by Don and Pemberton, 1981. Briefly, plasmids are transferred by conjugation to *Pseudomonas*, using the method described in Haas, Dieter, and Bruce W. Holloway. *Molecular and General Genetics* 144.3 (1976): 243-251 (incorporated herein by reference in its entirety).

After the generation of bacteria carrying pesticide-compatibility conferring plasmids, these endophytes are tested for their ability to live inside plant tissues and for their ability to provide the same beneficial property to the plant as it did for the parental strain, with or without application of the pesticide product to the plants as described herein.

VI. Growth and Scale-Up of Bacteria for Inoculation on Solid Media

The bacterial isolates are grown by loop-inoculation of a single colony into R2A broth (supplemented with appropriate antibiotics) in 100 mL flasks. The bacterial culture is incubated at 30±2° C. for 2 days at 180 rpm in a shaking incubator (or under varying temperatures and shaking speeds as appropriate). This liquid suspension is then used to inoculate heat sterilized vermiculite powder that is premixed with sterile R2A broth (without antibiotics), resulting in a soil like mixture of particles and liquid. This microbial powder is then incubated for an additional couple of days at 30±2° C. with daily handshaking to aerate the moist powder and allow bacterial growth. Microbially inoculated vermiculite powder is now ready for spreading on to soil or onto plant parts. Alternatively, the R2A broth is used to inoculate Petri dishes containing R2A or another appropriate nutrient agar where lawns of bacteria are grown under standard conditions and the solid colonies scraped off, resuspended in liquid and applied to plants as desired.

VII. Growth & Scale-Up of Fungi for Inoculation on Solid Media

Once a fungal isolate has been characterized, conditions are optimized for growth in the lab and scaled-up to provide sufficient material for assays. For example, the medium used to isolate the fungus is supplemented with nutrients, vitamins, co-factors, plant-extracts, and other supplements that can decrease the time required to grow the fungal isolate or increase the yield of mycelia and/or spores the fungal isolate produces. These supplements can be found in the literature or through screening of different known media additives that promote the growth of all fungi or of the particular fungal taxa.

To scale up the growth of fungal isolates, isolates are grown from a frozen stock on several Petri dishes containing media that promotes the growth of the particular fungal isolate and the plates are incubated under optimal environmental conditions (temperature, atmosphere, light). After mycelia and spore development, the fungal culture is scraped and resuspended in 0.05M Phosphate buffer (pH 7.2, 10 mL/plate). Disposable polystyrene Bioassay dishes (500 $cm^2$, Thermo Scientific Nunc UX-01929-00) are prepared with 225 mL of autoclaved media with any required supplements added to the media, and allowed to solidify. Plates are stored at room temperature for 2-5 days prior to inoculation to confirm sterility. 5 mL of the fungal suspension is spread over the surface of the agar in the Bioassay plate in a biosafety cabinet, plates are allowed to dry for 1 h, and they are then incubated for 2-5 days, or until mycelia and/or spores have developed.

A liquid fungal suspension is then created via the following. Fungal growth on the surface of the agar in the Bioassay plates are then scraped and resuspended in 0.05M Phosphate buffer (pH 7.2). $OD_{600}$ readings are taken using a spectrometer and correlated to previously established $OD_{600}$/CFU counts to estimate fungal population densities, and the volume adjusted with additional sodium phosphate buffer to result in 100 mL aliquots of fungi at a density of approximately $10^6$-$10^{11}$ spores/mL. This suspension may or may not be filtered to remove mycelia and can be used to create a liquid microbial formulation as described herein to apply the fungal isolate onto a plant, plant part, or seed.

VIII. Growth & Scale-Up of Bacteria for Inoculation in Liquid Media

Bacterial strains are grown by loop-inoculation of one single colony into R2A broth (amended with the appropriate antibiotics) in 100 mL flasks. The bacterial culture is incubated at 28±2° C. for 1 day at 180 rpm in a shaking incubator (or under varying temperatures and shaking speeds as appropriate). The bacteria are pelleted by centrifugation and resuspended in sterile 0.1 M sodium phosphate. $OD_{600}$ readings are taken using a spectrometer and correlated to previously established $OD_{600}$/CFU counts to estimate bacterial population densities, and the volume adjusted with additional sodium phosphate buffer to result in 100 mL aliquots of bacteria at a density of $1\times10^8$ cells/mL. To help break surface tension, aid bacterial entry into plants and provide microbes for some energy for growth, 10 μL of Silwet L-77 surfactant and 1 g of sucrose is added to each 100 mL aliquot (resulting in 0.01% v/v and 1% v/v concentrations, respectively) in a similar way as in the protocol for *Agrobacterium*-mediated genetic transformation of *Arabidopsis thaliana* seed [Clough, S., Bent, A. (1999) The Plant Journal 16(6): 735-743].

IX. Growth & Scale-Up of Fungi for Inoculation in Liquid Media

Once a fungal isolate has been characterized, conditions are optimized for growth in the lab and scaled-up to provide enough material for assays. For example, the medium used to isolate the fungi is supplemented with nutrients, vitamins, co-factors, plant-extracts, and/or other supplements that can decrease the time required to grow the fungal isolate and/or increase the yield of mycelia and/or spores the fungal isolate produces. These supplements can be found in the literature or through screening of different known media additives that promote the growth of all fungi or of the particular fungal taxa.

To scale up the growth of fungal isolates, isolates are grown from a frozen stock on Petri dishes containing media that promotes the growth of the particular fungal isolate and the plates are incubated under optimal environmental conditions (temperature, atmosphere, light). After mycelia and spore development, the fungal culture is scraped and resuspended in 0.05M Phosphate buffer (pH 7.2, 10 mL/plate). 1 liter of liquid media selected to grow the fungal culture is prepared in 2 L glass flasks and autoclaved and any required supplements added to the media. These are stored at room temperature for 2-5 days prior to inoculation to confirm sterility. 1 mL of the fungal suspension is added aseptically to the media flask, which is then incubated for 2-5 days, or until growth in the liquid media has reached saturation. Spore counts are determined using hemacytometer and correlated to previously established $OD_{600}$/CFU counts to estimate fungal population densities, and the volume adjusted with additional sodium phosphate buffer to result in 100 mL aliquots of fungi at a density of approximately $10^6$-$10^{11}$ spores/mL. This suspension may or may not be filtered to remove mycelia and can be used to create a liquid microbial formulation as described herein to apply the fungal isolate onto a plant, plant part, or seed.

X. Creation of Liquid Microbial Formulations or Preparations for the Application of Microbes to Plants Bacterial or fungal cells are cultured in liquid nutrient broth medium to between $10^2$-$10^{12}$ CFU/mL. The cells are separated from the medium and suspended in another liquid medium if desired. The microbial formulation may contain one or more bacterial or fungal strains. The resulting formulation contains living cells, lyophilized cells, or spores of the bacterial or fungal strains. The formulation may also contain water, nutrients, polymers and binding agents, surfactants or polysaccharides such as gums, carboxymethylcellulose and polyalcohol derivatives. Suitable carriers and adjuvants can be solid or liquid and include natural or regenerated mineral substances, solvents, dispersants, wetting agents, tackifiers, thickeners, binders or fertilizers. Compositions can take the form of aqueous solutions, oil-in-water emulsions, or water-in-oil emulsions. Small amounts of insoluble material can optionally be present, for example in suspension in the medium, but it is generally preferred to minimize the presence of such insoluble material.

XI. Inoculation of Plants by Coating Microbes Directly onto Seed

Seed is treated by coating it with a liquid microbial formulation (prepared as described herein) comprising microbial cells and other formulation components, directly onto the seed surface at the rate of $10^2$-$10^8$ microbial CFU per seed. Seeds are soaked in liquid microbial formulation for 1, 2, 3, 5, 10, 12, 18 or 24 hours or 2, 3, or 5 days. After soaking in microbial formulation, seeds are planted in growing containers or in an outdoor field. Seeds may also be coated with liquid microbial formulation by using an auger or a commercial batch treater. One or more microbial formulations or other seed treatments are applied concurrently or in sequence. Treatment is applied to the seeds using a variety of conventional treatment techniques and machines, such as fluidized bed techniques, augers, the roller mill method, rotostatic seed treaters, and drum coaters. Other methods, such as spouted beds may also be useful. The seeds are pre-sized before coating. Optionally the microbial formulation is combined with an amount of insecticide, herbicide, fungicide, bactericide, or plant growth regulator, or plant micro- or macro-nutrient prior to or during the coating process. After coating, the seeds are typically dried and then transferred to a sizing machine for grading before planting. Following inoculation, colonization of the plants or seeds produced therefrom is confirmed via any of the various methods described herein. Growth promotion or stress resilience benefits to the plant are tested via any of the plant growth testing methods described herein.

XII. Inoculation of Plants with a Combination of Two or More Microbes

Seeds can be coated with bacterial or fungal endophytes. This method describes the coating of seeds with two or more bacterial or fungal strains. The concept presented here involves simultaneous seed coating of two microbes (e.g., both a gram negative endophytic bacterium *Burkholderia phytofirmans* and a gram positive endophytic bacterium *Bacillus mojavensis*). Optionally, both microbes are genetically transformed by stable chromosomal integration as follows. *Bacillus mojavensis* are transformed with a construct with a constitutive promoter driving expression of a synthetic operon of GFPuv and spectinomycin resistance genes, while *Burkholderia phytofirmans* are transformed with a construct with a constitutive promoter driving expression of the lac operon with an appended spectinomycin resistance gene. Seeds are coated with a prepared liquid formulation of the two microbes the various methods described herein. Various concentrations of each endophyte in the formulation is applied, from $10^2$ CFU/seed to about $10^8$ CFU/seed. Following inoculation, colonization of the plants or seeds produced therefrom may be confirmed via any of the various methods described herein. Growth promotion or stress resilience benefits to the plant are tested via any of the plant growth testing methods described herein.

XIII. Culturing to Confirm Colonization of Plant by Bacteria

The presence in the seeds or plants of GFPuv or gusA-labeled endophytes can be detected by colony counts from mashed seed material and germinated seedling tissue using R2A plates amended with 5-Bromo-4-chloro-3-indolyl β-D-glucuronide (X-glcA, 50 μg/mL), IPTG (50 μg/mL) and the antibiotic spectinomycin (100 μg/mL). Alternatively, bacterial or fungal endophytes not having received transgenes can also be detected by isolating microbes from plant, plant tissue or seed homogenates (optionally surface-sterilized) on antibiotic free media and identified visually by colony morphotype and molecular methods described herein. Representative colony morphotypes are also used in colony PCR and sequencing for isolate identification via ribosomal gene sequence analysis as described herein. These trials are repeated twice per experiment, with 5 biological samples per treatment.

XIV. Culture-Independent Methods to Confirm Colonization of the Plant or Seeds by Bacteria or Fungi One way to detect the presence of endophytes on or within plants or seeds is to use quantitative PCR (qPCR). Internal colonization by the endophyte can be demonstrated by using surface-sterilized plant tissue (including seed) to extract total DNA, and isolate-specific fluorescent MGB probes and amplification primers are used in a qPCR reaction. An increase in the product targeted by the reporter probe at each PCR cycle therefore causes a proportional increase in fluorescence due to the breakdown of the probe and release of the reporter. Fluorescence is measured by a quantitative PCR instrument and compared to a standard curve to estimate the number of fungal or bacterial cells within the plant.

XV. Experimental Description

The design of both species-specific amplification primers, and isolate-specific fluorescent probes are well known in the art. Plant tissues (seeds, stems, leaves, flowers, etc.) are pre-rinsed and surface sterilized using the methods described herein.

Total DNA is extracted using methods known in the art, for example using commercially available Plant-DNA extraction kits, or the following method.

1. Tissue is placed in a cold-resistant container and 10-50 mL of liquid nitrogen is applied. Tissues are then macerated to a powder.
2. Genomic DNA is extracted from each tissue preparation, following a chloroform:isoamyl alcohol 24:1 protocol (Sambrook, Joseph, Edward F. Fritsch, and Thomas Maniatis. *Molecular cloning*. Vol. 2. New York: Cold spring harbor laboratory press, 1989.).

Quantitative PCR is performed essentially as described by Gao, Zhan, et al. *Journal of clinical microbiology* 48.10 (2010): 3575-3581 with primers and probe(s) specific to the desired isolate using a quantitative PCR instrument, and a standard curve is constructed by using serial dilutions of cloned PCR products corresponding to the specie-specific PCR amplicon produced by the amplification primers. Data are analyzed using instructions from the quantitative PCR instrument's manufacturer software.

As an alternative to qPCR, Terminal Restriction Fragment Length Polymorphism, (TRFLP) can be performed, essentially as described in Johnston-Monje D, Raizada M N (2011) PLoS ONE 6(6): e20396. Group specific, fluorescently labelled primers are used to amplify a subset of the microbial population, especially bacteria, especially fungi, especially archaea, especially viruses. This fluorescently labelled PCR product is cut by a restriction enzyme chosen for heterogeneous distribution in the PCR product population. The enzyme cut mixture of fluorescently labelled and unlabeled. DNA fragments is then submitted for sequence analysis on a Sanger sequence platform such as the Applied Biosystems 3730 DNA Analyzer.

XVI. Immunological Methods to Detect Microbes in Seeds and Vegetative Tissues

A polyclonal antibody is raised against specific bacteria X or fungus Y strains via standard methods. A polyclonal antibody is also raised against specific GUS and GFP proteins via standard methods. Enzyme-linked immunosorbent assay (ELISA) and immunogold labeling is also conducted via standard methods, briefly outlined below.

Immunofluorescence microscopy procedures involve the use of semi-thin sections of seed or seedling or adult plant tissues transferred to glass objective slides and incubated with blocking buffer (20 mM Tris (hydroxymethyl)-aminomethane hydrochloride (TBS) plus 2% bovine serum albumin, pH 7.4) for 30 min at room temperature. Sections are first coated for 30 min with a solution of primary antibodies and then with a solution of secondary antibodies (goat anti-rabbit antibodies) coupled with fluorescein isothiocyanate (FITC) for 30 min at room temperature. Samples are then kept in the dark to eliminate breakdown of the light-sensitive FITC. After two 5-min washings with sterile potassium phosphate buffer (PB) (pH 7.0) and one with double-distilled water, sections are sealed with mounting buffer (100 mL 0.1 M sodium phosphate buffer (pH 7.6) plus 50 mL double-distilled glycerine) and observed under a light microscope equipped with ultraviolet light and a FITC Texas-red filter.

Ultra-thin (50- to 70-nm) sections for TEM microscopy are collected on pioloform-coated nickel grids and are labeled with 15-nm gold-labeled goat anti-rabbit antibody. After being washed, the slides are incubated for 1 h in a 1:50 dilution of 5-nm gold-labeled goat anti-rabbit antibody in IGL buffer. The gold labeling is then visualized for light microscopy using a BioCell silver enhancement kit. Toluidine blue (0.01%) is used to lightly counterstain the gold-labeled sections. In parallel with the sections used for immunogold silver enhancement, serial sections are collected on uncoated slides and stained with 1% toluidine blue. The sections for light microscopy are viewed under an optical microscope, and the ultrathin sections are viewed by TEM.

XVII. Characterization of Uniformity of Endophytes in a Population of Seeds

To test for the homogeneity of endophytes either on the surface or colonizing the interior tissues in a population of seeds, seeds are tested for the presence of the microbes by culture-dependent and/or -independent methods. Seeds are obtained, surface sterilized and pulverized, and the seed homogenate is divided and used to inoculate culture media or to extract DNA and perform quantitative PCR. The homogeneity of colonization in a population of seeds is assessed through detection of specific microbial strains via these methods and comparison of the culture-dependent and culture-independent results across the population of seeds. Homogeneity of colonization for a strain of interest is rated based on the total number of seeds in a population that contain a detectable level of the strain, on the uniformity across the population of the number of cells or CFU of the strain present in the seed, or based on the absence or presence of other microbial strains in the seed.

XVIII. Experimental Description

Surface sterilized seeds are obtained as described herein. For culture-dependent methods of microbial-presence confirmation, bacterial and fungi are obtained from seeds essentially as described herein with the following modification. Seed homogenate is used to inoculate media containing selective and/or differential additives that will allow to identification of a particular microbe.

For qPCR, total DNA of each seed is extracted using methods known in the art, as described herein.

XIX. Characterization of Homogeneity of Colonization in Population of Plants

To test for the homogeneity of microorganisms (including endophytes) colonizing the interior in a population of plants, tissues from each plant are tested for the presence of the microbes by culture-dependent and/or -independent methods. Tissues are obtained, surface sterilized and pulverized, and the tissue material is divided and used to inoculate culture media or to extract DNA and perform quantitative PCR. The homogeneity of colonization in a population of plants is assessed through detection of specific microbial strains via these methods and comparison of the culture-dependent and culture-independent results across the population of plants or their tissues. Homogeneity of colonization for a strain of interest is rated based on the total number of plants in a population that contain a detectable level of the strain, on the uniformity across the population of the number of cells or CFU of the strain present in the plant tissue, or based on the absence or presence of other microbial strains in the plant.

XX. Experimental Description

Surface sterilized plant tissues are obtained as described herein. For culture-dependent methods of microbial-presence confirmation, bacterial and fungi are obtained from plant tissues essentially as described herein with the following modification. Plant tissue homogenate is used to inoculate media containing selective and/or differential additives that will allow identification of a particular microbe.

For qPCR, total DNA of each plant tissue is extracted using methods known in the art, as described herein.

Other embodiments will be apparent to those skilled in the art from consideration of the specification and practice of the embodiments. Consider the specification and examples as exemplary only, with a true scope and spirit being indicated by the following claims.

SEQUENCE LISTING (4957 sequences)

SEQ ID NO: 1 - DNA, 254 bp, Unknown
  Kingdom: Bacteria, Phylum: OD1
tacagagacctcaagcattatccggatttattgggcgtatagggtccgcaggtggcccggcacgtcccgcgttaaataccaaagctcaactttggcaccgcgcgggatacggccaaggctcgagggtgggagaggcgagcggaattaccggtgtagtagtaaaatgcgtttatatcggtaagaacaccaaaagcgaaggcagctcgctggaacacttctgacactcagggacgaaagcgtggggagcgaatggg

SEQ ID NO: 2 - DNA, 253 bp, Unknown
  Kingdom: Bacteria, Phylum: Actinobacteria
tacgtagggtgcaagcgttgtccggaattattgggcgtaaagagctcgtaggcggtttgtcgcgtctgctgtgaaaacgcgaggctcaacctcgcgcctgcagtgggtacgggcagactagagtgtggtaggggagattggaattcctggtgtagcggtggaatgcgcagatatcaggaggaacaccgatggcgaaggcagatctctgggccattactgacgctgaggagcgaaagcgtggggagcgaacagg

SEQ ID NO: 3 - DNA, 253 bp, Unknown
  Kingdom: Bacteria, Phylum: Actinobacteria
tacgtagggtgcgagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacagg

SEQ ID NO: 4 - DNA, 254 bp, Unknown
  Kingdom: Bacteria, Phylum: Actinobacteria
tacgtagggtgcgagcgttgtccggaattactgggcgtaaagggctcgtaggtggtttgtcgcgtcgtctgtgaaattccggggcttaactccgggcgtgcaggcgatacgggcataacttgagtactgtaggggtaactggaattcctggtgtagcggtgaaatgcgcagatatcaggaggaacaccgatggcgaaggcaggttactgggcagttactgacgctgaggagcgaaagcatgggtagcgaacagg

SEQ ID NO: 5 - DNA, 253 bp, Unknown
  Kingdom: Bacteria, Phylum: Actinobacteria
tacgtagggtgcgagcgttgtccggaattactgggcgtaaagagctcgtaggcggtttgtcacgtcgtctgtgaaatcctagggcttaaccctggacgtgcaggcgatacgggctgacttgagtactacaggggagactggaatttctggtgtagcggtggaatgcacagatatcaggaagaacaccgatggcgaaggcaggtctctgggtagtaactgacgctgaggagcgaaagcatgggtagcgaacagg

SEQ ID NO: 6 - DNA, 253 bp, Unknown
  Kingdom: Bacteria, Phylum: Actinobacteria
tacgtagggtgcaagcgttgtccggaattattgggcgtaaagagctcgtaggcggtttgtcgcgtcggctgtgaaagcccggagctcaactccgggtctgcagtcgatacgggcagacttgagtgttgcaggggagactggaattcctggtgtagcggtgaaatgcgcagatatcaggaggaacaccggtggcgaaggcgggtctctgggcaacaactgacgctgaggagcgaaagcgtggggagcgaacagg

SEQ ID NO: 7 - DNA, 253 bp, Unknown
  Kingdom: Bacteria, Phylum: Actinobacteria
tacgtagggcgcaagcgttgtccggaattattgggcgtaaagagctcgtaggcggtttgtcgcgtctggtgtgaaaactcaaggctcaaccttgagcttgcatcgggtacgggcagactagagtgtggtaggggtgactggaattcctggtgtagcggtggaatgcgcagatatcaggaggaacaccgatggcgaaggcaggtcactgggccactactgacgctgaggagcgaaagcatggggagcgaacagg

SEQ ID NO: 8 - DNA, 253 bp, Unknown
  Kingdom: Bacteria, Phylum: Actinobacteria
tacgtagggtgcaagcgttgtccggaattattgggcgtaaagagctcgtaggcggtttgtcgcatctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcggaagcgtggggagcgaacagg

SEQ ID NO: 9 - DNA, 253 bp, Unknown
  Kingdom: Bacteria, Phylum: Actinobacteria
tacgtagggcgcaagcgttgtccggaattattgggcgtaaagagctcgtaggcggtttgtcgcgtctgctgtgaaagcccggggctcaaccccgggtctgcagtgggtacgggcagactagagtgcagtaggggagactggaattcctggtgtagcggtgaaatgcgcagatatcaggaggaacaccgatggcgaaggcaggtctctgggctgttactgacgctgaggagcgaaagcatggggagcgaacagg

SEQ ID NO: 10 - DNA, 253 bp, Unknown
  Kingdom: Bacteria, Phylum: Actinobacteria
tacgtagggtgcgagcgttgtccggaattactgggcgtaaagagttcgtaggcggtttgtcgcgtcgtttgtgaaaacccggggctcaacttcgggcttgcaggcgatacgggcagacttgagtgtttcaggggagactggaattcctggtgtagcggtgaaatgcgcagatatcaggaggaacaccggtggcgaaggcgggtctctgggaaacaactgacgctgaggaacgaaagcgtgggtagcaaacagg

SEQ ID NO: 11 - DNA, 253 bp, Unknown
  Kingdom: Bacteria, Phylum: Actinobacteria
tacgtagggtgcaagcgttgtccggaattattgggcgtaaagagctcgtaggcggtgtgtcgcgtctgctgtgaaaactcagggctcaactctgagcttgcagtgggtacgggcacactagagtgctgtaggggagactggaattcctggtgtagcggtgaaatgcgcagatatcaggaggaacaccggtggcgaaggcgggtctctgggcagttactgacgctgaggagcgaaagcatggggagcgaacagg

SEQ ID NO: 12 - DNA, 253 bp, Unknown
  Kingdom: Bacteria, Phylum: Actinobacteria
tacgtagggtgcaagcgttgtccggaattattgggcgtaaagagctcgtaggcggtttgtcgcgtctgctgtgaaatctgggggctcaacccccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacagg

SEQ ID NO: 13 - DNA, 253 bp, Unknown
  Kingdom: Bacteria, Phylum: Actinobacteria
tacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacagg

SEQ ID NO: 14 - DNA, 253 bp, Unknown
  Kingdom: Bacteria, Phylum: Proteobacteria
tacggagggggctagcgttgttcggaattactgggcgtaaagcgcacgtaggcggctgttcaagtcagaggtgaaagcccggagctcaactccggaattgcctttgaaactagacagcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 15 - DNA, 253 bp, Unknown
  Kingdom: Bacteria, Phylum: Proteobacteria
tacgaagggggctagcgttgctcggaattactgggcgtaaagggagcgtaggcggacatttaagtcaggggtgaaatcccagagctcaactctggaactgcctttgatactgggtgtcttgagtgtgatagaggtatgtggaactccgagtgtagaggtgaaattcgtagatattcggaagaacaccagtggcgaaggcgacatactggatcattactgacgctgaggctcgaaagcgtggggagcaaacagg

SEQ ID NO: 16 - DNA, 253 bp, Unknown
  Kingdom: Bacteria, Phylum: Proteobacteria
tacgaagggggctagcgttgttcggaattactgggcgtaaagcgcacgtaggcggatatttaagtcaggggtgaaatcccgcagctcaactgcggaactgcctttgatactggatatcttgagtatggaagaggtgagtggaattccgagtgtagaggtgaaattcgtagatattcggaggaacaccagtggcgaaggcggctcactggtccataactgacgctgaggtgcgaaagcgtggggagcaaacagg

SEQ ID NO: 17 - DNA, 253 bp, Unknown
  Kingdom: Bacteria, Phylum: Proteobacteria
tacgaagggggctagcgttgttcggaattactgggcgtaaagcgcacgtaggcggacatttaagtcaggggtgaaatcccggggctcaaccccggaactgcctttgatactgggtgtcttgagtgtggtagaggtgagtggaattgcgagtgtagaggtgaaattcgtagatattcgcaggaacaccagtggcgaaggcggctcactggaccacaactgacgctgaggtgcgaaagcgtggggagcaaacagg

SEQ ID NO: 18 - DNA, 253 bp, Unknown
  Kingdom: Bacteria, Phylum: Proteobacteria
tacgaagggggctagcgttgttcggaattactgggcgtaaagcgcacgtaggcggactattaagtcaggggtgaaatcccggggctcaaccccggaactgcctttgatactggtagtctcgagtccggaagaggtgagtggaattccgagtgtagaggtgaaattcgtagatattcggaggaacaccagtggcgaaggcggctcactggtccggtactgacgctgaggtgcgaaagcgtggggagcaaacagg

SEQ ID NO: 19 - DNA, 253 bp, Unknown
  Kingdom: Bacteria, Phylum: Proteobacteria
tacgaagggggctagcgttgttcggatttactgggcgtaaagcgcacgtaggcggtttgttaagtcaggggtgaaatcccagagctcaactctggaactgcctttgatactggcaagctcgagtccggaagaggtaagtggaactcctagtgtagaggtggaattcgtagatattaggaagaacaccagtggcgaaggcggcttactggtccggaactgacgctgaggtgcgaaagcgtggggagcaaacagg

SEQ ID NO: 20 - DNA, 253 bp, Unknown
  Kingdom: Bacteria, Phylum: Proteobacteria
tacggagggggctagcgttgttcggaattactgggcgtaaagcgcacgtaggcggctttgcaagttagaggtgaaagcccggggctcaaccccggaattgcctttaagactgcagggctagaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 21 - DNA, 253 bp, Unknown
  Kingdom: Bacteria, Phylum: Proteobacteria
tacgaagggggctagcgttgttcggaatcactgggcgtaaagggtgcgtaggcgggatcttaagtcaggggtgaaatcccgaggctcaacctcggaactgcctttgatactggggtccttgagtccggaagaggtgagtggaactgcgagtgtagaggtgaaattcgtagatattcgcaagaacaccggtggcgaaggcggctcactggtccggaactgacgctgaggcacgacagcgtggggagcaaacagg

SEQ ID NO: 22 - DNA, 253 bp, Unknown
  Kingdom: Bacteria, Phylum: Proteobacteria
tacgaagggggctagcgttgctcggaattactgggcgtaaagggagcgtaggcggacatttaagtcaggggtgaaatcccggggctcaacctcggaattgcctttgatactgggtgtcttgagtatgagagaggtgtgtggaactccgagtgtagaggtgaaattcgtagatattcggaagaacaccagtggcgaaggcgacacactggctcattactgacgctgaggctcgaaagcgtggggagcaaacagg

SEQ ID NO: 23 - DNA, 253 bp, Unknown
  Kingdom: Bacteria, Phylum: Proteobacteria
tacggagggggctagcgttgttcggaattactgggcgtaaagcgcacgtaggcggccgaataagtcagaggtgaaagcctggggctcaaccccagaactgcctttgagactgtatggctagaacgtcggagaggtgagtggaattccgagtgtagaggtgaaattcgtagatattcggaagaacaccagtggcgaaggcggctcactggacgactgttgacgctgaggtgcgaaagcgtggggagcaaacagg

SEQ ID NO: 24 - DNA, 253 bp, Unknown
  Kingdom: Bacteria, Phylum: Proteobacteria
tacgaagggggctagcgttgctcggaattactgggcgtaaagggcgcgtaggcggcttagttagtcaggcgtgaaattcctgggctcaacctggggactgcgcttgatacggctaggctagaggatggaagagggtcgcggaattcccagtgtagaggtgaaattcgtagatattgggaagaacaccggtggcgaaggcggcgacctggtccattactgacgctgaggcgcgacagcgtggggagcaaacagg

SEQ ID NO: 25 - DNA, 253 bp, Unknown
  Kingdom: Bacteria, Phylum: Proteobacteria
ggcggggggggctagcgttgttcggaattactgggcgtaaagcgcgcgtaggcggttactcaagtcagaggtgaaagcccggggctcaaccccggaactgcctttgaaactaggtaactagaatcttggagaggtcagtggaattccgagtgtagaggtgaaattcgtagatattcggaagaacaccagtggcgaaggcgactgactggacaagtattgacgctgaggtgcgaaagcgtggggagcagacagg

SEQ ID NO: 26 - DNA, 253 bp, Unknown
  Kingdom: Bacteria, Phylum: Proteobacteria
tacggagggggctagcgttgttcggaattactgggcgtaaagcgcacgtaggcggaacagaaagtcagaggtgaaatcccagggctcaaccttggaactgcctttgaaactcctgttcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacagg

SEQ ID NO: 27 - DNA, 253 bp, Unknown
  Kingdom: Bacteria, Phylum: Proteobacteria
tacgaagggggctagcgttgttcggaattactgggcgtaaagcgcacgtaggcggacatttaagtcaggggtgaaatcccggggctcaaccccggaacggcctttgatactgggtgtcttgagttcggaagaggtgagtggaattgcgagtgtagaggtgaaattcgtagatattcgcaggaacaccagtggcgaaggcggctcactggtccgatactgacgctgaggtgcgaaagcgtggggagcaaacagg

SEQ ID NO: 28 - DNA, 253 bp, Unknown
  Kingdom: Bacteria, Phylum: Proteobacteria
tacggagggagctagcgttgttcggaattactgggcgtaaagcgcgcgtaggcggctattcaagtcagaggtgaaagcccggggctcaaccccggaactgcctttgaaactaggtagctagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 29 - DNA, 253 bp, Unknown
  Kingdom: Bacteria, Phylum: Proteobacteria
tacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacagg

SEQ ID NO: 30 - DNA, 253 bp, Unknown
  Kingdom: Bacteria, Phylum: Proteobacteria
tacggagggagctagcgttattcggaattactgggcgtaaggcgcacgtaggcggctttgtaagtcagaggtgaaagcctggagctcaactccagaactgcctttgagactgcatcgctcgaatccaggagaggtgagtggaattccgagtgtagaggtgaaattcgtagatattcggaagaacaccagtggcgaaggcggctcaccggactggtattgacgctgaggtgcgaaagcgtggggagcaaacagg

SEQ ID NO: 31 - DNA, 253 bp, Unknown
  Kingdom: Bacteria, Phylum: Proteobacteria
tacggagggggctagcgttgttcggaattactgggcgtaaagcgcacgtaggcggctttgtaagtaagaggtgaaagcctggtgctcaacaccagaactgccttttagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 32 - DNA, 253 bp, Unknown
  Kingdom: Bacteria, Phylum: Proteobacteria
tacggagggggctagcgttgttcggaattactgggcgtaaagcgcacgtaggcggctttgtaagttaggggtgaaagcctggagctcaactccagaattgcctttaagactgcatcgcttgaatccaggagaggtgagtggaattccgagtgtagaggtgaaattcgtagatattcggaagaacaccagtggcgaaggcggctgactggacatgtattgacgctgaggtgcgaaagcgtggggagcaaacagg

SEQ ID NO: 33 - DNA, 253 bp, Unknown
  Kingdom: Bacteria, Phylum: Proteobacteria
gacggggggggcaagtgttcttcggaatcactgggcgtaaagggcgcgtaggcggccattcaagtcgggggtgaaagcctgtggctcaaccacagaattgccttcgatactgtttggcttgagtttggtagaggttggtggaactgcgagtgtagaggtgaaattcgtagatattcgcaagaacaccagtggcgaaggcggccaactggaccaacactgacgctgaggcgcgaaagcgtggggagcaaacagg

SEQ ID NO: 34 - DNA, 253 bp, Unknown
  Kingdom: Bacteria, Phylum: Proteobacteria
tacgaagggggctagcgttgttcggaattactgggcgtaaagggcgcgtaggcggcctgttaagttaggagtgaaagccccgggctcaacctgggaattgctcttgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacagg

SEQ ID NO: 35 - DNA, 253 bp, Unknown
  Kingdom: Bacteria, Phylum: Proteobacteria
tacgaagggggctagcgttgctcggaatcactgggcgtaaagggcgcgtaggcggccattcaagtcgggggtgaaagcctgtggctcaaccacagaattgccttcgatactgtttggcttgagtatggcagaggtcagtggaactgcgagtgtagaggtgaaattcgtagatattcgcaagaacaccagtggcgaaggcggctgactgggccattactgacgctgaggcgcgaaagcgtggggagcaaacagg

SEQ ID NO: 36 - DNA, 253 bp, Unknown
  Kingdom: Bacteria, Phylum: Proteobacteria
tacgaagggggctagcgttactcggaattactgggcgtaaagggcgcgtaggcggcgctccaagttaggcgtgaaagtcctgggctcaacctgggaactgcgcttaagactggagtgcttgaggatggaagagggtcgtggaattcccagtgtagaggtgaaattcgtagatattgggaagaacaccggtggcgaaggcggcgacctggtccattactgacgctgaggcgcgacagcgtggggagcaaacagg

SEQ ID NO: 37 - DNA, 253 bp, Unknown
  Kingdom: Bacteria, Phylum: Proteobacteria
tacggagggggctagcgttgttcggaattactgggcgtaaagcgtacgtaggcggttttgtaagttagaggtgaaagcccggagctcaacttcggaattgcctttaagactgcatcacttgaacgtcggagaggtgagtggaattccgagtgtagaggtgaaattcgtagatattcggaagaacaccagtggcgaaggcggctcactggacgactgttgacgctgaggtacgaaagcgtggggagcaaacagg

SEQ ID NO: 38 - DNA, 253 bp, Unknown
  Kingdom: Bacteria, Phylum: Proteobacteria
tacggagggggctagcgttgttcggaattactgggcgtaaagcgcacgtaggcggctttgtaagtcaggggtgaaagcctggagctcaactccagaactgcctttgagactgcatcgcttgaatccgggagaggtaagtggaattccgagtgtagaggtgaaattcgtagatattcggaagaacaccagtggcgaaggcggcttactggaccgggattgacgctgaggtgcgaaagcgtggggagcaaacagg

SEQ ID NO: 39 - DNA, 253 bp, Unknown
  Kingdom: Bacteria, Phylum: Proteobacteria
tacgaagggggctagcgttgctcggaatcactgggcgtaaagggcgcgtaggcggccttgtaagttgggggtgaaagcccgtggctcaaccacggaattgccttcgatactgcttggcttgagtgtggtagaggttggtggaactgcgagtgtagaggtgaaattcgtagatattcgcaagaacaccggtggcgaaggcggccaactggaccatcactgacgctgaggcgcgaaagcgtggggagcaaacagg

SEQ ID NO: 40 - DNA, 253 bp, Unknown
  Kingdom: Bacteria, Phylum: Proteobacteria
tacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacagg

SEQ ID NO: 41 - DNA, 253 bp, Unknown
  Kingdom: Bacteria, Phylum: Proteobacteria
tacgaagggggctagcgttgctcggaatcactgggcgtaaagggcgtgtaggcggccattcaagtcgggggtgaaagcctgtggctcaaccacagaattgccttcgatactgtttggcttgagtttggtagaggttggtggaactgcgagtgtagaggtgaaattcgtagatattcgcaagaacaccagtggcgaaggcggccgactggaccaatactgacgctgaggcgcgaaagcgtggggagcaaacagg

SEQ ID NO: 42 - DNA, 253 bp, Unknown
  Kingdom: Bacteria, Phylum: Proteobacteria
tacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacagg

SEQ ID NO: 43 - DNA, 253 bp, Unknown
  Kingdom: Bacteria, Phylum: Proteobacteria
tacggagggagctagcgttgttcggaattactgggcgtaaagcgcacgtaggcggctttgtaagttagaggtgaaagcctggagctcaactccagaattgcctttgatactgcatggcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 44 - DNA, 253 bp, Unknown
  Kingdom: Bacteria, Phylum: Proteobacteria
tacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacagg

SEQ ID NO: 45 - DNA, 253 bp, Unknown
  Kingdom: Bacteria, Phylum: Proteobacteria
tacggagggagctagcgttgttcggaattactgggcgtaaggcgcacgtaggcggctttgtaagttggaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctggggtgcgaaagcatggggagcgaacagg

SEQ ID NO: 46 - DNA, 252 bp, Unknown
  Kingdom: Bacteria, Phylum: Firmicutes
tacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 47 - DNA, 253 bp, Unknown
  Kingdom: Bacteria, Phylum: Firmicutes
tacgtatgtcccgagcgttatccggatttattgggcgtaaagcgagcgcagacggttgattaagtctgatgtgaaagcccggagctcaactccggaattgcattggaaactggttaacttgagtgttgtagaggtaagtggaactccatgtgtagcggtggaatgcgtagatatatggaagaacaccagtggcgaaggcggcttactggacaacaactgacgttgaggctcgaaagtgtgggtagcaaacagg

SEQ ID NO: 48 - DNA, 253 bp, Unknown
  Kingdom: Bacteria, Phylum: Firmicutes
tacgtaggtggcaagcgttgtccggaattattgggcgtaaagcgcgcgcaggcggccttttaagtctgatgtgaaagcccacggctcaaccgtggagggtcattggaaactggaaggcttgagtgcagaagagaagagcggaattccacgtgtagcggtgaaatgcgtagagatgtggaggaacaccagtggcgaaggcggctctttggtctgtaactgacgctgaggcgcgagagcgtggggagcgaacagg

SEQ ID NO: 49 - DNA, 252 bp, Unknown
  Kingdom: Bacteria, Phylum: Firmicutes
tacgtagggggcaagcgttgtccggaattattgggcgtaaagcgcgcgcaggcggtcatttaagtctggtgtttaatcccgaagctcaacttcgggtcgcatcggaaactgggtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 50 - DNA, 253 bp, Unknown
  Kingdom: Bacteria, Phylum: Firmicutes
tacgtagggggcaagcgttgtccggaattattgggcgtaaagcgcgcgcaggcggttatttaagtctgatgtgaaagcctacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacagg

SEQ ID NO: 51 - DNA, 253 bp, Unknown
  Kingdom: Bacteria, Phylum: Firmicutes
tacgtagggggcaagcgttgtccggaattattgggcgtaaagggcgcgtaggcggtttcttaagtctgatgtgaaagcccacagcttaactgtggagggtcattggaaactggggaacttgagtgcagaagaggagagtggaattccacgtgtagcggtgaaatgcgtagatatgtggaggaacaccagtggcgaaggcgactctctggtctgtaactgacgctgaggcgcgaaagcgtggggagcaaacagg

SEQ ID NO: 52 - DNA, 253 bp, Unknown
  Kingdom: Bacteria, Phylum: Firmicutes
tacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacagg

SEQ ID NO: 53 - DNA, 252 bp, Unknown
  Kingdom: Bacteria, Phylum: Firmicutes
tacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 54 - DNA, 252 bp, Unknown
  Kingdom: Bacteria, Phylum: Firmicutes
tacgtagggggcaagcgttgtccggaattattgggcgtaaagcgcgcgcaggcggttgtttaagtctggagtttaagttcggggctcaaccccgtatcgctctggaaactggggaactggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacagg

SEQ ID NO: 55 - DNA, 253 bp, Unknown
  Kingdom: Bacteria, Phylum: Firmicutes
aacgtaggtggcaagcgttgtccggaattattgggcgtaaagcgcgcgcaggcggtcctttaagtctgatgtgaaagcccacggctcaaccgtggagggtcattggaaactggaggacttgagtgcagaagaggaaagtggaattccatgtgtagcggtgaaatgcgtagagatgtggaggaacaccagtggcgaaggcgactttctggtctgcaactgacgctgaggcgcgaaagcgtggggagcaaacagg

SEQ ID NO: 56 - DNA, 253 bp, Unknown
  Kingdom: Bacteria, Phylum: Firmicutes
tacgtatgtcccgagcgttatccggatttattgggcgtaaagcgagcgcagacggttggttaagtctgatgtgaaagcccggagctcaactccggaaaggcattggaaactggttaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacagg

SEQ ID NO: 57 - DNA, 253 bp, Unknown
  Kingdom: Bacteria, Phylum: Firmicutes
tacgtaggtggcaagcgttgtccggatttattgggcgtaaagcgagcgcaggcggttcttttagtctgatgtgaaagcccccggctcaaccggggagggtcattggaaactggagaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacagg

SEQ ID NO: 58 - DNA, 252 bp, Unknown
  Kingdom: Bacteria, Phylum: Firmicutes
tacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacagg

SEQ ID NO: 59 - DNA, 252 bp, Unknown
  Kingdom: Bacteria, Phylum: Firmicutes
tacgtagggggcaagcgttgtccggaattattgggcgtaaagcgcgtgcaggcggcttcttaagtcgggtgtttaagaccggggctcaaccccggctcgcacccgaaactgggaagcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 60 - DNA, 253 bp, Unknown
  Kingdom: Bacteria, Phylum: Firmicutes
tacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacagg

SEQ ID NO: 61 - DNA, 253 bp, Unknown
  Kingdom: Bacteria, Phylum: Firmicutes
tacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacagg

SEQ ID NO: 62 - DNA, 253 bp, Unknown
  Kingdom: Bacteria, Phylum: Firmicutes
tacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacagg

SEQ ID NO: 63 - DNA, 253 bp, Unknown
  Kingdom: Bacteria, Phylum: Firmicutes
tacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacagg

SEQ ID NO: 64 - DNA, 252 bp, Unknown
  Kingdom: Bacteria, Phylum: Firmicutes
tacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacagg

SEQ ID NO: 65 - DNA, 253 bp, Unknown
  Kingdom: Bacteria, Phylum: Firmicutes
tacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacagg

SEQ ID NO: 66 - DNA, 253 bp, Unknown
  Kingdom: Bacteria, Phylum: Firmicutes
tacgtaggtggcaagcgttgtccggaattattgggcgtaaagcgcgcgcaggcggtttcttaagtctgatgtgaaagcccccagctcaactggggagggtcattggaaactgggaaacttgagtacagaagaggagagtagaattccacgtgtagcggtgaaatgcgtagagatgtggaggaataccagtggcgaaggcggctctctggtctgtaactgacgctgaggcgcgaaagcgtggggagcaaacagg

SEQ ID NO: 67 - DNA, 253 bp, Unknown
  Kingdom: Bacteria, Phylum: Firmicutes
tacgtagggggcgagcgttgtccggaattattgggcgtaaagcgcgcgcaggcggtctcttaagtctgatgtgaaagcccacggctcaaccgtggagggtcattggaaactgggggacttgagggcaggagaggagagcggaattccacgtgtagcggtgaaatgcgtagagatgtggaggaacaccagtggcgaaggcggctctctggcctgcacctgacgctgaggcgcgaaagcgtggggagcaaacagg

SEQ ID NO: 68 - DNA, 253 bp, Unknown
  Kingdom: Bacteria, Phylum: Firmicutes
tacgtaggtggcaagcgttgtccggaattattgggcgtaaagcgcgcgcaggcggttccttaagtctgatgtgaaagcccacggctcaaccgtggagggtcattggaaactggggaacttgagtgcagaagaggagagcggaattccacgtgtagcggtgaaatgcgtagagatgtgggggaacaccagtggcgaaggcggctctctggtctgtaactgacgctgaggcgcgaaagcgtggggagcgaacagg

SEQ ID NO: 69 - DNA, 252 bp, Unknown
  Kingdom: Bacteria, Phylum: Firmicutes
tacgtagggggcaagcgttgtccggaattattgggcgtaaagcgcgcgcaggcggctttttaagtccggtgtcacagcccaaggctcaaccttgggtcgcactggaaactggagagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 70 - DNA, 252 bp, Unknown
  Kingdom: Bacteria, Phylum: Firmicutes
tacgtagggggcaagcgttgtccggaattattgggcgtaaagcgcgtgcaggcggcgggttaagtcggatgtttaagatcggggctcaaccccgattcgcatccgaaactggcccgcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 71 - DNA, 253 bp, Unknown
  Kingdom: Bacteria, Phylum: Firmicutes
tacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacagg

SEQ ID NO: 72 - DNA, 253 bp, Unknown
  Kingdom: Bacteria, Phylum: Firmicutes
tacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacagg

SEQ ID NO: 73 - DNA, 253 bp, Unknown
  Kingdom: Bacteria, Phylum: Proteobacteria
tacgtagggtgcaagcgttaatcggaattactgggcgtaaagcgtgcgcaggcggttttgtaagacagtggtgaaatccccgggctcaacctgggaactgccattgtgactgcaaggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 74 - DNA, 253 bp, Unknown
  Kingdom: Bacteria, Phylum: Proteobacteria
tacagagggtgcaagcgttaatcggaattactgggcgtaaagcgtgcgcaggcggttatataagacagatgtgaaatccccgggctcaacctgggaactgcatttgtgactgtatagctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 75 - DNA, 253 bp, Unknown
  Kingdom: Bacteria, Phylum: Proteobacteria
tacgtagggtgcaagcgttaatcggaattactgggcgtaaagcgtgcgcaggcggttttgtaagtctgttgtgaaatccccgggcttaacctgggaatggcaatggagactgcaaggctagagtttggcagaggggggtagaattccacgtgtagcagtgaaatgcgtagagatgtggaggaacaccgatggcgaaggcagccccctgggtcaagactgacgctcatgcacgagagcgtggggagcaaacagg

SEQ ID NO: 76 - DNA, 253 bp, Unknown
  Kingdom: Bacteria, Phylum: Proteobacteria
tacgtagggtgcaagcgttaatcggaattactgggcgtaaagcgtgcgcaggcggttttgtaagtctgacgtgaaatccccgggcttaacctgggaatggcgttggagactgcaaggctggaatctggcagaggggggtagaattccacgtgtagcagtgaaatgcgtagagatgtggaggaacaccgatggcgaaggcagccccctgggctaagattgacgctcatgcacgaaagcgtggggagcaaacagg

SEQ ID NO: 77 - DNA, 253 bp, Unknown
  Kingdom: Bacteria, Phylum: Proteobacteria
tacgtagggtgcaagcgttaatcggaattactgggcgtaaagcgtgcgcaggcggttcggaaagaaagatgtgaaatcccagggctcaaccttggaactgcatttttaactcccgaactagagtatgtcagaggggggtggaattccacgtgtagcagtgaaatgcgtagatatgtggaggaacaccgatggcgaaggcagccccctgggataatactgacgctcatgcacgaaagcgtggggagcaaacagg

SEQ ID NO: 78 - DNA, 253 bp, Unknown
  Kingdom: Bacteria, Phylum: Proteobacteria
tacgtagggtgcaagcgttaatcggaattactgggcgtagagcgtgcgcaggcggttttgtaagtctgatgtgaaatccccgggctcaacctgggaattgcattggagactgcaaggctagaatctggcagaggggggtagaattccacgtgtagcagtgaaatgcgtagatatgtggaggaacaccgatggcgaaggcagccccctgggtcaagattgacgctcatgcactaaagcgtggggagcaaacagg

SEQ ID NO: 79 - DNA, 253 bp, Unknown
  Kingdom: Bacteria, Phylum: Proteobacteria
tacgtagggtgcaagcgttaatcggaattactgggcgtaaagcgtgcgcaggcggttatgtaagacagttgtgaaatccccgggctcaacctgggaattgcatctgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 80 - DNA, 253 bp, Unknown
  Kingdom: Bacteria, Phylum: Proteobacteria
tacgtagggtgtgagcgttaatcggaattactgggcgtaaagcgtgcgcaggcggttatgtaagacagatgtgaaatccccgggctcaacctgggaactgcatttgtgactgcatggctagagtacggtagagggggatggaattccgcgtgtagcagtgaaatgcgtagatatgcggaggaacaccgatggcgaaggcaatcccctggacctgtactgacgctcatgcacgaaagcatggggagcgaacggg

SEQ ID NO: 81 - DNA, 253 bp, Unknown
  Kingdom: Bacteria, Phylum: Proteobacteria
tacgtagggtgcaagcgttaatcggaattactgggcgtaaagcgtgcgcaggcggttttgtaagtctgacgtgaaatccccgggctcaacctgggaattgcgttggagactgcaaggctagaatctggcaggggggggtagaattccacgtgtagcagtgaaatgcgtagagatgtggaggaacaccgatggcgaaggcagccccctgggtcaagactgacgctcaggtgcgaaagcgtggggagcaaacagg

SEQ ID NO: 82 - DNA, 253 bp, Unknown
  Kingdom: Bacteria, Phylum: Proteobacteria
tacgtagggtgcgagcgttaatcggaattactgggcgtaaagcgtgcgcaggcggttatgtaagacagaggtgaaatccccgggctcaacctgggaacggcctttgtgactgcatagctagagtacggtagagggggatggaattccgcgtgtagcagtgaaatgcgtagatatgcggaggaacaccgatggcgaaggcaatcccctggacctgtactgacgctcatgcacgagagcgtggggagcaaacagg

SEQ ID NO: 83 - DNA, 253 bp, Unknown
  Kingdom: Bacteria, Phylum: Proteobacteria
tacgtagggtgcaagcgttaatcggaattactgggcgtaaagcgtgcgcaggcggttttgtaagactgtcgtgaaatccccgggctcaacctgggaatggcgatggtgactgcaaggctagagtttggcagaggggggtagaattccacgtgtagcagtgaaatgcgtagatatgtggaggaacaccgatggcgaaggcagccccctgggtcaaaactgacgctcatgcacgaaagcgtggggagcaaacagg

SEQ ID NO: 84 - DNA, 253 bp, Unknown
  Kingdom: Bacteria, Phylum: Proteobacteria
tacgtagggtgcaagcgttaatcggaattactgggcgtaaagcgtgcgcaggcggtaatgtaagacagatgtgaaatccccgggctcaacctgggaactgcatttgtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 85 - DNA, 253 bp, Unknown
  Kingdom: Bacteria, Phylum: Proteobacteria
tacgtagggtccaagcgttaatcggaattactgggcgtaaagcgtgcgcaggtggttgtgcaagaccgatgtgaaatccccgggcttaacctgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacagg

SEQ ID NO: 86 - DNA, 253 bp, Unknown
  Kingdom: Bacteria, Phylum: Proteobacteria
tacgtagggtgcgagcgttaatcggaattactgggcgtaaagcgtgcgcaggcggctttgcaagacagaggtgaaatccccgggctcaacctgggaactgcctttgtgactgcaaggctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 87 - DNA, 253 bp, Unknown
  Kingdom: Bacteria, Phylum: Proteobacteria
tacgtagggtgcaagcgttaatcggaattactgggcgtaaagcgtgcgcaggcggttttgtaagtctgtcgtgaaagccccgggctcaacctgggaattgcgatggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 88 - DNA, 253 bp, Unknown
  Kingdom: Bacteria, Phylum: Proteobacteria
gacggggggggcaagtgttaatcggaattactgggcgtaaagcgtgcgcaggcggttttgtaagtctgacgtgaaatccccgggctcaacctgggaattgcgttggagactgcaaagctagaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 89 - DNA, 253 bp, Unknown
  Kingdom: Bacteria, Phylum: Firmicutes
tacgtaggtggcaagcgttgtccggatttactgggcgtaaagggagcgtaggtggatatttaagtgggatgtgaaatactcgggcttaacctgagtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacagg

SEQ ID NO: 90 - DNA, 253 bp, Unknown
  Kingdom: Bacteria, Phylum: Firmicutes
tacgtaggtggcaagcgttgtccggatttactgggcgtaaagggagcgtaggcggatacttaagtgggatgtgaaatacctgggcttaacttgggtgctgcattccaaactgggtgtctagagtgttggagaggaaagtggaattcctagtgtagcggtgaaatgcgtagagattaggaagaacaccagtggcgaaggcgactttctggacaataactgacgctgaggctcgaaagcgtggggagcaaacagg

SEQ ID NO: 91 - DNA, 253 bp, Unknown
  Kingdom: Bacteria, Phylum: Firmicutes
tacgtaggtggcaagcgttgtccggatttactgggcgtaaagggagcgtaggcggacttttaagtgggatgtgaaatacccgggcttaacctgggtgctgcattccaaactgggagtctagagtgcaggaggggaaagtggaattcctagtgtagcggtgaaatgcgtagagattaggaagaacaccagtggcgaaggcgactttctggactgtaactgacgctgaggctcgaaagcgtggggagcgaacagg

SEQ ID NO: 92 - DNA, 253 bp, Unknown
  Kingdom: Bacteria, Phylum: Firmicutes
tacgtagggggcgagcgttgtccggaattactgggcgtaaagagcacgtaggcggctataaaagtcagatgtgaaaaacctgggctcaaccgagggtatgcatctgaaactaaatagcttgagtcaaggagaggagagcggaattcctggtgtagcggtgaaatgcgtagagatcaggaagaataccagtggcgaaagcggctctctggacttgaactgacgctgaggtgcgaaagcgtggggagcaaacagg

SEQ ID NO: 93 - DNA, 253 bp, Unknown
  Kingdom: Bacteria, Phylum: Firmicutes
tacgtaggtggcgagcgttgtccggaattactgggcgtaaagggtgcgtaggcggcctggtaagttgagcgtgaaatttttgggctcaacccaaaaggagcgctcaatactgccgggcttgagtgcgggagaggacggcggaattcccggtgtagcggtgaaatgcgtagatatcgggaggaacaccagtggcgaaggcggccgtctggaccgtaactgacgctgaggcacgaaagcgtggggagcaaacagg

SEQ ID NO: 94 - DNA, 253 bp, Unknown
  Kingdom: Bacteria, Phylum: Firmicutes
aacgtagggggcgagcgttatccggaattactgggcgtaaagcgcgtgtaggcgggctgttaagtcggttgtgaaaatccggggctcaactccggacatgcagccgatactgacagtcttgagggcaggagagggaagcggaattcccggtgtagcggtgaaatgcgtagatatcgggaggaacaccagtggcgaaggcggctttctggactgtacctgacgctgagacgcgaaagcgtggggagcaaacagg

SEQ ID NO: 95 - DNA, 253 bp, Unknown
  Kingdom: Bacteria, Phylum: Bacteroidetes
tacggagggtgcgagcgttgtccggatttattgggtttaaagggtgcgtaggcggccttataagtccggggtgaaagcccgttgctcaacaacggaactgccctggatactgtgaggcttgagtacagacgaggttggcggaatggactgagtagcggtgaaatgcatagatacagtccagaaccccgattgcgaaggcagctgactaggctgttactgacgctgaggcacgacagcgtggggagcgaacagg

SEQ ID NO: 96 - DNA, 253 bp, Unknown
  Kingdom: Bacteria, Phylum: Bacteroidetes
tacggagggtgcgagcgttgtccggatttattgggtttaaagggtgcgtaggcggcccgttaagtccggggtgaaagcctactgctcaacagcggaactgccctggatactgacgggcttgagtacagacgaggttggcggaatggactgagtggcggtgaaatgcatagatacagtccagaaccccgattgcgaaggcagctgactaggctgttactgacgctgaggcacgaaagcgtggggagcgaacagg

SEQ ID NO: 97 - DNA, 253 bp, Unknown
  Kingdom: Bacteria, Phylum: Bacteroidetes
tacggagggtgcgagcgttgtccggatttattgggtttaaagggtgcgtaggcggcctgacaagtctggggtgaaagcccgttgcttaacaacggaactgccctggatactatcaggcttgagtacagacgaggttggcggaatggaccgagtagcggtgaaatgcatagatacggtccagaaccccgattgcgaaggcagctgactaggctgttactgacgctgaggcacgacagcgtggggagcgaacagg

SEQ ID NO: 98 - DNA, 253 bp, Unknown
  Kingdom: Bacteria, Phylum: Bacteroidetes
tacggagggtgcgagcgttgtccggatttattgggtttaaagggtgcgtaggcggcccgttaagtccggggtgaaagcccgttgctcaacaacggaactgccctggatactgacgggcttgagtacagacgaggttggcggaatggaccgagtagcggtgaaatgcatagatacggtccagaaccccgattgcgaaggcagctgactaggctgttactgacgctgaggcacgacagcgtggggagcgaacagg

SEQ ID NO: 99 - DNA, 253 bp, Unknown
  Kingdom: Bacteria, Phylum: Bacteroidetes
tacggagggtgcgagcgttgtccggatttattgggtttaaagggtgcgtaggcggctttttaagtctggggtgaaagcccgctgctcaacagcggaactgccctggatactggagagcttgagtacagacgaggttggcggaatggacggagtagcggtgaaatgcatagataccgtccagaacaccgattgcgaaggcagctgactaggctgttactgacgctgaggcacgaaagcgtggggagcgaacagg

SEQ ID NO: 100 - DNA, 253 bp, Unknown
  Kingdom: Bacteria, Phylum: Bacteroidetes
tacggagggtgcgagcgttgtccggatttattgggtttaaagggtgcgtaggcggccgtttaagtccggggtgaaagcccgctgctcaacagcggaactgccctggatactggatggcttgagtacagacgaggttggcggaatggactgagtagcggtgaaatgcatagatacagtccagaaccccgattgcgaaggcagctgactaggctgttactgacgctgaggcacgaaagcgtggggagcgaacagg

SEQ ID NO: 101 - DNA, 254 bp, Unknown
  Kingdom: Bacteria, Phylum: Proteobacteria
gacagagggtgcaagcgttgttcggaattattgggcgtaaagggcgcgtaggcggcccatcaagtcggatgtgaaagcccagggctcaaccttggaagtgcatccgaaactgatgagctagagttcacggagagggtggtggaattcccagtgtagaggtgaaattcgtagatattgggaggaacaccggtggcgaaggcgaccacctggacggaaactgacgctgaggcgcgaaagcgtgggtagcaaacagg

SEQ ID NO: 102 - DNA, 253 bp, Unknown
  Kingdom: Bacteria, Phylum: Bacteroidetes
tacggagggtgcaagcgttatccggatttattgggtttaaagggtccgtaggcggatctgtaagtcagtggtgaaatctttcggcttaaccggaaaactgccattgatactgcaggtcttgagtaaggtagaagtggctggaataagtagtgtagcggtgaaatgcatagatattacttagaacaccaattgcgaaggcaggtcactatgtcttaactgacgctgatggacgaaagcgtggggagcgaacagg

SEQ ID NO: 103 - DNA, 253 bp, Unknown
  Kingdom: Bacteria, Phylum: Bacteroidetes
tacggagggtgcaagcgttatccggatttattgggtttaaagggtccgtaggcggactcgtaagtcagtggtgaaatctcacagctcaactgtgaaactgccattgatactgcgggtcttgagtaaggtagaagtggctggaataagtagtgtagcggtgaaatgcatagatattacttagaacaccaattgcgaaggcaggtcactatgtcttaactgacgctgatggacgaaagcgtggggagcgaacagg

SEQ ID NO: 104 - DNA, 253 bp, Unknown
  Kingdom: Bacteria, Phylum: Bacteroidetes
tacggagggtgcaagcgttatccggatttattgggtttaaagggtccgtaggcggactcgtaagtcagtggtgaaatctcatagcttaactatgaaactgccattgatactgcgggtcttgagtaaggtagaggtagctggaataagtagtgtagcggtgaaatgcatagatattacttagaacaccaattgcgaaggcaggttaccatgtcttaactgacgctgatggacgagagcgtggggagcgaacagg

SEQ ID NO: 105 - DNA, 253 bp, Unknown
  Kingdom: Bacteria, Phylum: Bacteroidetes
tacggagggtgcaagcgttatccggatttattgggtttaaagggtccgtaggcggatctgtaagtcagtggtgaaatctcatagcttaactatgaaactgccattgatactgcaggtcttgagtaaagtagaagtggctggaataagtagtgtagcggtgaaatgcatagatattacttagaacaccaattgcgaaggcaggtcactatgttttaactgacgctgatggacgaaagcgtggggagcgaacagg

SEQ ID NO: 106 - DNA, 253 bp, Unknown
  Kingdom: Bacteria, Phylum: Bacteroidetes
tacggagggtgcaagcgttatccggatttattgggtttaaagggtccgtaggcggatctgtaagtcagtggtgaaatctcatagcttaactatgaaactgccattgatactgcaggtcttgagtgagattgaggtagctggaataagtagtgtagcggtgaaatgcatagatattacttagaacaccaattgcgaaggcaggttaccaagtcttaactgacgctgatggacgaaagcgtggggagcgaacagg

SEQ ID NO: 107 - DNA, 253 bp, Unknown
  Kingdom: Bacteria, Phylum: Proteobacteria
tacagagggtgcaagcgttaatcggaattactgggcgtaaagcgcacgcaggcggtctgtcaagtcggatgtgaaatccccgggctcaacccgggaactgcattcgaaactggcagactcgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 108 - DNA, 253 bp, Unknown
  Kingdom: Bacteria, Phylum: Proteobacteria
tacggagggtgcaagcgttaatcggaattactgggcgtaaagcgcacgcaggcggtttgttaagtcagatgtgaaatcctcgagcttaacttgggaactgcatttgaaactggcaagctagagtcttgtagaggggggtagaattccaggtgtagcggtgaaatgcgtagagatctggagggatactggtggcgaaggcggccccctggacaaagactgacgctcaggtgcgaaagcgtggggagcaaacagg

SEQ ID NO: 109 - DNA, 253 bp, Unknown
  Kingdom: Bacteria, Phylum: Proteobacteria
tacgtaggtggcaagcgttatccggaattactgggcgtaaagcgcacgcaggcggtctgtcaagtcggatgtgaaatccccgggctcaacctgggaactgcattcgaaactgacaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 110 - DNA, 253 bp, Unknown
  Kingdom: Bacteria, Phylum: Proteobacteria
tacagagggtgcaagcgttaatcggaattactgggcgtaaagcgcgcgtaggtggtttgttaagtcggatgtgaaatccccgggctcaacctgggaactgcatccgaaactggcaagctagagtatggtagagggtagtggaatttcctgtgtagcggtgaaatgcgtagatataggaaggaacaccagtggcgaaggcgactacctggactgatactgacactgaggtgcgagagcgtggggagcaaacagg

SEQ ID NO: 111 - DNA, 253 bp, Unknown
  Kingdom: Bacteria, Phylum: Proteobacteria
tacgaagggtgcgagcgttaatcggaattactgggcgtaaagcgcgcgtaggtggtttgttaagttggaagtgaaagccccgggctcaacctgggaattgctttcaaaactgacgggctagagtacggtagagggtagtggaatttcctgtgtagcggtgaaatgcgtagatataggaaggaacatcagtggcgaaggcgactacctggactgatactgacactgaggtgcgaaagcgtggggagcaaacagg

SEQ ID NO: 112 - DNA, 253 bp, Unknown
  Kingdom: Bacteria, Phylum: Proteobacteria
tacagagggtgcaagcgttaatcggatttactgggcgtaaagcgcgcgtaggtggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacactgaggtgcgaaagcatggggagcaaacagg

SEQ ID NO: 113 - DNA, 253 bp, Unknown
  Kingdom: Bacteria, Phylum: Proteobacteria
tacagagggtgcaagcgttactcggaattactgggcgtaaagcgtgcgtaggtggttgtttaagtctgttgtgaaagccctgggctcaacctgggaattgcagtggatactgggcgactagagtgtggtagagggtagtggaattcccggtgtagcagtgaaatgcgtagagatcgggaggaacatccatggcgaaggcagctacctggaccaacactgacactgaggtgcgaaagcgtggggagcaaacagg

SEQ ID NO: 114 - DNA, 253 bp, Unknown
  Kingdom: Bacteria, Phylum: Proteobacteria
tacggagggtgcaaacgttaatcggaattactgggcgtaaagcgcacgcaggcggtctgtcaagtcggatgtgaaatccccgggctcaacctgggaactgcatttgaaactggcaggctagagtcttgtagaggggggtagaattccaggtgtagcggtgtaatgcgtagagatctggaggaataccggtggcgaaggcggccccctgggcaaagactgacgctcaggtgcgagagcgtggggagcaaacagg

SEQ ID NO: 115 - DNA, 253 bp, Unknown
  Kingdom: Bacteria, Phylum: Proteobacteria
aacggggggggcaagtgttcttcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 116 - DNA, 253 bp, Unknown
  Kingdom: Bacteria, Phylum: Proteobacteria
tacggagggtgcaagcgttaatcggaattactgggcgtaaagcgcacgcaggcggtctgtcaagtcggatgtgaaatccccgggcttaacctgggaactgcattcgaaactggcaggctggagtcttgtagaagggggtagaattccaggtgtagcggtgaaatgcgtagagacctggaggaataccggtggcgaaggcagccctctggacaaagactgacgctcaggtgcgaaagcgtggggagcaaacagg

SEQ ID NO: 117 - DNA, 253 bp, Unknown
  Kingdom: Bacteria, Phylum: Proteobacteria
tacgaagggtgcaagcgttactcggaattactgggcgtaaagcgtgcgtaggtggttgtttaagtctgttgtgaaagccctgggctcaacctgggaactgcagtggaaactggatgactagagtgtggtagagggtagcggaattcccggtgtagcagtgaaatgcgtagagatcgggaggaacatccatggcgaaggcagctacctggaccaacactgacactgaggcacgagagcgtggggagcaaacagg

SEQ ID NO: 118 - DNA, 253 bp, Unknown
  Kingdom: Bacteria, Phylum: Proteobacteria
tacagagggtgcaagcgttaatcggaattactgggcgtaaagcgcgcgtaggtggttagttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgagagcgtggggagcaaacagg

SEQ ID NO: 119 - DNA, 253 bp, Unknown
  Kingdom: Bacteria, Phylum: Proteobacteria
tacgtagggtgcaagcgttaatcggaattactgggcgtaaagcgcgcgtaggcggttcgtcaagtcggatgtgaaatccccgggctcaacctggggactgcatccgaaactggcaagctagagtatggtagagggtggtggaatttcctgtgtagcggtgaaatgcgtagatataggaaggaacatcagtggcgaaggcgaccacctggaccaatactgacgctgaggtgcgaaagcgtggggagcaaacagg

SEQ ID NO: 120 - DNA, 253 bp, Unknown
  Kingdom: Bacteria, Phylum: Proteobacteria
tacagagggtgcaagcgttaatcggaattactgggcgtaaagcgcgcgtaggcggtttgttaagttgaatgtgaaatccccgggctcaacctgggaactgcatccaaaactggcaagctagagtatggtagagggtggtggaatttcctgtgtagcggtgaaatgcgtagatataggaaggaacatcagtggcgaaggcgaccacctggaccaatactgacgctgaggtgcgaaagcgtggggagcaaacagg

SEQ ID NO: 121 - DNA, 253 bp, Unknown
  Kingdom: Bacteria, Phylum: Proteobacteria
tacgaagggtgcaagcgttactcggaattactgggcgtaaagcgtgcgtaggtggtcgtttaagtccgttgtgaaagccctgggctcaacctgggaactgcagtggatactgggcgactagagtgtggtagagggtagcggaattcctggtgtagcagtgaaatgcgtagagatcaggaggaacatccatggcgaaggcagctacctggaccaacactgacactgaggcacgaaagcgtggggagcaaacagg

SEQ ID NO: 122 - DNA, 247 bp, Unknown
  Kingdom: Bacteria, Phylum: Proteobacteria
tacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgaggtgcgaaagcgtggggagcaaacagg

SEQ ID NO: 123 - DNA, 253 bp, Unknown
  Kingdom: Bacteria, Phylum: Proteobacteria
gacggggggtgcaagcgttaatcggaattactgggcgtaaagcgcgcgtaggtggtttgttaagttggatgtgaaatccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 124 - DNA, 253 bp, Unknown
  Kingdom: Bacteria, Phylum: Proteobacteria
tacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacagg

SEQ ID NO: 125 - DNA, 253 bp, Unknown
  Kingdom: Bacteria, Phylum: Proteobacteria
tacggagggtgcaagcgttaatcggaattactgggcgtaaagcgcacgcaggcggtctgtcaagtcggatgtgaaatcctcgggctcaacctgagaactgcattcgaaactggcaggcttgagtcttgtagaggggggcagaattccaggtgtagcggtgagatgcgtagagatctggaggaataccggtggcgaaggcggccccctggacaaagactgacgctcaggtgcgaaagcgtggggagcaaacagg

SEQ ID NO: 126 - DNA, 252 bp, Unknown
  Kingdom: Bacteria, Phylum: Proteobacteria
tacggagggtgcaagcgttaatcggaattactgggcgtaaagcgcacgcaggcgtttgttaagtcagatgtgaagcccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgagagcgtggggagcaaacagg

SEQ ID NO: 127 - DNA, 253 bp, Unknown
  Kingdom: Bacteria, Phylum: Proteobacteria
tacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaacgcgtagatataggtaggaacaccggtggcgaaggcgaccacctggactgatactgacactgaggtgcgaaagcgtggggagcaaacagg

SEQ ID NO: 128 - DNA, 253 bp, Unknown
  Kingdom: Bacteria, Phylum: Proteobacteria
tacagagggtgcaagcgttaatcggaattactgggcgtaaagcgcgcgtaggtggtttgttaagttggatgtgaaagccccgggctcaacctgggaactgcatccaaaactggcaggctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 129 - DNA, 253 bp, Unknown
  Kingdom: Bacteria, Phylum: Proteobacteria
tacgaagggtgcaagcgttactcggaattactgggcgtaaagcgtgcgtaggtggtggtttaagtctgttgtgaaagccctgggctcaacctgggaattgcagtggatactgggtcactagagtgtggtagagggtagcggaattcccggtgtagcagtgaaatgcgtagagatcgggaggaacatccgtggcgaaggcggctacctggaccaacactgacactgaggcacgaaagcgtggggagcaaacagg

SEQ ID NO: 130 - DNA, 253 bp, Unknown
  Kingdom: Bacteria, Phylum: Proteobacteria
tacggagggtgcgagcgttaatcggaattactgggcgtaaagcgcgcgtaggtggcttgataagccggttgtgaaagccccgggctcaacctgggaacggcatccggaactgtcaagctagagtgcaggagaggaaggtagaattcccggtgtagcggtgaaatgcgtagagatcgggaggaataccagtggcgaaggcggccttctggactgacactgacactgaggtgcgaaagcgtgggtagcaaacagg

SEQ ID NO: 131 - DNA, 253 bp, Unknown
  Kingdom: Bacteria, Phylum: Proteobacteria
tacagagggtgcaagcgttaatcggaattactgggcgtaaagcgcgcgtaggtggtttgttaagttgaatgtgaaatccccgggctcaacctgggaactgcatccaaaactggcaagctagagtagggcagagggtggtggaatttcctgtgtagcggtgaaatgcgtagatataggaaggaacaccagtggcgaaggcgaccacctgggctcatactgacactgaggtgcgagagcgtggggagcaaacagg

SEQ ID NO: 132 - DNA, 253 bp, Unknown
  Kingdom: Bacteria, Phylum: Proteobacteria
tacgaagggtgcaagcgttaatcggaattactgggcgtaaagcgcgcgtaggtggcttgataagttggatgtgaaatccccgggctcaacctgggaactgcatccaaaactgtctggctagagtgtggtagagggtagtggaatttccagtgtagcggtgaaatgcgtagatattggaaggaacaccagtggcgaaggcgactacctggactaacactgacactgaggtgcgaaagcgtggggagcaaacagg

SEQ ID NO: 133 - DNA, 253 bp, Unknown
  Kingdom: Bacteria, Phylum: Proteobacteria
tacggagggtgcaagcattaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 134 - DNA, 253 bp, Unknown
  Kingdom: Bacteria, Phylum: Proteobacteria
tacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgagagcgtggggagcaaacagg

SEQ ID NO: 135 - DNA, 253 bp, Unknown
  Kingdom: Bacteria, Phylum: Proteobacteria
tacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 136 - DNA, 254 bp, Unknown
  Kingdom: Bacteria, Phylum: Tenericutes
aacataggtggcgaacgttatctggaatttttgggtgtaaaggatgcataggtggtgtaataagttattggcgataaattcggtgcttaacctcgtggaggtaatactgtatatagttgagttctggagaggttaacggaactctatatagagcggtaaaatgtgactatatataaaagaacatcaataaagcggaagacagttaactattctgctactgacattgaggcatgaaagcgtgggaagcaaaacgg

SEQ ID NO: 137 - DNA, 253 bp, Unknown
  Kingdom: Bacteria, Phylum: Bacteroidetes
tacggaggatccaagcgttatccggatttattgggtttaaagggtgcgtaggcggctttttaagtcaggggtgaaaacttgcggctcaaccgtaagcttgcctttgatactgaggagcttgaatacacttgaggtaggcggaatgtgacaagtagcggtgaaatgcatagatatgtcacagaacaccaattgcgaaggcagcttactaaagtgagattgacgctgaggcacgaaagcgtggggatcaaacagg

SEQ ID NO: 138 - DNA, 253 bp, Unknown
  Kingdom: Bacteria, Phylum: Bacteroidetes
tacggaggatccaagcgttatccggatttattgggtttaaagggtgcgtaggcggcttattaagtcaggggtgaaagacggtggctcaaccatcgcagtgcctttgatactgatgagcttgaatgaactagaggtaggcggaatgtgacaagtagcggtgaaatgcatagatatgtcacagaacaccgattgcgaaggcagcttactatggttttattgacgctgaggcacgaaagcgtggggatcaaacagg

SEQ ID NO: 139 - DNA, 253 bp, Unknown
  Kingdom: Bacteria, Phylum: Bacteroidetes
tacggaggatccaagcgttatccggatttattgggtttaaagggtgcgtaggtggcctattaagtcaggggtgaaagacggtagcttaactatcgcagtgcctttgatactgatgggcttgaatacagttgaagtaggcggaatgtgacaagtagcggtgaaatgcatagatatgtcacagaacaccgattgcgaaggcagcttactaaagtgtgattgacactgaggcacgaaagcgtggggatcaaacagg

SEQ ID NO: 140 - DNA, 253 bp, Unknown
  Kingdom: Bacteria, Phylum: Bacteroidetes
tacggaggatccaagcgttatccggatttattgggtttaaagggtgcgtaggcggcccgttaagtcaggggtgaaagacggtagctcaactatcgcagtgcccttgatactgacgggcttgaatggactagaggtaggcggaatgtgacaagtagcggtgaaatgcatagatatgtcacagaacaccgattgcgaaggcagcttactatggttttattgacgctgaggcacgaaagcgtggggatcaaacagg

SEQ ID NO: 141 - DNA, 253 bp, Unknown
  Kingdom: Bacteria, Phylum: Bacteroidetes
tacggaggatccaagcgttatccggatttattgggcttaaagggtgcgtaggcggcctgttaagtcaggggtgaaagacggtggctcaaccatcgcagtgcccttgatactgacgggcttgaatggactagaggtaggcggaatgagacaagtagcggtgaaatgcatagatatgtctcagaacaccgattgcgaaggcagcttactatggtcttactgacgctgaggcacgaaagcgtggggatcaaacagg

SEQ ID NO: 142 - DNA, 253 bp, Unknown
  Kingdom: Bacteria, Phylum: Bacteroidetes
tacggaggatccaagcgttatccggatttattgggtttaaagggtgcgtaggcggctttttaagtcaggggtgaaagacggtagctcaactatcgcagtgcccttgatactgaagagcttgaatggactagaggtaggcagaatgtgacaagtagcggtgaaatgcatagatatgtcacagaacaccgattgcgaaggcagcttactagggtttaattgacgctgaggcacgaaagcgtggggatcaaacagg

SEQ ID NO: 143 - DNA, 253 bp, Unknown
  Kingdom: Bacteria, Phylum: Bacteroidetes
tacggaggatccaagcgttatccggatttattgggtttaaagggtgcgtaggcggcctgttaagtcaggggtgaaagacggtagctcaactatcgcagtgcctttgatactgatgggcttgaatgaactagaggtaggcggaatgagacaagtagcggtgaaatgcatagatatgtctcagaacaccgattgcgaaggcagcttactagggtttaattgacgctgaggcacgaaagcgtggggatcaaacagg

SEQ ID NO: 144 - DNA, 254 bp, Unknown
  Kingdom: Bacteria, Phylum: Cyanobacteria
gacagaggatgcaagcgttatccggaatgattgggcataaaacgtctgtaagtgactttttaagtccgccattaaatcccagggcttaaccctggacacgcagtggaaactaccaagctagagtacggtaggggcagagggaatttctagttttagcggtgaagtgcgtagagatcgagaagaacaccaatggcaaaagcactctgttgggccgaccgtgacactgagagacgaaagctaggggaacaaatggg

SEQ ID NO: 145 - DNA, 151 bp, Unknown
  Kingdom: Fungi, Phylum: Basidiomycota
gtaggtgaacctgcggaaggatcattaatgaacttgtggttgttgctggctagtgtctctagcatgtgcacacgcaccttcatcccatttacacctgtgcaccttttgtagtagagttctgaaagggggggtttaccttctctgatttact

SEQ ID NO: 146 - DNA, 151 bp, Unknown
  Kingdom: Fungi, Phylum: Basidiomycota
gtaggtgaacctgcggaaggatcattattgaattttaatgaagagttcggttgtagctggcccattcatttgggcatgtgcacacctttctctttcatcccacacacacctgtgaacctgtgagacagatggggaatttacttgttgcttt

SEQ ID NO: 147 - DNA, 151 bp, Unknown
  Kingdom: Fungi, Phylum: Ascomycota
gtaggtgaacctgcggagggatcattacacaaatatgaaggcgggctggaacctctcggggttacagccttgctgaattattcacccttgtcttttgcgtacttcttgtttccttggtgggttcgcccaccactaggacaaacataaacct

SEQ ID NO: 148 - DNA, 151 bp, Unknown
  Kingdom: Fungi, Phylum: Ascomycota
gtaggtgaacctgcggagggatcattacaagtgaccccggtctaaccaccgggatgttcataaccctttgttgtccgactctgttgcctccggggcgaccctgccttcgggcgggggctccgggtggacacttcaaactcttgcgtaactt

SEQ ID NO: 149 - DNA, 151 bp, Unknown
  Kingdom: Fungi, Phylum: Ascomycota
gtaggtgaacctgcggagggatcattacaagaacgcccgggcttcggcctggttattcataaccctttgttgtccgactctgttgcctccggggcgaccctgccttcgggcgggggctccgggtggacacttcaaactcttgcgtaacttt

SEQ ID NO: 150 - DNA, 151 bp, Unknown
  Kingdom: Fungi, Phylum: Ascomycota
gtaggtgaacctgcggagggatcattacacaataacaaggcgggctggacacccccagccgggcactgcttcacggcgtgcgcggctgggccggccctgctgaattattcacccgtgtcttttgcgtacttcttgtttcctgggtgggctc

SEQ ID NO: 151 - DNA, 151 bp, Unknown
  Kingdom: Fungi, Phylum: Ascomycota
gtaggtgaacctgcggaaggatcattacctagagtttgtagacttcggtctgctacctcttacccatgtcttttgagtaccttcgtttcctcggcgggtccgcccgccgattggacaacattcaaaccctttgcagttgcaatcagcgtct

SEQ ID NO: 152 - DNA, 151 bp, Unknown
  Kingdom: Fungi, Phylum: Ascomycota
gtaggtgaacctgcggagggatcattacacaatatgaaagcgggctggcatccttcggggttacagccttgctgaattattcacccgtgtcttttgcgtacttcttgtttccttggtgggttcgcccaccataggacaaaccataaacctt

SEQ ID NO: 153 - DNA, 151 bp, Unknown
  Kingdom: Fungi, Phylum: Ascomycota
gtaggtgaacctgcggagggatcattacaagtgacccccggctccggccggggatgttcataaccctttgttgtccgactctgttgcctccggggcgaccctgccttttcacgggcgggggccccgggtggacacatcaaaactcttgcgt

SEQ ID NO: 154 - DNA, 151 bp, Unknown
  Kingdom: Fungi, Phylum: Ascomycota
gtaggtgaacctgcggaaggatcattacctagagttgtaggctttgcctgctatctcttacccatgtcttttgagtaccttacgtttcctcggtgggttcgcccaccgattggacaaacttaaaccctttgcagttgaaatcagcgtctga

SEQ ID NO: 155 - DNA, 151 bp, Unknown
  Kingdom: Fungi, Phylum: Ascomycota
gtaggtgaacctgcggagggatcattatatgacgccccaggcttgtacagctgggaacgcacaaccctttgttttccgactctgttgcctccggggcgaccctgccttcgggcgggggctccgggtggacacttcaaactcttgcgtaact

SEQ ID NO: 156 - DNA, 151 bp, Unknown
  Kingdom: Fungi, Phylum: Ascomycota
gtaggtgaacctgcggaaggatcattacattcagtagcttgctactgttagggaggccggttagtctgtatagtatcactactgatgagcagcacggccttctgtctgtacccttgtcttttgcgcactcatgtttcctcggctgggttta

SEQ ID NO: 157 - DNA, 151 bp, Unknown
  Kingdom: Fungi, Phylum: Ascomycota
gtaggtgaacctgcggaaggatcattaaatgaaaagctggtttaccagtatacggcccctgggtttgtttctgacaagcgccaggatcagtcgtcatttatacccatgttttttgcgtactacttgtttccttggtaggcttgcctaccat

SEQ ID NO: 158 - DNA, 151 bp, Unknown
  Kingdom: Fungi, Phylum: Ascomycota
gtaggtgaacctgcggaaggatcattacaattcagtagcttgctactgtcgggaggcgctgtaagtccgcatagtttaattactgatgagcggcaggccctctgtctgtacccttgtcttttgcgcactcatgtttcctcggcgggcttgc

SEQ ID NO: 159 - DNA, 151 bp, Unknown
  Kingdom: Fungi, Phylum: Ascomycota
gtaggtgaacctgcggaaggatcattacatttagtagcttgctactgctaagagggtctgttaggctgtatagtattgctactgacgagcagcatgatcctctgagtcaacccttgtcttttgtgtacctacgtttcctcagcgggcacaa

SEQ ID NO: 160 - DNA, 151 bp, Unknown
  Kingdom: Fungi, Phylum: Ascomycota
gtaggtgaacctgcggagggatcattacacaatatgaaagcgggttgggacctcacctcggtgagggctccagcttgtctgaattattcacccatgtcttttgcgcacttcttgtttcctgggcgggttcgcccgccaccaggaccaaacc

SEQ ID NO: 161 - DNA, 151 bp, Unknown
  Kingdom: Fungi, Phylum: Ascomycota
gtaggtgaacctgcggagggatcattaccgagtgagggcctccgggtccgacctccaaccctttgtgaacacatcccgttgcttcgggggcgaccctgccgggcgcccccggaggaccacacaacactgcatctttgcgtcggagtttacg

SEQ ID NO: 162 - DNA, 151 bp, Unknown
  Kingdom: Fungi, Phylum: Ascomycota
gtaggtgaacctgcggaaggatcattaacctttcaaatcagggtgcggcgcggcccccgaggagcggaaacaatccttgggaggtatgcgggggcttcgagccccccatttacgcacgcacgactgccatccttactttacgagcaccttc

SEQ ID NO: 163 - DNA, 151 bp, Unknown
  Kingdom: Fungi, Phylum: Ascomycota
gtaggtgaacctgcggaaggatcattacctagagttgcgggctttgcctgccatctcttacccatgtcttttgagtaccttcgtttcctcggtgggttcgcccgccgattggacaaaacttaaaccctttgtaattgaaatcagcgtctga

SEQ ID NO: 164 - DNA, 151 bp, Unknown
  Kingdom: Fungi, Phylum: Ascomycota
gtaggtgaacctgcggaaggatcattaaagagtaagggtgctcagcgcccgacctccaaccctttgttgttaaaactaccttgttgctttggcgggaccgctcggtctcgagccgctggggattcgtcccaggcgagcgcccgccagagtt

SEQ ID NO: 165 - DNA, 151 bp, Unknown
  Kingdom: Fungi, Phylum: Ascomycota
gtaggtgaacctgcggaaggatcattaaattcagtagcttgctactgttagggggggtctattagtctgtatagtatcactactgatgagcagcacgaccctctgtctatacccttgtcttttgcgcactcatgtttcctcggcggcttga

SEQ ID NO: 166 - DNA, 151 bp, Unknown
  Kingdom: Fungi, Phylum: Ascomycota
gtaggtgaacctgcggaaggatcattatcttgagttgcgggctttgcctgccatctcttacccatgtcttttgagtacttacgtttccttggcgggtccgcccgccaaagacaaaaaatcaaaacctttgcagttgcaatcagcgtctgaa

SEQ ID NO: 167 - DNA, 151 bp, Unknown
  Kingdom: Fungi, Phylum: Ascomycota
gtaggtgaacctgcggagggatcattacaagtgaccccggctacggccgggatgttcataaccctttgttgtccgactctgttgcctccggggcgaccctgccttcgggcgggggctccgggtggacacttcaaactcttgcgtaactttg

SEQ ID NO: 168 - DNA, 151 bp, Unknown
  Kingdom: Fungi, Phylum: Ascomycota
gtaggtgaacctgcggaaggatcattacactcagtagtttactactgtaaaggaggctgttagtctgtatagcgcaagctgatgagcagctagcctcttttatccacccttgtcttttgcgtacccacgtttcctcggcaggcttgcctgc

SEQ ID NO: 169 - DNA, 151 bp, Unknown
  Kingdom: Fungi, Phylum: Ascomycota
gtaggtgaacctgcggagggatcattacacaatatgaaagcgggctggactcacctcagcagcatctgctgttggggccagccttgctgaattattcacccgtgtcttttgcgtacttcttgtttccttggtgggctcgcccaccacaagg

SEQ ID NO: 170 - DNA, 151 bp, Unknown
  Kingdom: Fungi, Phylum: Ascomycota
gtaggtgaacctgcggaaggattattaaattcagtcgcttgctactgttaggggggtctattagtctgtatagtatcactactggtgagcagcacgaccctctgtctatacccttgtcttttgcgcactcatgtttcctcggcggctttat

SEQ ID NO: 171 - DNA, 151 bp, Unknown
  Kingdom: Fungi, Phylum: Ascomycota
gtaggtgaacctgcggaaggatcattacatatagtagcttgctactgctaagagggtctgttaggctgtatagtattgctactgacgagcagcatgatcctctgagtcaacccttgtcttttgcgtacctacgtttcctcagtgggtataa

SEQ ID NO: 172 - DNA, 151 bp, Unknown
  Kingdom: Fungi, Phylum: Ascomycota
gtaggtgaacctgcggaaggatcattacaaatcagtagcttgctactgcgctgggggagacgggaaagtcctggctgaaaagtcggtgtaccggtacctacacccctatcatacccttgtcttttgagtacttatgtttccttggtaggct

SEQ ID NO: 173 - DNA, 151 bp, Unknown
  Kingdom: Fungi, Phylum: Ascomycota
gtaggtgaacctgcggaaggatcattacctagagttgtaggctttgcctgctatctcttacccatgtcttttgagtaccttcgtttcctcggcgggtccgcccgccgattggacaatttaaaccctttgcagttgcaatcagcgtctgaaa

SEQ ID NO: 174 - DNA, 151 bp, Unknown
  Kingdom: Fungi, Phylum: Ascomycota
gtaggtgaacctgcggaaggatcattaccaagagtttgtggacttcggtctgctacctcttacccatgtcttttgagtaccttcgtttcctcggcgggtccgcccgccggttggacaccattcaaaccctttgcagttacaatcagcgtct

SEQ ID NO: 175 - DNA, 151 bp, Unknown
  Kingdom: Fungi, Phylum: Ascomycota
gtaggtgaacctgcggagggatcattacacgacagcaaggcgggctggacaccccccgctgggcactgcttcacggcgtgcgcggcggggccggccctgctgaattattcacccgtgtcttttgcgtacttcttgtttcctgggtgggctc

SEQ ID NO: 176 - DNA, 151 bp, Unknown
  Kingdom: Fungi, Phylum: Ascomycota
gtaggtgaacctgcggaaggatcattacactcagtcgtttactactgtcaaaggggctgttagtctgtatagcgcaagctgatgagcagctggcctcttttatccacccttgtcttttgcgtacccacgtttcctcggcaggcttgcctgc

SEQ ID NO: 177 - DNA, 151 bp, Unknown
  Kingdom: Fungi, Phylum: Ascomycota
gtaggtgaacctgcggagggatcattataagttcacccaggcttgtacagctggggactgacaaccctttgatttccgactctgttgcctccggggcgaccctgccttcgggcgggggctccgggtggacacttcaaactcttgcgtaact

SEQ ID NO: 178 - DNA, 151 bp, Unknown
  Kingdom: Fungi, Phylum: Ascomycota
gtaggtgaacctgcggaaggatcattaattatcggtagtttactaccgtttgaagggggtggaaagtttccaggtcttcctgggggtgagtacatcctattcttaacccttgactttttgcgcactcatgtttcctcggcgggcttgcctg

SEQ ID NO: 179 - DNA, 151 bp, Unknown
  Kingdom: Fungi, Phylum: Ascomycota
gtaggtgaacctgcggaaggatcattacctttcagtatggagtttatagtccgctatagctcctgtctgtatccatgtcttttgcgtactacatgtttcctcggcgggtctgacccgccgattggacaactttaaactctttgcaattgca

SEQ ID NO: 180 - DNA, 151 bp, Unknown
  Kingdom: Fungi, Phylum: Ascomycota
gtaggtgaacctgcggagggatcattacacaaatatgaaggcgggctggaacctctcggggttacagccttgctgaattattcacccttgtcttttgcgtacttcttgtttccttggtgggttcgcccgccaccaggaccaaaccataaac

SEQ ID NO: 181 - DNA, 151 bp, Unknown
  Kingdom: Fungi, Phylum: Ascomycota
gtaggtgaacctgcggagggatcattacaagttgaccccggccctcgggccgggatgttcacaaccctttgttgtccgactctgttgcctccggggcgaccctgcctccgggcgggggccccgggtggacatttcaaactcttgcgtaact

SEQ ID NO: 182 - DNA, 151 bp, Unknown
  Kingdom: Fungi, Phylum: Ascomycota
ttcttttaacctgcggagggatcattacacaaatatgaaggcgggctggaacctctcggggttacagccttgctgaattattcacccttgtcttttgcgtacttcttgtttccttggtgggttcgcccaccactaggacaaacataaacct

SEQ ID NO: 183 - DNA, 151 bp, Unknown
  Kingdom: Fungi, Phylum: Ascomycota
gtaggtgaacctgcggagggatcattacacaatctgaaggcgggctggacaccctccagccgggcactgcttcacggcgtgcgcggctggagccggccctgctgaattattcacccgtgtcttttgcgtacttcttgtttcctgggtgggc

SEQ ID NO: 184 - DNA, 151 bp, Unknown
  Kingdom: Fungi, Phylum: Ascomycota
gtaggtgaacctgcggaaggatcattacctagagttgtaggctttgcctgctatctcttacccatgtcttttaagtaccttacgtttcctcggcgggtccgcccgccggttggacaatttaaaccattttcagttgcaatcagcgtctgaa

SEQ ID NO: 185 - DNA, 151 bp, Unknown
  Kingdom: Fungi, Phylum: Ascomycota
gtaggtgaacctgcggaaggatcattacctagagttgtaggctttgcctgctatctcttacccatgtcttttgagtaccttacgtttcctcggcgggttggccaccgattggacaaatttaaaccctttgtagttgaaatcagcgtctgaa

SEQ ID NO: 186 - DNA, 151 bp, Unknown
  Kingdom: Fungi, Phylum: Ascomycota
gtaggtgaacctgcggaaggatcattacctagagtttgtgggctttgcctgctatctcttacccatgtcttttgagtaccttacgtttcctcggcgggtccgcccgccgactggacaatttaaaccatttgcagttgcaatcagcgtctga

SEQ ID NO: 187 - DNA, 151 bp, Unknown
  Kingdom: Fungi, Phylum: Ascomycota
gtaggtgaacctgcggaaggatcattacattcagtagcctagctacttgtttacacccttgttttttgcgtacctattgtttcctcggtgggcttgcctgccggttggacaaaacctataacctttttaaatcttcaatcagcgtctgaat

SEQ ID NO: 188 - DNA, 151 bp, Unknown
  Kingdom: Fungi, Phylum: Ascomycota
gtaggtgaacctgcggagggatcattacacaataaccaggcgggctggacaccccccgctgggcactgcttcacggcgtgcgcggcggggccggccctgctgaattattcacccgtgtcttttgcgtacttcttgtttcctgggggggctc

SEQ ID NO: 189 - DNA, 151 bp, Unknown
  Kingdom: Fungi, Phylum: Ascomycota
gtaggtgaacctgcggagggatcattacacaataaaatatgaaggcctggcttcgcggccggctgaagtattttttcacccatgtcttttgcgcacttgttgtttcctgggcgggttcgcccgccaccaggaccaaaccataaaccttttt

SEQ ID NO: 190 - DNA, 151 bp, Unknown
  Kingdom: Fungi, Phylum: Ascomycota
gtaggtgaacctgcggaaggatcattaaagagacgttgcccttcggggtatacctcccaccctttgtttattatacctttgttgctttggcgggcccgtcctcggaccaccggcttcggctggtcagtgcccgccagaggacctaaaactc

SEQ ID NO: 191 - DNA, 151 bp, Unknown
  Kingdom: Fungi, Phylum: Ascomycota
gtaggtgaacctgcggagggatcattactgagtgagggccttcgggctcgacctccaaccctttgtgaacacaacttgttgcttcgggggcgaccctgccgtttcgacggcgagcgcccccggaggccttcaaacactgcatctttgcgtc

SEQ ID NO: 192 - DNA, 151 bp, Unknown
  Kingdom: Fungi, Phylum: Ascomycota
gtaggtgaacctgcggagggatcattactgagtgagggcttccggcccgacctccaaccctttgtgaacacatcttgttgcttcgggggcgaccctgccgttcgcggcattccccccggaggtcatcaaaacactgcattcttacgtcgga

SEQ ID NO: 193 - DNA, 151 bp, Unknown
  Kingdom: Fungi, Phylum: Ascomycota
gtaggtgaacctgcggaaggatcattaaccttcatcggggggctggacccagactgtagagcttcggccctgctttctgcccaaccctctctgattatacccatgtcttttgcgtactatttgtttccttggtgggcttgcccgccgatag

SEQ ID NO: 194 - DNA, 151 bp, Unknown
  Kingdom: Fungi, Phylum: Ascomycota
gtaggtgaacctgcggaaggatcattatctagagtcgtgggctttgcctgccatctcttacccatgtcttttgagtacttacgtttccttggcgggtccgcccgccaaagacaaagaatcaaacctttgcagttgcaatcagcgtctgaaa

SEQ ID NO: 195 - DNA, 151 bp, Unknown
  Kingdom: Fungi, Phylum: Ascomycota
gtaggtgaacctgcggagggatcattacaagaaacgatcccggttttaccaccgggtgatttcataaccctttgttgtccgactctgttgcctccggggcgaccctgccttcgggcgggggctccgggtggacaaattcaaactcttgcgt

SEQ ID NO: 196 - DNA, 151 bp, Unknown
  Kingdom: Fungi, Phylum: Ascomycota
gtaggtgaacctgcggaaggatcattaaagagtcagggtgctcagcgcccgacctccaaccctttgttgttacaactaccttgttgctttggcgggaccgctcggttccgagccgctggggattcgtcccaggcgagtgcccgccagagtt

SEQ ID NO: 197 - DNA, 151 bp, Unknown
  Kingdom: Fungi, Phylum: Ascomycota
gtaggtgaacctgcggaaggatcattacctagagttgtaggctttgcctgctatctcttacccatgtcttttgagtacttacgtttcctcggcgggtccgcccgccgatttgacaaatttaaaccatttgcagttgcaatcagcgtctgaa

SEQ ID NO: 198 - DNA, 151 bp, Unknown
  Kingdom: Fungi, Phylum: Ascomycota
gtaggtgaacctgcggaaggatcattacctagagttgtaggctttgcctgctatctcttacccatgtctttacagtaccttcgtttcctcggcgggttcgcccgccgatttgacaaatttaaaccctttgcagttgcaatcagcgtctgaa

SEQ ID NO: 199 - DNA, 151 bp, Unknown
  Kingdom: Fungi, Phylum: Ascomycota
gtaggtgaacctgcggaaggatcattacctagagtttgtgggctttgcctgctatctcttacccatgtcttttgagtacttacgtttcctcggtgggctcgcccgccgattggacaaacttaaaccctttgcagttgcaatcagcgtctga

SEQ ID NO: 200 - DNA, 151 bp, Unknown
  Kingdom: Fungi, Phylum: Ascomycota
gtaggtgaacctgcggaaggatcattaccgagagttgtaggcttctgtctaccatctcttacccatgtcttttgcgtactacacgtttcctcggcaggtccgcctgccgctaggacaatttaaaccatttgcagttgcagtcagcgtctga

SEQ ID NO: 201 - DNA, 151 bp, Unknown
  Kingdom: Fungi, Phylum: Ascomycota
gtaggtgaacctgcggaaggatcattacactcagtcgtttactactgtaaaggaggctgttagtctgtatcgcgcaagctgatgagcagctggcctcttttatctacccttgtcttttgcgcacccacgtttcctcggcaggcttgcctgc

SEQ ID NO: 202 - DNA, 151 bp, Unknown
  Kingdom: Fungi, Phylum: Ascomycota
gtaggtgaacctgcggaaggatcattacattcagtagcttgctactgttaggggggtcgatcagcctgtatagtatcactactgatgagcagcacaaccccctgtctgtacccttgtcttttgcgcactcatgtttcctcggcgggtctat

SEQ ID NO: 203 - DNA, 151 bp, Unknown
  Kingdom: Fungi, Phylum: Ascomycota
gtaggtgaacctgcggaaggatcattaaatatcggtagttcactgccgtttgagggaggtggaaactgtgcggctaatagctgtacagaagtacacttcttttcttaacccttgactttttgcgcacttgtgtttcctcggcaggcttgcc

SEQ ID NO: 204 - DNA, 151 bp, Unknown
  Kingdom: Fungi, Phylum: Ascomycota
gtaggtgaacctgcggaaggatcattaccgagtgagggccctctgggtccaacctcccacccgtgtttattttaccttgttgcttcggcgggcccgccttaactggccgccggggggctcacgcccccgggcccgcgcccgccgaagacac

SEQ ID NO: 205 - DNA, 151 bp, Unknown
  Kingdom: Fungi, Phylum: Ascomycota
gtaggtgaacctgcggaaggatcattaccgagtgcgggcccctcggggcccaacctcccacccgtgttgcccgaacctatgttgcctcggcgggccccgcgcccgccgacggcccccctgaacgctgtctgaagttgcagtctgagaccta

SEQ ID NO: 206 - DNA, 151 bp, Unknown
  Kingdom: Fungi, Phylum: Ascomycota
gtaggtgaacctgcggaaggatcattaccgagtgcgggtcctttgggcccaacctcccatccgtgtctattgtaccctgttgcttcggcgggcccgccgcttgtcggccgccgggggggcgcctctgccccccgggcccgtgcccgccgga

SEQ ID NO: 207 - DNA, 151 bp, Unknown
  Kingdom: Fungi, Phylum: Ascomycota
gtaggtgaacctgcggaaggatcattaccgagtgagggccctctgggtccaacctcccacccgtgtttattttaccttgttgcttcggcgagcctgccttttggctgccgggggacgtctgtccccgggtccgcgctcgccgaagacacct

SEQ ID NO: 208 - DNA, 151 bp, Unknown
  Kingdom: Fungi, Phylum: Ascomycota
gtaggtgaacctgcggaaggatcattaccgagtgcgggccctctgggtccaacctcccatccgtgtctatctgtaccctgttgcttcggcgtggccacggcccgccgaagactaacatttgaacactgtctgaagtttgcagtctgagttt

SEQ ID NO: 209 - DNA, 151 bp, Unknown
  Kingdom: Fungi, Phylum: Ascomycota
gtaggtgaacctgcggaaggatcattaccgagtgcgggccctcatggcccaacctcccacccttgtctctatacacctgttgctttggcgggcccaccggggccacctggtcgccgggggacatctgtccccgggcccgcgcccgccgaag

SEQ ID NO: 210 - DNA, 151 bp, Unknown
  Kingdom: Fungi, Phylum: Ascomycota
gtaggtgaacctgcggaaggatcattactgagtgagggccctctgggtccaacctcccacccgtgtttattgtaccttgttgcttcggtgcgcccgcctcacggccgccggggggcttctgcccccgggtccgcgcgcaccggagacacca

SEQ ID NO: 211 - DNA, 151 bp, Unknown
  Kingdom: Fungi, Phylum: Ascomycota
gtaggtgaacctgcggaaggatcattgtcgtgaccctgaccaaaacagaccgcgcacgcgtcatccaatccgtcggcgacggcaccgtccgtcgctcggccaatgcctcgaccacctcccctcctcggagcgggtgggggctcggggtaaa

SEQ ID NO: 212 - DNA, 151 bp, Unknown
  Kingdom: Fungi, Phylum: Ascomycota
gtaggtgaacctgcggaaggatcattaccgagtgagggccctctggtccaacctcccacccgtgtttatttaccttgttgcttcggcgagcctgccttttggctgccgggggacgtcagtccccgggtccgtgctcgccggagacacctta

SEQ ID NO: 213 - DNA, 151 bp, Unknown
  Kingdom: Fungi, Phylum: Ascomycota
gtaggtgaacctgcggaaggatcattaccgagtgagggccctctgggtccaacctcccacccgtgtttatcgtaccttgttgcttcggcgggcccgcctcacggccgccggggggcatctgcccccgggcccgcgcccgccgaagacacac

SEQ ID NO: 214 - DNA, 151 bp, Unknown
  Kingdom: Fungi, Phylum: Ascomycota
gtaggtgaacctgcggaaggatcattaccgagtgtagggttcctagcgagcccaacctcccacccgtgtttactgtaccttagttgcttcggcgggcccgccattcatggccgccgggggctctcagccccgggcccgcgcccgccggaga

SEQ ID NO: 215 - DNA, 151 bp, Unknown
  Kingdom: Fungi, Phylum: Ascomycota
gtaggtgaacctgcggaaggatcattaccgagtgagggccctctgggtccaacctcccacccgtgtttattttaccttgttgcttcggcgagcctgccttcgggctgccggggggcatctgcccccgggtccgcgctcgccggagacacct

SEQ ID NO: 216 - DNA, 151 bp, Unknown
  Kingdom: Fungi, Phylum: Ascomycota
gtaggtgaacctgcggaaggatcattaccgagtgcgggcccctcgtggcccaacctcccacccttgtctctatacacctgttgctttggcgggcccaccggggccacctggtcgccgggggacgttcgtccccgggcccgcgcccgccgaa

SEQ ID NO: 217 - DNA, 151 bp, Unknown
  Kingdom: Fungi, Phylum: Ascomycota
gtaggtgaacctgcggaaggatcattgtcgtgaccctgaccaaaacagaccgtgcacgcgtcatccaatccgtcggcgatggcattgtccgtcgctcggccaatatgcctcgaccacctcccctccttggagtgggtgggggctcggggta

SEQ ID NO: 218 - DNA, 151 bp, Unknown
  Kingdom: Fungi, Phylum: Zygomycota
gtaggtgaacctgcggaaggatcattaattatgttaaagcgccttaccttagggtttcctctggggtaagtgattgcttctacactgtgaaaatttggctgagagactcagactggtcatgggtagacctatctggggtttgatcgatgcc

SEQ ID NO: 219 - DNA, 151 bp, Unknown
  Kingdom: Fungi, Phylum: Ascomycota
gtaggtgaacctgcggaaggatcattatagtgttcgctgccctcacgggtagcaaacctcacccttgtatatcatatctttgttgctttggcacgccacccccgggtgccggctccggctggctagtgcgtgtcgagggaccgtaaactct

SEQ ID NO: 220 - DNA, 151 bp, Unknown
  Kingdom: Fungi, Phylum: Ascomycota
gtaggtgaacctgcggaaggatcattacagagtgcgaggctcagtcgtggcgtctgctgcgtgctgggccgaccctcccacccgtgtcgatttgtatcttgttgctttggcgggccgggccgcgtcgtcgctgcccgcatgggacatgcgt

SEQ ID NO: 221 - DNA, 151 bp, Unknown
  Kingdom: Fungi, Phylum: Ascomycota
gtaggtgaacctgcggaaggatcattacagagttcatgcccgaaagggtagacctcccacccttgtgtattattactttgttgctttggcgagctgccttcgggccttgtatgctcgccagagaataccaaaactctttttattaatgtcg

SEQ ID NO: 222 - DNA, 151 bp, Unknown
  Kingdom: Fungi, Phylum: Basidiomycota
gtaggtgaacctgcggaaggatcattaatgaaattcaaggacgctctttttagaggtccgaccaattacattttacctttactctgtgcacacactactctttacaccattttttaactctatagttttaagaatgtaaaacaagtctcga

SEQ ID NO: 223 - DNA, 151 bp, Unknown
  Kingdom: Fungi, Phylum: Basidiomycota
gtaggtgaacctgcggaaggatcattagtgaataaatagggtgtccaatttaacttggaacccgaccttctcacatctaaccctgtgcatctgtatataatggcgagcaattttcgaattgtgagccatttcactttataaacactagtct

SEQ ID NO: 224 - DNA, 151 bp, Unknown
  Kingdom: Fungi, Phylum: Basidiomycota
gtaggtgaacctgcggaaggatcattagtgaataaatagggtgtccaatttaacttggaacccgaccttctcacacctaaccctgtgcatctgtatttaatggcgtgcaattttcggattgtgagccacttcactttataaacactagtct

SEQ ID NO: 225 - DNA, 151 bp, Unknown
  Kingdom: Fungi, Phylum: Basidiomycota
gtaggtgaacctgcggaaggatcattattgaaaacaagggtgtccaatttaacttggaacccgaacttctcaattctaactttgtgcatctgtattatggcgagcagtcttcggattgtgagccttcacttataaacactagtctatgaat

SEQ ID NO: 226 - DNA, 151 bp, Unknown
  Kingdom: Fungi, Phylum: Basidiomycota
gtaggtgaacctgcggaaggatcattagtgaataaatagggtgtccaatttaacttggaacccgaccttctcacatctcaccctgtgcatctgtattaatggcgagcaattttcggaccgtgagccatttcactttataaacactagtcta

SEQ ID NO: 227 - DNA, 151 bp, Unknown
  Kingdom: Fungi, Phylum: Basidiomycota
gtaggtgaacctgcggaaggatcattagtgaataacaggacgttcaatttaacttgaagtccgaactctcacatctaaccctgtgcatttgttttggttagtagagcgcttgcgttcgaacacctcttcattttacaaacactaagtcaaa

SEQ ID NO: 228 - DNA, 151 bp, Unknown
  Kingdom: Fungi, Phylum: Basidiomycota
gtaggtgaacctgcggaaggatcattagtgaatctaggacgtccaacttaacttggagtccgaactctcactttctaaccctgtgcatctgttaattggaatagtagctcttcggagtgaaccaccattcacttataaaacacaaagtcta

SEQ ID NO: 229 - DNA, 151 bp, Unknown
  Kingdom: Fungi, Phylum: Basidiomycota
gtaggtgaacctgcggaaggatcattaatgaaatgcaaggacgctctttttagaggtccgaccaactcatttacctttacactgtgcacatactacttttttacaccaattttttaacgcattagtttaagaatgtaaaatcagtctcgaa

SEQ ID NO: 230 - DNA, 151 bp, Unknown
  Kingdom: Fungi, Phylum: Ascomycota
gtaggtgaacctgcggaaggatcattactgtgatttatatcttatacacatgcgtgagcgcaccaaacacctaaaattgtaataataccagtcactaagttttaacaaaacaaaactttcaacaacggatctcttggttctcgcatcgatg

SEQ ID NO: 231 - DNA, 151 bp, Unknown
  Kingdom: Fungi, Phylum: Ascomycota
gtaggtgaacctgcggaaggatcattagattgaattatcattgttgctcgagttcttgtttagatcttttacaataatgtgtatctttattggagatgtgcgcttaattgcgctgcttcattagagtgtcgcagtagaagtagtcttgctt

SEQ ID NO: 232 - DNA, 151 bp, Unknown
  Kingdom: Fungi, Phylum: Ascomycota
gtaggtgaacctgcggaaggatcattagattgaattatcattgttgctcgagttcttgtttagatcttttacaataatgtgtatctttactgaagatgtgcgcttaattgcgctgcttctttagagtgtcgcagtgaaagtagtcttgctt

SEQ ID NO: 233 - DNA, 151 bp, Unknown
  Kingdom: Fungi, Phylum: Ascomycota
gttggtgaaccagcggagggatcattaccgagtttacaactcccaaacccctgtgaacataccaattgttgcctcggcggatcagcccgctcccggtaaaacgggacggcccgccagaggacccctaaactctgtttctatatgtaacttc

SEQ ID NO: 234 - DNA, 151 bp, Unknown
  Kingdom: Fungi, Phylum: Ascomycota
gtaggtgaacctgcggagggatcattactgagttttcaactctccaaaccatgtgaacttaccactgttgcctcggtggttggtgccctcacgggcgctgccgccggcggacaaactaaactcttgtcaactttgtcaaatctgaatctaa

SEQ ID NO: 235 - DNA, 151 bp, Unknown
  Kingdom: Fungi, Phylum: Ascomycota
gttggtgaaccagcggagggatcattaccgagtttacaactcccaaacccctgtgaacataccttatgttgcctcggcggatcagcccgcgccccgtaaaaagggacggcccgccgcaggaaccctaaactctgtttttagtggaacttct

SEQ ID NO: 236 - DNA, 151 bp, Unknown
  Kingdom: Fungi, Phylum: Ascomycota
gttggtgaaccagcggagggatcattacagagttgcaaaactccctaaaccattgtgaacgttaccttcaaaccgttgcttcggcgggcggcccgggtccgcccggtgccccctggccccctagcggggcgcccgccggaggaaaacccaa

SEQ ID NO: 237 - DNA, 151 bp, Unknown
  Kingdom: Fungi, Phylum: Ascomycota
gttggtgaaccagcggagggatcattaccagagtgccctaggctctccaacccattgtgaacatacctatcgttccctcggcgggctcagcgcgcggtgcctccgggctccgggcgtccgccggggacaaccaaaccctgattttatcgtg

SEQ ID NO: 238 - DNA, 151 bp, Unknown
  Kingdom: Fungi, Phylum: Ascomycota
gttggtgaaccagcggagggatcaccaccgagtttacaactcccaaacccctgtgaacatacctatacgttgcctcggcggatcagcccgcgccccgtaaaaagggacggcccgcccgtggacccctaaactctgtttttagtggaacttc

SEQ ID NO: 239 - DNA, 151 bp, Unknown
  Kingdom: Fungi, Phylum: Ascomycota
gttggtgaaccagcggagggatcattaccgagtttacaactcccaaacccctgtgaacatacctatacgttgcctcggcggatcagcccgcgccctgtaaaaagggacggcccgcccgaggaccctaaactctgtttttagtggaacttct

SEQ ID NO: 240 - DNA, 151 bp, Unknown
  Kingdom: Fungi, Phylum: Ascomycota
gttggtgaaccagcggagggatcattaccagagtgccttttggctctccaacccactgtgaacatacctacgtttccctcggcgggctcagcgcgttgcggttccgccgcctcgcgtccgccgggggcacccaaactcgaatttatatcgt

SEQ ID NO: 241 - DNA, 151 bp, Unknown
  Kingdom: Fungi, Phylum: Ascomycota
gttggtgaaccagcggagggatcattaccgagtttacaactcccaaacccctgtgaacataccttaatgttgcctcggcggatcagcccgcgccccgtaaaacgggacggcccgccagaggacccaaactctaatgtttcttattgtaact

SEQ ID NO: 242 - DNA, 151 bp, Unknown
  Kingdom: Fungi, Phylum: Ascomycota
gttggtgaaccagcggagggatcattaccgagtgtaaaaactcccaaaccattgtgaacctaccactgttgcttcggcggcctcgccccgggcgcgttcgcgcggcccggacccaggcgtccgccggaggctccaaactcttgtcttttag

SEQ ID NO: 243 - DNA, 151 bp, Unknown
  Kingdom: Fungi, Phylum: Ascomycota
gttggtgaaccagcggagggatcattaccgagttattcaactcatcaaccctgtgaacttacctaaacgttgcttcggcgggaatagacggccctgtaaaacgggccgcccccgccagaggactcttaactctgtttcttataatgtttct

SEQ ID NO: 244 - DNA, 151 bp, Unknown
  Kingdom: Fungi, Phylum: Ascomycota
gttggtgaaccagcggagggatcattaccgagtactacactcataaccctttgtgaacctttataacctgttgcttcggcggcgcgccgcgaggcccgcccgccggtaccatcagaatctctgttcgaacccgacgatacatctgagtgtt

SEQ ID NO: 245 - DNA, 151 bp, Unknown
  Kingdom: Fungi, Phylum: Ascomycota
gttggtgaaccagcggagggatcattactgagtactacactctctaccctttgtgaactattatacctgttgcttcggcggcgcccgcgagggtgcccgccggtctcatcagaatctctgttttcgaacccgacgatacttctgagtgttc

SEQ ID NO: 246 - DNA, 151 bp, Unknown
  Kingdom: Fungi, Phylum: Ascomycota
gttggtgaaccagcggagggatcattaccgagtttacaactcccaaacccctgtgaaccatacctgtcgttgcttcggcggccacgccccggtgccctcgtgcccggaaccaggcgcccgccggaggccaaaaaaaccatgtttaccacag

SEQ ID NO: 247 - DNA, 151 bp, Unknown
  Kingdom: Fungi, Phylum: Ascomycota
gttggtgaaccagcggagggatcattaccgagtttccaactcccaaacccctgtgaacatccctttatgttgcctcggcggatcagcccgcgccccgtaaaacgggacggcccgccgcaggaaaccctaaactctgtttttagtggaactt

SEQ ID NO: 248 - DNA, 151 bp, Unknown
  Kingdom: Fungi, Phylum: Ascomycota
gttggtgaaccagcggagggatcattaccgagtttccaactcccaaacccctgtgaacatccctatacgttgcctcggcggatcagcccgcgccccgtaaaacgggacggcccgcccgaggacccctaaactctgtttttagtggaacttc

SEQ ID NO: 249 - DNA, 151 bp, Unknown
  Kingdom: Fungi, Phylum: Ascomycota
gtaggtgaacctgcggagggatcattacacaaatatgaaggcggggctggcacctcccggggtggccagccttgctgaattattccacccgtgtcttttgcgtacttcttgtttccttggtgggctcgcccaccacaaggaccaacccata

SEQ ID NO: 250 - DNA, 151 bp, Unknown
  Kingdom: Fungi, Phylum: Ascomycota
gttggtgaaccagcggagggatcattacagagttgcaaaactcccaaccattgtgaacctacctcaccgttgcctcggcgggtggcccccacccgggccgcgccggccccaccgggccggcaacccgtcagaggaccgcaactcttagtca

SEQ ID NO: 251 - DNA, 151 bp, Unknown
  Kingdom: Fungi, Phylum: Ascomycota
gttggtgaaccagcggagggatcattacagagttgcaaaactccctaaaccattgtgaacgttacctaaaccgttgcttcggcgggcggccccggggtttaccccccgggcgcccctgggccccaccgcgggcgcccgccggaggtcacca

SEQ ID NO: 252 - DNA, 151 bp, Unknown
  Kingdom: Fungi, Phylum: Ascomycota
gttggtgaaccagcggagggatcattactgagtcctacactctctaccctttgtgaactattatacctgttgcttcggcggcgctcgcaagagcgcccgccggtctcatcagaatctctgttttcgaacccgacgatacttctgagtgttc

SEQ ID NO: 253 - DNA, 151 bp, Unknown
  Kingdom: Fungi, Phylum: Ascomycota
gttggtgaaccagcggagggatcattactgagttaccgctctacaaccctttgtgaacatacctaaccgttgcttcggcgggcaggggaagcctctcgtgggcggaccctcccggcgccggccccgtcacgggggcggagcgcccgccgga

SEQ ID NO: 254 - DNA, 151 bp, Unknown
  Kingdom: Fungi, Phylum: Ascomycota
gttggtgaaccagcggagggatcattactgagtttacaactcccaaacccctgtgaacatacctatgttgcttcggcgggccgtcccgcggcgcgcccacgtggcgtgacccggaaccaggcgcccgccggggacccaaactcttgccttt

SEQ ID NO: 255 - DNA, 151 bp, Unknown
  Kingdom: Fungi, Phylum: Ascomycota
gtaggtgaacctgcggagggatcattaccgagtttacaactcccaaacccctgtgaacatacctttatgttgcctcggcggatcagcccgcgccccgtaaaacgggacggcccgccgctggaaaccctaaactctgtttttagtggaactt

SEQ ID NO: 256 - DNA, 151 bp, Unknown
  Kingdom: Fungi, Phylum: Ascomycota
gcaggttcacctacggagggatcattactgagttttcaactctccaaaccatgtgaacttaccactgttgcctcggtggttggtgccctcacgggcgctgccgccggcggacaaactatactcttgtcaactttgtcaaatctgaatctaa

SEQ ID NO: 257 - DNA, 151 bp, Unknown
  Kingdom: Fungi, Phylum: Ascomycota
gttggtgaaccagcggagggatcattaccgagtttacactcataaccctttgtgaacattataacttgttgcttcggcggcttcttcgggagcccgccggcgtttcagtatctctgtttgtacccgacgatacatctgagtgttcttagcg

SEQ ID NO: 258 - DNA, 151 bp, Unknown
  Kingdom: Fungi, Phylum: Ascomycota
gttggtgaaccggcggagggatcattaccgagtttacaactcccaaacccctgtgaacatacctatacgttgcctcggcggaccagcccgtgccccgtaaaacgggacggcccgcccgaggacccctaaactctgtttttagtggaacttc

SEQ ID NO: 259 - DNA, 151 bp, Unknown
  Kingdom: Fungi, Phylum: Ascomycota
gttggtgaaccagcggagggatcattaccgagtttacaactcccaaacccatgtgaacatacctttacgttgcttcggcggagccgccccggcgcccggaacctcttcggtttcgcggcccggaaccaggcgcccgccggaggccacaaac

SEQ ID NO: 260 - DNA, 151 bp, Unknown
  Kingdom: Fungi, Phylum: Ascomycota
gttggtgaaccagcggagggatcattaccgagtttacaactcccaaacccctgtgaacataccatatgttgcctcggcggatcagcccgtccttcgggacggcccgccgcaggaccctaaactctgtttttagtggaacttctgagtaaaa

SEQ ID NO: 261 - DNA, 151 bp, Unknown
  Kingdom: Fungi, Phylum: Basidiomycota
gtaggtgaacctgcggaaggatcattaatgaatttagattgaaccataggcgaaagccagtggttcttctttcatatccataacacctgtgcactgttggatgcttgcatccacttttaaactaaacattattgtaacaaatgtagtctta

SEQ ID NO: 262 - DNA, 151 bp, Unknown
  Kingdom: Fungi, Phylum: Basidiomycota
gtaggtgaacctgcggaaggatcattaatgaataaaggtatcacgcctcacggctgtgtgttggatcattgtgcaatagtctttgatccacttcctatcatatccataacacctgtgcactgttggatgcttgcatccacttttaaactaa

SEQ ID NO: 263 - DNA, 151 bp, Unknown
  Kingdom: Fungi, Phylum: Basidiomycota
gtaggtgaacctgcggaaggatcattaatagtgctcattgacgcaagtcagtgagttagatctgctctcttcgcaagaagagggtttccatacacaccgtgaactgtggcttcggccatcacaaactgttagtaatgaatgtaatatcata

SEQ ID NO: 264 - DNA, 151 bp, Unknown
  Kingdom: Fungi, Phylum: Basidiomycota
gtaggtgaacctgcggaaggatcattaataatgctctctggcttcggtcagctgagttcaatgagtgccttctcttcggagttggccatccacacacaccgtgaactgtggcttcggccatcacaaactgttagtaatgaatgtaatatca

SEQ ID NO: 265 - DNA, 151 bp, Unknown
  Kingdom: Fungi, Phylum: Basidiomycota
gtaggtgaacctgcggaaggatcattaatagtgccctttgatgcaaatcattgggttagatctgctctcttcgcaagaagagggtttccatacacaccgtgaactgtggcttcggccatcacaaactgttagtaatgaatgtaatatcata

SEQ ID NO: 266 - DNA, 151 bp, Unknown
  Kingdom: Fungi, Phylum: Basidiomycota
gtaggtgaacctgcggaaggatcattattaaatgcgaagcctcacggcctagctttataatcccttattacacctgtgcaccttattgtcttcggacaatttactacaaacatcagtgtaacgaatgtaaagtattataatcaatacaact

SEQ ID NO: 267 - DNA, 151 bp, Unknown
  Kingdom: Fungi, Phylum: Basidiomycota
gtaggtgaacctgcggaaggatcattaatgaaaatgtgttgccgggacccataatcccggcactaaccttcttatccataacacctgtgcactgttggatgcttgcatccacttttatactaaacaatttgtaacaaatgtagtcttatta

SEQ ID NO: 268 - DNA, 151 bp, Unknown
  Kingdom: Fungi, Phylum: Basidiomycota
gtaggtgaacctgcggaaggatcattattgattggtcgaaagaccttatcagattctaccacctctgtgaaccgttgacctccgggttaataatcaaacatcagtgtaacgaacgtaagagtatcttaattaaacaaaacttttaacaacg

SEQ ID NO: 269 - DNA, 151 bp, Unknown
  Kingdom: Fungi, Phylum: Basidiomycota
gtaggtgaacctgcggaaggatcattaatgaatataaatcgtactgttcacgcagtatgtggggtggtgacttcggtcccgctcattcatatccataacacctgtgcactgttggatgcttgcatccacttttaaactaaacattattgta

SEQ ID NO: 270 - DNA, 151 bp, Unknown
  Kingdom: Fungi, Phylum: Basidiomycota
gtaggtgaacctgcggaaggatcattagtgaattgagctggcttcggccgctctgatctatacacacctgtgaactgttggccttcgggtctttaattacaactgtgacgaacgtaaattattataacaaataaaacttttaacaacggat

SEQ ID NO: 271 - DNA, 151 bp, Unknown
  Kingdom: Fungi, Phylum: Basidiomycota
gtaggtgaacctgcggaaggatcattaatgaattttacgccctagtcttaactgataggggctggttctatccataacacctgtgcactgttggatgcttgcatccacttttaaactaaacattattgtaacaaatgtagtcttattataa

SEQ ID NO: 272 - DNA, 151 bp, Unknown
  Kingdom: Fungi, Phylum: Basidiomycota
gtaggtgaacctgcggaaggatcactagtgattaaacgggaagcgtcttaactgaccttctcacccttcacatccacatacaccctgtgaactgtttggcttcaactctcgagttgggctctcctatcgatagattagcaatagtctagcg

SEQ ID NO: 273 - DNA, 151 bp, Unknown
  Kingdom: Fungi, Phylum: Basidiomycota
gtaggtgaacctgcggaaggatcactagtgattaaaccggagagcgtcttcattgacctctccaacccttcacatccacatacaccctgtgaaccgtttggctttgttgagctgaaagttgaaagaataggcttgcaaaagtctagtcgga

SEQ ID NO: 274 - DNA, 151 bp, Unknown
  Kingdom: Fungi, Phylum: Basidiomycota
gtaggtgaacctgcggaaggatcattagtgattgacctccgggtcttaataactataatcttctacctctgtgaaccgttggtcttcggaccgattcttataacaaacatctgtgtaatgaacgtaacctatattaatcatataaaacttt

SEQ ID NO: 275 - DNA, 151 bp, Unknown
  Kingdom: Fungi, Phylum: Basidiomycota
gtaggtgaacctgcggaaggatcattaataaatggcgacgctttcgagcttagcttttatatccttatacacctgtgaactatttgcctttgggcacaaacttaaacataatgtaatgaatgtaaactattataacaaatacaactttcaa

SEQ ID NO: 276 - DNA, 151 bp, Unknown
  Kingdom: Fungi, Phylum: Basidiomycota
gtaggtgaacctgcggaaggatcactagagatttcgccctccggggctctctttttcttcacacacccctgtgcactttggctgccgcttcattgcggtggtcttttataattaccatacccatatacacaagtcattgaatgtaaaatcg

SEQ ID NO: 277 - DNA, 151 bp, Unknown
  Kingdom: Fungi, Phylum: Basidiomycota
gtaggtgaacctgcggaaggatcattaatgaattttacgccctaggcctaagtgctaggggctggttctatccataacacctgtgcactgttggatgcttgcatccacttttaaactaaacattattgtaacaaatgtagccttattataa

SEQ ID NO: 278 - DNA, 151 bp, Unknown
  Kingdom: Fungi, Phylum: Basidiomycota
gtaggtgaacctgcggaaggatcactaaagtaaacgccctccggggctctctttattcacacacccctgtgcactttggccacctgccgcgcttaactgcgttagtaggtgtgtctctttatttatgcccatatacacaagtcattgaatg

SEQ ID NO: 279 - DNA, 151 bp, Unknown
  Kingdom: Fungi, Phylum: Basidiomycota
gtaggtgaacctgcggaaggatcattattaaacgttacttcggtaacttaatatccttaacacctgtgcatcttgtcgctccggcgatattatacaaacatcagtgtaaagaatgtattatattataacaaatacaactttcaacaacgga

SEQ ID NO: 280 - DNA, 151 bp, Unknown
  Kingdom: Fungi, Phylum: Basidiomycota
gtaggtgaacctgcggaaggatcattaatgattgaacgtctgtcgagcttgctcacaggcacatcatatccataacacctgtgcacttgtcggatggcttagtgaagaccgcaaggttggatctatccatctactttacataacaattctg

SEQ ID NO: 281 - DNA, 151 bp, Unknown
  Kingdom: Fungi, Phylum: Basidiomycota
gtaggtgaacctgcggaaggatcattaatagtgctctctgatgcaaatcattgagttagatctgctctcctcgcaagaggagggtttccatacacaccgtgaactgtggcttcggccatcacaaactgttagtaatgaatgtaatatcata

SEQ ID NO: 282 - DNA, 151 bp, Unknown
  Kingdom: Fungi, Phylum: Basidiomycota
gtaggtgaacctgcggaaggatcactaaagtaaacgccctccggggctctctttattcacacacccctgtgcactttggccacctgccgcgcttcactgcgttagtaggtgtgtctttataattatacccatatacacaagtcattgaatg

SEQ ID NO: 283 - DNA, 151 bp, Unknown
  Kingdom: Fungi, Phylum: Basidiomycota
gtaggtgaacctgcggaaggatcactagtgattaaatcgagcgtgtcttcattgaccgctcacccttctcaccatccacatacacctgtgcactgtttagcctgagccggttttccggtccaggttatcatttcatacaaactctagtctt

SEQ ID NO: 284 - DNA, 151 bp, Unknown
  Kingdom: Fungi, Phylum: Basidiomycota
gtaggtgaacctgcggaaggatcattaatgattaactgtctgtcgagcttgctcacagacttatcatatccataacacctgtgcacttgtcggatggcttagtgaagaccgcaaggttggaactatccatctactttacataacaatttag

SEQ ID NO: 285 - DNA, 151 bp, Unknown
  Kingdom: Fungi, Phylum: Basidiomycota
gtaggtgaacctgcggaaggatcattattaaatgcgaagccatcactggcctagctttataatcccttattacacctgtgcaccttattgtctttggacaattttaacaaacatcagtgtaaagaatgtaaactattataataaatacaac

SEQ ID NO: 286 - DNA, 151 bp, Unknown
  Kingdom: Fungi, Phylum: Basidiomycota
gtaggtgaacctgcggaaggatcattagtgattcgttattgagtgtaaaaactcataatcttctatacaaaccactgttttaaaatgtttactagaatgtccaagcagttaagctgttgaaatattaaaaagtttaataaaactttcagca

SEQ ID NO: 287 - DNA, 151 bp, Unknown
  Kingdom: Fungi, Phylum: Basidiomycota
gtaggtgaacctgcggaaggatcattagtgattaattattgagtgtaaaaaactcataatcttctacaaaccactgttttaaaatgtttactagaatgtccaagcagttaagctgttgaaatattaaaagttttataaaactttcagcaac

SEQ ID NO: 288 - DNA, 151 bp, Unknown
  Kingdom: Fungi, Phylum: Basidiomycota
gtaggtgaacctgcggaaggatcattagtgattaattattgagtgtaaaaactcataatcttctatacaaaccactgttttaaaatgtttactagaatgtccaagcagttaagctgttgaaattataaaagtttaataaaactttcagcaa

SEQ ID NO: 289 - DNA, 151 bp, Unknown
  Kingdom: Fungi, Phylum: Basidiomycota
gtaggtgaacctgcggaaggatcattagtgattaattattgagtgataaaaaactcataatcttctacaaaccactgttttaaatgtttactagaatgtccaagcagttaagctgttgaaatattaaaagttttataaaactttcagcaac

SEQ ID NO: 290 - DNA, 1409 bp, Unknown
  Kingdom: Bacteria, Phylum: Proteobacteria
catgcagtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattacgtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcaaggagggcgatacca

SEQ ID NO: 291 - DNA, 1404 bp, Unknown
  Kingdom: Bacteria, Phylum: Proteobacteria
tgacagtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaatcaggacacaggtgctgcatggctgtcgtcagctcgtgtcctgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcaaggagggcgta

SEQ ID NO: 292 - DNA, 1418 bp, Unknown
  Kingdom: Bacteria, Phylum: Proteobacteria
acacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagatgcttacctggccttgacatgctgagaacattgcagagatggatatgtgccttcgggaactcagacacaggtgctgcatggctgtcgtcagctcgtgtcgtgagatgttgggttaagtcccgtaacgagcgcaacccttgtccttagttaccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacggagta

SEQ ID NO: 293 - DNA, 1356 bp, Unknown
  Kingdom: Bacteria, Phylum: Proteobacteria
catgcagtcgaacgcatcgcagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcagaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattgggagacgatgaccttcagttcggctggccctagaacaggtgctgcatggctgtcgtcagctcgtgtcgtgagatgttgggataagtcccgcaacgagcgcaaccctcccgcatagttggcagcatttagttgggctctctatcgggactgccggtgatatccgcagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgacc

SEQ ID NO: 294 - DNA, 1419 bp, Unknown
  Kingdom: Bacteria, Phylum: Proteobacteria
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagatgcttacctggccttgacatccagagaacatagcagagatgctttggtgccttgcggtactctgagacaggtgctgcatggctgtcgtcagctcgtgttgactaatgttgggttaagtcccgcatgctgcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactta

SEQ ID NO: 295 - DNA, 1424 bp, Unknown
  Kingdom: Bacteria, Phylum: Proteobacteria
gctacacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaacttgccgattgacgttacccgcagaagaagcaccggctaactccgtgccagcagccgcattaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaatagtagggttaagtcccggtacgagcgcaagccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttgg

SEQ ID NO: 296 - DNA, 793 bp, Unknown
  Kingdom: Bacteria, Phylum: Proteobacteria
  misc_feature (34)..(34): n is a, c, g, or t
agtcgaacggtaacaggaagcagcttgctgcttngctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgccctttgaggcgtg

SEQ ID NO: 297 - DNA, 1420 bp, Unknown
  Kingdom: Bacteria, Phylum: Proteobacteria
accatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatggtggtttaattcgatgcaacgcgaagtagcttacctggccttgacatccagagaacttagcagagatgctttggtcgcttcgggaactctgacacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttt

SEQ ID NO: 298 - DNA, 1424 bp, Unknown
  Kingdom: Bacteria, Phylum: Proteobacteria
tacacatgcagtcgaacggtagcacagagagcttgctctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtggagttaataccttcaccgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctggagtcttgtagaggggggtagaattccaggtgtagcggtgaaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacggggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttga

SEQ ID NO: 299 - DNA, 602 bp, Unknown
  Kingdom: Fungi, Phylum: Ascomycota
ttgaggaagtaaaagtcgtaacaaggtctccgttggtgaaccagcggagggatcattaccagagtgccctaggctctccaacccattgtgaacatacctaacgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcatatcaataaggcg

SEQ ID NO: 300 - DNA, 1420 bp, Unknown
  Kingdom: Bacteria, Phylum: Proteobacteria
acacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggctgtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgatgggataagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactg

SEQ ID NO: 301 - DNA, 1419 bp, Unknown
  Kingdom: Bacteria, Phylum: Proteobacteria
cacatgcagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtcgagcatgtggtttaattcgatgcaacgcgaagtaccttacctggtcttgacatccacagaacttagcagagatggtatcgtgccttcgggtactgtgagacacgtgctgcatggctgtcgtcagctcgtgttgactaatgttgggttaagtcccgcaacgaccgcaaccgttatccttagtaccgtcgggttcggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccactta

SEQ ID NO: 302 - DNA, 1422 bp, Unknown
  Kingdom: Bacteria, Phylum: Proteobacteria
taccatgcagtcgagcggtagcacaggagagcttgctctccgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcgtcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtaccgccgcaaggttaaaactcaaatgaattgacgggggcccgcacaagcggtggagcatgtggtttaattcgatgcaacgcgaagtaccttacctactcttgacatccagagtacttttcagagatgcattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactttga

SEQ ID NO: 303 - DNA, 1415 bp, Unknown
  Kingdom: Bacteria, Phylum: Proteobacteria
catgcagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagtacttggcagacatgccttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccata

SEQ ID NO: 304 - DNA, 608 bp, Unknown
  Kingdom: Fungi, Phylum: Ascomycota
ttgaggaagtaaaagtcgtaacaaggtctccgttggtgaaccagcggagggaacattaccagagtgccctaggctctccaacccattgtgaacatacctaacgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcatatcaataagccggaggaa

SEQ ID NO: 305 - DNA, 894 bp, Unknown
  Kingdom: Bacteria, Phylum: Firmicutes
tcgagcggagccttagagaagcttgcttctctgatgcttagcggcggacgggtgagtaacacgtaggcaacctgcctttcagtttgggataacttccggaaacggatgctaataccgaatacatcatcctttggcatcagaggatgaggaaagacggcgcaagctgtcactgagagatgggcctgcggcgcattagctagttggtgaggtaatggctcaccaaggcgacgatgcgtagccgacctgagagggtgaacggccacactgggactgagacacggcccagactcctacgggaggcagcagtagggaatcttccacaatgggcgaaagcctgatggagcaatgccgcgtgagtgatgaaggttttcggatcgtaaagctctgttgccagggaagaacgtccgggtgagtaactgcacccggagtgacggtacctgagaagaaagccccggctaactacgtgccagcagccgcggtaatacgtagggggcaagcgttgtccggaattattgggcgtaaagcgcgtgcaggcggcttgttaagttgggtgtttaagaccggggctcaaccccggctcgcacccaaaactgggaagcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgagtgctaggtgttcggggtttcgataccctgggtgccgaagttcacgcattaagcactccgcctggggagtacggtcgcaagactgaaactcaaaggaattgacggggacccgcacaagcagtgg

SEQ ID NO: 306 - DNA, 1333 bp, Unknown
  Kingdom: Bacteria, Phylum: Proteobacteria
gagagccttcggagtttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgctttgggtggcgcagctaacgcacttaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgctgacgcagatc

SEQ ID NO: 307 - DNA, 609 bp, Unknown
  Kingdom: Fungi, Phylum: Ascomycota
tcttggtcaatttagaggaagtaaaagtcgtaacaaggtctccgttggtgaaccagcggagggatcattaccagagtgccctaggctctccaacccattgtgaacatacctaacgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcatatcaaaa

SEQ ID NO: 308 - DNA, 1412 bp, Unknown
  Kingdom: Bacteria, Phylum: Proteobacteria
catgcagtcgagcggatgagaggagcttgctcctcgattcagcggcggacgggtgagtaatgcctaggaatctgcccagtagtgggggacaacgtttcgaaaggaacgctaataccgcatacgtcctacgggagaaagtgggggatcttcggacctcacgctattggatgagcctaggtcggattagctagttggtggggtaacggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggcttacagcgaaatacctgtgagttttgacgttaccaacagaataaagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggattaattcgaagcaacgcgaagaaaccttacctggccatgacttgctgagaactttccagaacatggattggtgccttcgggtactcagacacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcggggggacggtacca

SEQ ID NO: 309 - DNA, 878 bp, Unknown
  Kingdom: Bacteria, Phylum: Proteobacteria
  misc_feature (759)..(759): n is a, c, g, or t
acttcttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcacggttcccgaaggcactaaggcatctctgccgaattccgtggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtctttgtccagggggccgccttcgccaccggtattcctccagatctctacgcatttcaccgctacacctggnattctacccccctctacaagactcaagcctgccagtttcaaatgcagttcccaggttaagcccggggatttcacatctgacttaacagaccgcctgcgtgcgctttacgcccagtaatt

SEQ ID NO: 310 - DNA, 1389 bp, Unknown
  Kingdom: Bacteria, Phylum: Proteobacteria
acatgcagtcgtacggtgagtcacacatagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcatgacatccagagaacattgcagagatgcattcgacgcatgcggtactctgacacagcagctgcatggctgtcgtcagctcctgttgtgaatagtagggttaagtcccgcaacgaagcgcaacccatttgctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtagtaa

SEQ ID NO: 311 - DNA, 1406 bp, Unknown
  Kingdom: Bacteria, Phylum: Proteobacteria
accatgcagtcgacggcagcatgatcctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccgcttgtagtccacgccctaaacgatgtcaactagttgttggggattcatttccttagtaacgtagctaacgcgtgaagttgaccgcctgggggagtacggtcgcaagattaaaactcaaaggaattgacggggaccggcacaagcggtggatgatgtggattaatttgatgcaacgcgaaaaaccttacctacccttgacatgccactaacgaagcacagatgcattaggtgctcgaaagagaaagtggacacaggtgctgcatggctgtcgtcagctggtgtcgtgagatgttgggttaagtcccgcaacgagcgcaacccttgtctgtagttgctacgaaagggcactctagagagactgccggtgacaaaccggaggaaggtggggaggacgtcaagtcctcatggcccttatgggtagggggtcacacgtcatacaatggtgcgtacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcgctaaccgcaaggaggg

SEQ ID NO: 312 - DNA, 611 bp, Unknown
  Kingdom: Fungi, Phylum: Ascomycota
tcttggttcaattagaggaagtaaaagtcgtaacaaggtctccgtaggtgaacctgcggagggatcattacacaaatatgaaggcgggctggaacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcaataagcggaggaa

SEQ ID NO: 313 - DNA, 566 bp, Unknown
  Kingdom: Fungi, Phylum: Ascomycota
tttagaggaagtaaaagtcgtaacaaggtttccgtaggtgaacctgcggaaggatcattacctagagtttgtggacttcggtctgctacctcttacccatgtcttttgagtaccttcgtttcctcggcgggtccgcccgccggttggacaacattcaaaccctttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgttttgtctcgcctccgcgcgcagactcgccttaaaacaattggcagccggcgtattgatttcggagcgcagtacatctcgcgctttgcactcataacgacgacgtccaaaagtacatttttacactcttgacctcggatcaggtagggatacccgctgaacttaagcatatcaaaa

SEQ ID NO: 314 - DNA, 576 bp, Unknown
  Kingdom: Fungi, Phylum: Ascomycota
tcttggtccaattagaggaagtaaaagtcgtaacaaggtttccgtaggtgaacctgcggaaggttcattacctagagtttgtagacttcggtctgctacctcttacccatgtcttttgagtaccttcgtttcctcggcgggtccgcccgccgattggacaacattcaaaccctttgcagttgcaatcagcgtctgaaaaaacataatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgtgtagactcgccttaaaacaattggcagccggcgtattgatttcggagcgcagtacatctcgcgctttgcactcataacgacgacgtccaaaagtacatttttacactcttgacctcggatcaggtagggatacccgctgaacttaagcatatcaaaag

SEQ ID NO: 315 - DNA, 576 bp, Unknown
  Kingdom: Fungi, Phylum: Ascomycota
tggtcatttagaggaagtaaaagtcgtaacaaggtctccgttggtgaaccagcgggaggttcattaccgagtttacaactcccaaacccctgtgaacataccttatgttgcctcggcggatcagcccgcgccccgtaaaaagggacggcccgccgcaggaaccctaaactctgtttttagtggaacttctgagtataaaaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccagcttggtgttgggagctgcagtcctgctgcactccccaaatacattggcggtcacgtcgagcttccatagcgtagtaatttacacatcgttactggtaatcgtcgcggccacgccgttaaaccccaacttctgaatgttgacctcggatcaggtaggaatacccgctgaacttaagcatatcaataaggc

SEQ ID NO: 316 - DNA, 543 bp, Unknown
  Kingdom: Fungi, Phylum: Ascomycota
ttggtgaccagcggagggatcattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatcata

SEQ ID NO: 317 - DNA, 539 bp, Unknown
  Kingdom: Fungi, Phylum: Ascomycota
  misc_feature (19)..(19): n is a, c, g, or t
tggtgaccagcggagggancattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatc

SEQ ID NO: 318 - DNA, 539 bp, Unknown
  Kingdom: Fungi, Phylum: Ascomycota
  misc_feature (15)..(15): n is a, c, g, or t
  misc_feature (19)..(19): n is a, c, g, or t
tggtgaccagcgganggancattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatc

SEQ ID NO: 319 - DNA, 548 bp, Unknown
  Kingdom: Fungi, Phylum: Ascomycota
tctctccgttggtgaccagcggagggatcattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatc

SEQ ID NO: 320 - DNA, 533 bp, Unknown
  Kingdom: Fungi, Phylum: Ascomycota
tctcgttggtgaccagcggagggatcattaccgagtttacaactcccaaacccctgtgaacatacctatacgttgcctcggcggatcagcccgcgccccgtaaaaagggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatc

SEQ ID NO: 321 - DNA, 1431 bp, Unknown
  Kingdom: Bacteria, Phylum: Firmicutes
tacatgcagtcgagcggagttaataagaagcttgcttctttgagacttagcggcggacgggtgagtaacacgtaggcaacctgccctttagcctgggataactaccggaaacggtagctaataccggatactttctttttctgcatgggagaagaacgaaagacggagcaatctgtcactgaaggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtcttggagagtaactgctccgagagtgacggtacctgagaagaaagccccggctaactacgtgccagcagccgcggtaatacgtagggggcaagcgttgtcccggaattattgggcgtaaagcgcgcgcaggcggccgtttaagtccggtgtttaatcccgaagctcaacttcgggtcgcactggaaactggagggcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtgggagtatgtggtttaattcgaagcaacgcgaagaaccttaccaggtcttgacatctgaatgaccggtgcagagatgtacctttttcttcggaacattcaagacaggtggtgcatggttgtcgtcagctcgtgtcgtgagatgttgggttaagtcccgcaacgagcgcaacccttatgcttagttgccagcacgtaatgatgggcactctaagcagactgccggtgacaaaccggaggaaggtggggatgacgtcaaatcatcatgccccttatgacctgggctacacacgtactacaatggtcggtacaacgggaagcaaagccgcgaggtggagccaatccttaaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttgcaacacccgaagtcggtggggtaaccgcaaggagccagccgccgaa

SEQ ID NO: 322 - DNA, 1425 bp, Unknown
  Kingdom: Bacteria, Phylum: Proteobacteria
accatgcaagtcgaacggcagcacagaggagcttgctccttgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccatctggctaatacccgggtgggatgacggtacccaaagaataagcaccggctaacttcgtgccagcagccgcggtaatacgaagggtgcaagcgttactcggaattactgggcgtaaagcgtgcgtaggtggtcgtttaagtccgttgtgaaagcccctgggctcaacctgggaactgcagtggatactgggcgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggccttgacatgtcgagaactttccagagatggatcggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacggt

SEQ ID NO: 323 - DNA, 1423 bp, Unknown
  Kingdom: Bacteria, Phylum: Proteobacteria
ccatgcagtcgaacggcagcacagaggagcttgctccttgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccatctggctaatacccgggtgggatgacggtacccaaagaataagcaccggctaacttcgtgccagcagccgcggtaatacgaagggtgcaagcgttactcgggaattactgggcgtaaagcgtgcgtaggtggtcgtttaagtccgttgtgaaagccctgggctcaacctgggaactgcagtggatactgggcgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggccttgacatgtcgagaactttccagagatggatcggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgga

SEQ ID NO: 324 - DNA, 863 bp, Unknown
  Kingdom: Bacteria, Phylum: Firmicutes
  misc_feature (406)..(406): n is a, c, g, or t
aaaggttacctcaccgacttcgggtgttacaaactctcgtggtgtgacgggcggtgtgtacaaggcccgggaacgtattcaccgcggcatgctgatccgcgattactagcgattccggcttcatgtaggcgagttgcagcctacaatccgaactgagaacggttttatcggattagctccccctcgcgggttggcaaccgtttgtaccgtccattgtagcacgtgtgtagcccaggtcataaggggcatgatgatttgacgtcatccccaccttcctccggtttatcaccggcagtctccttagagtgcccaactgaatgatggcaactaagaataagggttgcgctcgttgcgggacttaacccaacatctcacgacacgagctgacgacaaccatgcaccaccngtcaccgttgcccccgaaggggaaactatgtctccatagtggtcaccgggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactgaggggcggaaaccccccaacacttagcactcatcgtttacggcgtggactaccagggtatctaatcctgtttgctccccacgctttcgcgcctcagtgtcagttacagaccagacagtcgccttcgccactggtgttcctccaaatctctacgcatttcaccgctacacttggaattccactatcctcttctgcactcaagttccccagtttccaatgaccctccccggttgagccgggggctttcacatcagacttaag

SEQ ID NO: 325 - DNA, 1433 bp, Unknown
  Kingdom: Bacteria, Phylum: Firmicutes
cctatacatgcagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtgggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaag

SEQ ID NO: 326 - DNA, 1442 bp, Unknown
  Kingdom: Bacteria, Phylum: Firmicutes
tatacatgcagtcgagcgaacttttgggagcttgctcccaaaagttagcggcggacgggtgagtaacacgtgggcaacctgcctataagactgggataacttcgggaaaccggagctaataccggataacatatgagaccacatggtctcatattaaaagatggcttttagctatcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggtcttcggatcgtaaagctctgttgttagggaagaacaagtaccgttcgaatagggcggtaccttgacggtacctaaccagaaagccacggctaactacgtgccagcagccgcggtaatacgtaggtggcaagcgttatccggaattatttgggcgtaaagcgcgcgcaggcggtcctttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaagcttaccaggtcttgacatccttattggcatttataagctcatagagctttcccccttcggggactaatgtgacagggtggagcatggttgtcgtcagctcgtgtcgagaaacatgttgggttaagtcccgcaacgaccgccaatcccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaaaccgcgaggttaagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaagg

SEQ ID NO: 327 - DNA, 1434 bp, Unknown
  Kingdom: Bacteria, Phylum: Firmicutes
ctatactgcaagtcgagcggagttaataagaagcttgcttctttgagacttagcggcggacgggtgagtaacacgtaggcaacctgccctttagcctgggataactaccggaaacggtagctaataccggatactttctttttctgcatgggagaagaacgaaagacggagcaatctgtcactgaaggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtcttggagagtaactgctccgagagtgacggtacctgagaagaaagccccggctaactacgtgccagcagccgcggtaatacgtagggggcaagcgttgtccggaattattgggcgtaaagcgcgcgcaggcggccgtttaagtccggtgtttaatcccgaagctcaacttcgggtcgcactggaaactggagggcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtgggagtatgtggtttaattcgaagcaacgcgaagaaccttaccaggtcttgacatctgaatgaccggtgcagagatgtacctttttcttcggaacattcaagacaggtggtgcatggttgtcgtcagctcgtgtcgtgagatgttgggttaagtcccgcaacgagcgcaacccttatgcttagttgccagcacgtgatgatgggcactctaagcagactgccggtgacaaaccggaggaaggtggggatgacgtcaaatcatcatgccccttatgacctgggctacacacgtactacaatggtcggtacaacgggaagcaaagccgcgaggtggagccaatccttaaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttgcaacacccgaagtcggtggggtaaccgcaaggagccagccgccgaag

SEQ ID NO: 328 - DNA, 1360 bp, Unknown
  Kingdom: Bacteria, Phylum: Proteobacteria
ccatgcagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtactcggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccactg

SEQ ID NO: 329 - DNA, 1427 bp, Unknown
  Kingdom: Bacteria, Phylum: Proteobacteria
accatgcagtcggacggtagcacagagagcttgctcttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacaatccctagctggtctgagaggatgaccagccacactggaactgagacacggtccagactcctacgggaggcagcagtggggaatattgcacaatgggcgcaagcctgatgcagccatgccgcgtgtatgaaaaaagccttcgggttgtaaagtactttcaccggggaggaaggcgactggggttaataaccctgtcgattgacgttacccgcagaaaaaacaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaacgcggccccctggacaaagactgacgctcacgtgcgaaagcgtggggagcaaacaggattagataccctggaagtccacgccgtaaacgatgtccacttgcaggttgttcccttgaggagtggcttccggagctaacgcgttaagtcgaccgcctgcggagtaccgccgcaaggtaaaaactcatatgaattgacgggggcccgcacaagcggtggagcatgtggtttaattccatgcaacgcgaagaaccttacctactcttgacatccacaggaatttggcagagatgcctttcttggccttctcggaaccgtgagacaggtgctgcatggctgtcgctcaactcctggtcatcacaaaacttgggttaacagccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccactgtg

SEQ ID NO: 330 - DNA, 1429 bp, Unknown
  Kingdom: Bacteria, Phylum: Firmicutes
tatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtcccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaa

SEQ ID NO: 331 - DNA, 1393 bp, Unknown
  Kingdom: Bacteria, Phylum: Firmicutes
acttgaagagaagcttgcttctctgatggttagcggcggacgggtgagtaacacgtaggcaacctgccctcaagcttgggacaactaccggaaacggtagctaataccgaatacttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaggcagagatgcgttaggtgcccttcggggaaagttgagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggcagcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaac

SEQ ID NO: 332 - DNA, 1429 bp, Unknown
  Kingdom: Bacteria, Phylum: Firmicutes
tacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtgggagcatgtgggtttaattcgaagcaacgcgaagaaccttaccaggtcttgacatcctctgacatccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgatgg

SEQ ID NO: 333 - DNA, 1418 bp, Unknown
  Kingdom: Bacteria, Phylum: Proteobacteria
cacatgcagtcgaacggtagcacagaggagcttgctcctcgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctggttggtgaggtaatggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgatacggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaattaggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccatag

SEQ ID NO: 334 - DNA, 1391 bp, Unknown
  Kingdom: Bacteria, Phylum: Actinobacteria
acatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccgggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaagggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagc

SEQ ID NO: 335 - DNA, 1362 bp, Unknown
  Kingdom: Bacteria, Phylum: Proteobacteria
cacatgcagtcgaacgagatcttcgggtctagtggcgcacgggtgcgtaacgcgtgggaatctgccctttggttcggaataacagttggaaacgactgctaataccggatgatgacgaaagtccaaagatttatcgccagaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttggggactctaaaggaaccgccggtgataagccggaggaaggtggggatgacgtcaagtcctcatggcccttacgcgctgggctacacacgtgctacaatggcggtgacagtgggcagcaaactcgcgagagtgcgctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccat

SEQ ID NO: 336 - DNA, 1423 bp, Unknown
  Kingdom: Bacteria, Phylum: Firmicutes
gtcgagcggagttgataaggaagcttgcttcttcttgagacttagcggcggacgggtgagtaacacgtaggcaacctgccctttagcctgggataactaccggaaacggtagctaataccggatactttctttttctgcatgggagaagaacgaaagacggagcaatctgtcactgaaggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttggagagtaactgctctgagagtgacggtacctgagaagaaagccccggctaactacgtgccagcagccgcggtaatacgtagggggcaagcgttgtccggaattattgggcgtaaagcgcgcgcaggcggccgtttaagtccggtgtttaatcccgaagctcaacttcgggtcgcactggaaactggagggcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatctgaatgaccggtgcagagatgtaccttttcttcggaacattcaagacaggtgctgcatggatgtcgtcagctcgtgtcgtgagatgttgggttaagtcccgcaacgagcgcaacccttatgcttagttgccagcacatgatggtgggcactctaagcagactgccggtgacaaaccggaggaaggtggggatgacgtcaaatcatcatgccccttatgacctgggctacacacgtactacaatggtcggtacaacgggaagcaaagccgcgaggtggagccaatccttaaaagccgatctcagttcggattgcaggctgcaactcgcctgcatgaagtcggaattgctagtaatcgcggatcagcatgccgcggtgaatacgttcccgggtcttgtacacaccgcccgtcacaccacgagagtttgcaacacccgaagtcggtggggtaaccgcaaggagccagccgcctaa

SEQ ID NO: 337 - DNA, 1389 bp, Unknown
  Kingdom: Bacteria, Phylum: Bacteroidetes
cacatgcagctgagcggtagagatctttcgggatcttgagagcggcgtacgggtgcggaacacgtgtgcaacctgcctttatcagagggatagcctttcgaaaggaagattaatacctcataatatattgattcgcatggattgatattgaaaactccggtggatagagatgggcacgcgcaagattagatagttggtgaggtaacggctcaccaagtcgatgatctttagggggcctgagagggtgatcccccacactggtactgagacacggaccagactcctacgggaggcagcagtgaggaatattggacaatgggttagcgcctgatccagccatcccgcgtgaaggacgacggccctatgggttgtaaacttcttttgtacagggataaacctttctacgtgtagaaagctgaaggtactgtacgaataagcaccggctaactccgtgccagcagccgcggtaatacggagggtgcaagcgttatccggatttattgggtttaaagggtccgtaggcggatctgtaagtcagtggtgaaatctcacagcttaactgtgaaactgccattgatactgcaggtcttgagtaaggtagaagtggctggaataagtagtgtagcggtgaaatgcatagatattacttagaacaccaattgcgaaggcaggtcactatgtcttaactgacgctgatggacgaaagcgtggggagcgaacaggattagataccctggtagtccacgccgtaaacgatgctaactcgtttttgggttttcggattcagagactaagcgaaagtgataagttagccacctggggagtacgttcgcaagaatgaaactcaaaggaattgacgggggcccgcacaagcggtggattatgtggtttaattcgatgatacgcgaggaaccttacgaaggcttaaatgggaattgacaggctcagaatagggtttttcttcggacaattttcaaggtgctgcatggttgtcgtcagctcgtgccgtgaggtgttaggttaagtcctgcaacgagcgcaacccctgtcactagttgccatcattcagttggggactctagtgagactgcctacgcaagtagagaggaaggtggggatgacgtcaaatcatcacggcccttacgccttgggccacacacgtaatacaatggcaggtacagagggcagctacacagcgatgtgatgcgaatctcgaaagcctgtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaaaaggagctgcc

SEQ ID NO: 338 - DNA, 1419 bp, Unknown
  Kingdom: Bacteria, Phylum: Firmicutes
atgcagtcgagcgaatggattaagagcttgctcttatgaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaagcttaccatggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccg

SEQ ID NO: 339 - DNA, 1350 bp, Unknown
  Kingdom: Bacteria, Phylum: Firmicutes
gtaggcaacctgccctcaagcttgggacaactaccggaaacggtagctaataccgaatacttgttttcttcgcctgaagggaactggaaagacggagcaatctgtcacttgaggatgggcctgcggcgcattagctagttggggaggtaacggctcaccaaggcgacgatgcgtagccgacctgagagggtgatcggccacactgggactgaaacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccaactaacgaggcagagatgcgttaggtgcccttcggggaaagttgagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagcca

SEQ ID NO: 340 - DNA, 1418 bp, Unknown
  Kingdom: Bacteria, Phylum: Firmicutes
agcagtcgagcggagttgatgggaaagcttgcttccctgagacttagcggcggacgggtgagtaacacgtaggcaacctgccctcaagcttgggacaactaccggaaacggtagctaataccgaatacttgttttcttcgcctgaagggaactggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccagggtcttgacatccaactaacgaggtagagatacgttaggtgcccttcggggaaagttgagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaactgcaaggagcc

SEQ ID NO: 341 - DNA, 1424 bp, Unknown
  Kingdom: Bacteria, Phylum: Firmicutes
tacatgcagtcgagcggacttaaaaagcttgctttttaagttagcggcggacgggtgagtaacacgtgggcaacctgcctgtaagactgggataacttcgggaaaccggagctaataccggataatcctttcctactcatgtaggaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaaccagaaagccacggctaactacgtgccagcagccgcggtaatacgtaggtggcaagcgttgtccgggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacccttctgggagccagccgcct

SEQ ID NO: 342 - DNA, 549 bp, Unknown
  Kingdom: Fungi, Phylum: Ascomycota
gcggagggatcattaccagagtgccctaggctctccaacccattgtgaacatacctaacgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcatat

SEQ ID NO: 343 - DNA, 1401 bp, Unknown
  Kingdom: Bacteria, Phylum: Proteobacteria
cagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctaccccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 344 - DNA, 549 bp, Unknown
  Kingdom: Fungi, Phylum: Ascomycota
cagcggagggatcattaccagagtgccctaggctctccaacccattgtgaacatacctatcgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcat

SEQ ID NO: 345 - DNA, 546 bp, Unknown
  Kingdom: Fungi, Phylum: Ascomycota
cggagggatcattaccagagtgccctaggctctccaacccattgtgaacatacctatcgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcat

SEQ ID NO: 346 - DNA, 537 bp, Unknown
  Kingdom: Fungi, Phylum: Ascomycota
cattaccagagtgccctaggctctccaacccattgtgaacatacctaacgttccctcggcgggctcagcgcgcggtgcctccgggctccgggcgtccgccggggacaaccaaaccctgatttcatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcat

SEQ ID NO: 347 - DNA, 1421 bp, Unknown
  Kingdom: Bacteria, Phylum: Firmicutes
gcaagtcgagcggacttaaaaagcttgctttttaagttagcggcggacgggtgagtaacacgtgggcaacctgcctgtaagactgggataacttcgggaaaccggagctaataccggataatccttttctactcatgtagaaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacccttctgggagccagccgcctat

SEQ ID NO: 348 - DNA, 1416 bp, Unknown
  Kingdom: Bacteria, Phylum: Proteobacteria
cacatgcagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatat

SEQ ID NO: 349 - DNA, 547 bp, Unknown
  Kingdom: Fungi, Phylum: Ascomycota
gcggagggatcattaccagagtgccctaggctctccaacccattgtgaacatacctatcgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcat

SEQ ID NO: 350 - DNA, 1407 bp, Unknown
  Kingdom: Bacteria, Phylum: Proteobacteria
tcgacggtacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgcccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtgggggagcaaacaggattagataccctggtagtccacgccgtaaacgatgtcgacttggaggttgtgcccttgaggcgtggcttccggagctaacgcgttaagtcgaccgcctggggagtacggccgcaagggttaaaactcaaatgaattgacgggggcccgcacaagcggtggagcatgtggtttaattcgatgcaacgcgaagaaccttacctggtcttgacatccacagaacttggcagagatgcaaaggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgatctcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctactc

SEQ ID NO: 351 - DNA, 1415 bp, Unknown
  Kingdom: Bacteria, Phylum: Proteobacteria
accatgcagtcgacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatggtttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatat

SEQ ID NO: 352 - DNA, 556 bp, Unknown
  Kingdom: Fungi, Phylum: Ascomycota
ggtgaaccagcggagggatcattaccagagtgccctaggctctccaacccattgtgaacatacctatcgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcat

SEQ ID NO: 353 - DNA, 1373 bp, Unknown
  Kingdom: Bacteria, Phylum: Proteobacteria
agaggagcttgctcctcgattcagcggcggacgggcgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaacta

SEQ ID NO: 354 - DNA, 1410 bp, Unknown
  Kingdom: Bacteria, Phylum: Proteobacteria
tgcagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccactag

SEQ ID NO: 355 - DNA, 1334 bp, Unknown
  Kingdom: Bacteria, Phylum: Proteobacteria
tggtgtgacgggcggtgtgtacaaggcccgggaacgtattcaccgcgacattctgattcgcgattactagcgattccgacttcacgcagtcgagttgcagactgcgatccggactacgatcggttttgtgagattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccttaacgtgctggtaactaaggacaagggttgcgctcgttacgggacttaacccaacatctcacgacacgagctgacgacagccatgcagcacctgtgtcagagttcccgaaggcaccaatccatctctggaaagttctctgcatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaaaatctcaaggattccaacggctagttgacatcgtttacggcgtggactaccagggtatctaatcctgtttgctccccacgctttcgcacctcagtgtcagtatcagtccaggtggtcgccttcgccactggtgttccttcctatatctacgcatttcaccgctacacaggaaattccaccaccctctaccgtactctagcttgccagttttggatgcagttcccaggttgagcccggggctttcacatccaacttaacaaaccacctacgcgcgctttacgcccagtaattccgattaacgcttgcaccctctgtattaccgcggctgctggcacagagttagccggtgcttattctgtcggtaacgtcaaaattgcagagtattaatctacaacccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattacctcaccaacaagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatccaggagcaagctccc

SEQ ID NO: 356 - DNA, 542 bp, Unknown
  Kingdom: Fungi, Phylum: Ascomycota
ctgcggagggatcattacacaaatatgaaggcgggctggaacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcata

SEQ ID NO: 357 - DNA, 542 bp, Unknown; identical to SEQ ID NO: 356
  Kingdom: Fungi, Phylum: Ascomycota

SEQ ID NO: 358 - DNA, 1365 bp, Unknown
  Kingdom: Bacteria, Phylum: Proteobacteria
cacatgcagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggcccctagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccactgta

SEQ ID NO: 359 - DNA, 506 bp, Unknown
  Kingdom: Fungi, Phylum: Ascomycota
ctgcggaaggatcattacctagagttgtaggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcata

SEQ ID NO: 360 - DNA, 531 bp, Unknown
  Kingdom: Fungi, Phylum: Ascomycota
aggtgaacctgcggagggatcattacaagtgaccccggtctaaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcatcgcggtccgccgcgtgcctcaaatcgaccggctgggtcttctgtcccctaagcgttgtggaaactattcgctaaagggtgttcgggaggctacgccgtaaaacaaccccatttctaaggttgacctcggatcaggtagggatacccgctgaacttaagcata

SEQ ID NO: 361 - DNA, 524 bp, Unknown
  Kingdom: Fungi, Phylum: Ascomycota
ggtgacctgcggagggatcattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccagcttggtgttgggactcgcgagtcaaatcgcgttccccaaattgattggcggtcacgtcgagcttccatagcgtagtagtaaaaccctcgttactggtaatcgtcgcggccacgccgttaaaccccaacttctgaatgttgacctcggatcaggtaggaatacccgctgaacttaagcata

SEQ ID NO: 362 - DNA, 548 bp, Unknown
  Kingdom: Fungi, Phylum: Ascomycota
  misc_feature (471)..(471): n is a, c, g, or t
  misc_feature (520)..(520): n is a, c, g, or t
gcggagggatcattaccagagtgccctaggctctccaacccattgtgaacatacctaacgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggntcgaccatgccgtaaaacccccaactttccaaggttgacctcggatcangtaggaatacccgctgaacttaagcata

SEQ ID NO: 363 - DNA, 514 bp, Unknown
  Kingdom: Fungi, Phylum: Ascomycota
acctgcggaggatcattacctagagttgtaggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcatatcaataa

SEQ ID NO: 364 - DNA, 547 bp, Unknown
  Kingdom: Fungi, Phylum: Ascomycota
ctgcggagggatcattacacaaatatgaaggcgggctggaacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcaat

SEQ ID NO: 365 - DNA, 1399 bp, Unknown
  Kingdom: Bacteria, Phylum: Proteobacteria
ggcagcacagaggagcttgctccttgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagccggctaatacctggttgggatgacggtacccaaagaataagcaccggctaacttcgtgccagcagccgcggtaatacgaagggtgcaagcgttactcggaattactgggcgtaaagcgtgcgtaggtggttatttaagtccgttgtgaaagcccctgggctcaacctgggaactgcagtggatactggatgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcagttagcttaaccttcgggagggcgc

SEQ ID NO: 366 - DNA, 1335 bp, Unknown
  Kingdom: Bacteria, Phylum: Proteobacteria
ttcgggagtcagcggcggacgggtgagtaacgcgtgggaacgtgccttccggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatcccgggacgataatgacggtaccgggaggaataagccccggctaacttcgtgcccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcagtc

SEQ ID NO: 367 - DNA, 1355 bp, Unknown
  Kingdom: Bacteria, Phylum: Proteobacteria
ttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtaga

SEQ ID NO: 368 - DNA, 1391 bp, Unknown
  Kingdom: Bacteria, Phylum: Bacteroidetes
cacatgcagctgagcggtatttgtctttcgggacagagagagcggcgtacgggtgcggaacacgtgtgcaacctgcctttatctgggggatagcctttcgaaaggaagattaataccccataatataattgatggcatcattgattattgaaaactccggtggatagagatgggcacgcgcaagattagatagttggtgaggtaacggctcaccaagtcgatgatctttagggggcctgagagggtgatcccccacactggtactgagacacggaccagactcctacgggaggcagcagtgaggaatattggacaatgggttagcgcctgatccagccatcccgcgtgaaggacgacggccctatgggttgtaaacttcttttgtacagggataaacctaccctcgtgagggtagctgaaggtactgtacgaataagcaccggctaactccgtgccagcagccgcggtaatacggagggtgcaagcgttatccggatttattgggtttaaagggtccgtaggcggatctgtaagtcagtggtgaaatctcacagcttaactgtgaaactgccattgatactgcaggtcttgagtaaggtagaagtggctggaataagtagtgtagcggtgaaatgcatagatattacttagaacaccaattgcgaaggcaggtcactatgtcttaactgacgctgatggacgaaagcgtggggagcgaacaggattagataccctggtagtccacgccgtaaacgatgctaactcgtttttgggtctttaagattcagagactaagcgaaagtgataagttagccacctggggagtacgttcgcaagaatgaaactcaaaggaattgacgggggcccgcacaagcggtggattatgtggtttaattcgatgatacgcgaggaaccttaccaaggcttaaatgggaattgaccggtttagaaatagaccttccttcgggcaattttcaaggtgctgcatggttgtcgtcagctcgtgccgtgaggtgttaggttaagtcctgcaacgagcgcaacccctgttactagttgctaccattcagttgaggactctagtaagactgcctacgcaagtagagaggaaggtggggatgacgtcaaatcatcacggcccttacgccttgggccacacacgtaatacaatggccggtacagagggcagctacctagcgataggatgcgaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaaaaggagctgcct

SEQ ID NO: 369 - DNA, 1335 bp, Unknown
  Kingdom: Bacteria, Phylum: Proteobacteria
gatgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtagg

SEQ ID NO: 370 - DNA, 762 bp, Unknown
  Kingdom: Bacteria, Phylum: Proteobacteria
gcctgcctccttgcggttggcgcagcgccgtcgggtaagaccaactcccatggtgtgacgggcggtgtgtacaaggcccgggaacgtattcaccgtggcatgctgatccacgattactagcgattccgccttcatgcacccgagttgcagagtgcaatccgaactgagacggcttttggggattcgctccaggtcgccccttcgctgcccattgtcaccgccattgtagcacgtgtgtagcccatcccgtaagggccatgaggacttgacgtcatccacaccttcctcgcggcttatcaccggcagtctccccagagtgcccaactgaatgatggcaactgaggacgtgggttgcgctcgttgcgggacttaacccaacatctcacgacacgagctgacgacagccatgcagcacctgtgtgcacgtccccgaagggaacaccggatctctccggctcgcatgccatgtcaagggatggtaaggttctgcgcgttgcttcgaattaaaccacatgctccaccgcttgtgcgggcccccgtcaattcctttgagttttaatcttgcgaccgtactccccaggcggaatgcgtaaagcgttagcggcgccactgaggtgcatgcaccccaacggctagcattcatcgtttacagcgtggactaccagggtatctaatcctgtttgctccccacgctttcgcgcctcagcgtcagaaccggaccagacagccgccttcgccactggtgttcttgcgaatatctac

SEQ ID NO: 371 - DNA, 1406 bp, Unknown
  Kingdom: Bacteria, Phylum: Proteobacteria
taccatgcagtcgaacggtaacaggtcttcggatgctgacgagtggcgaacgggtgagtaatacatcggaacgtgcccgatcgtgggggataacgaggcgaaagctttgctaataccgcataagatctatggatgaaagcaggggaccgcaaggccttgcgcgaacggagcggccgatggcagattaggtagttggtggggtaaaggcttaccaagcctacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaagccttcttctaataaagggaggtcatgacggtaccgtaagaataagcaccggctaactacgtgccagcagccgcggtaatacgtagggtgcaagcgttaatcggaattactgggcgtaaagcgtgcgcaggcggtgatgtaagacagatgtgaaatccccgggctcaacctgggaactgcatttgtgactgcatcgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagaaccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacagagggttgccaacccgcgagggggagctaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtaggtagcctaaccgtaaggagggcgctaccacta

SEQ ID NO: 372 - DNA, 1337 bp, Unknown
  Kingdom: Bacteria, Phylum: Proteobacteria
gacagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaacctgc

SEQ ID NO: 373 - DNA, 1406 bp, Unknown
  Kingdom: Bacteria, Phylum: Proteobacteria
cgtacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttgcagagatggtttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 374 - DNA, 549 bp, Unknown
  Kingdom: Fungi, Phylum: Ascomycota
gcggagggatcattaccagagtgccctaggctctccaacccattgtgaacatacctatcgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcatat

SEQ ID NO: 375 - DNA, 519 bp, Unknown
  Kingdom: Fungi, Phylum: Ascomycota
gcggagggatcattaccgagtttacaactcccaaacccctgtgaacatacctttatgttgcctcggcggatcagcccgcgccccgtaaaacgggacggcccgccgcaggaaaccctaaactctgtttttagtggaacttctgagtataaaaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccagcttggtgttgggatctgtttgtcacaaaacagtcctcaaattgattggcggtcacgtcgagcttccatagcgtagtaatttacacatcgttactggtaatcgtcgcggccacgccgttaaaccccaacttctgaatgttgacctcggatcaggtaggaatacccgctgaacttaagcatat

SEQ ID NO: 376 - DNA, 491 bp, Unknown
  Kingdom: Fungi, Phylum: Ascomycota
tgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatc

SEQ ID NO: 377 - DNA, 516 bp, Unknown
  Kingdom: Fungi, Phylum: Ascomycota
gcggagggatcattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccagcttggtgttgggactcgcgagtcaaatcgcgttccccaaattgattggcggtcacgtcgagcttccatagcgtagtagtaaaaccctcgttactggtaatcgtcgcggccacgccgttaaaccccaacttctgaatgttgacctcggatcaggtaggaatacccgctgaacttaagcata

SEQ ID NO: 378 - DNA, 510 bp, Unknown
  Kingdom: Fungi, Phylum: Ascomycota
cccattgtgaacatacctatcgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcagggccccctttcgggggggacctggtgctggggatcagcggccctcgggcccctgtcccccaaatacagtggcggtcgcgccgcagcctcccctgcgtagtagcacacctcgcaccggagagcggttcgaccacgccgtaaaacccccaactttccaaggttgacctcggatcaggtaggaatacccgctgaacttaagcata

SEQ ID NO: 379 - DNA, 536 bp, Unknown
  Kingdom: Fungi, Phylum: Ascomycota
  misc_feature (3)..(3): n is a, c, g, or t
  misc_feature (18)..(18): n is a, c, g, or t
  misc_feature (22)..(22): n is a, c, g, or t
cgnaggtgacctgcggangganattacaagtgaccccggtctaaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgttcgggaggctacgccgtaaaacaaccccatttctaaggttgacctcggatcaggtagggatacccgctgaacttaagcatatcaa

SEQ ID NO: 380 - DNA, 549 bp, Unknown
  Kingdom: Fungi, Phylum: Ascomycota
  misc_feature (19)..(19): n is a, c, g, or t
aggtgacctgcggaggganattacacaaatatgaaggcgggctggaacctcttggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatat

SEQ ID NO: 381 - DNA, 551 bp, Unknown
  Kingdom: Fungi, Phylum: Ascomycota
  misc_feature (19)..(19): n is a, c, g, or t
aggtgacctgcggaggganattacacaaatatgaaggcgggctggaacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatca

SEQ ID NO: 382 - DNA, 530 bp, Unknown
  Kingdom: Fungi, Phylum: Ascomycota
  misc_feature (19)..(19): n is a, c, g, or t
aggtgacctgcggaggganattacaagtgaccccggtctaaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgttcgggaggctacgccgtaaaacaaccccatttctaaggttgacctcggatcaggtagggatacccgctgaacttaagcatat

SEQ ID NO: 383 - DNA, 554 bp, Unknown
  Kingdom: Fungi, Phylum: Ascomycota
  misc_feature (4)..(4): n is a, c, g, or t
  misc_feature (19)..(19): n is a, c, g, or t
tcgnaggtgacctgcgganggatcattacacaaatatgaaggcgggctggaacctcttggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatat

SEQ ID NO: 384 - DNA, 575 bp, Unknown
  Kingdom: Fungi, Phylum: Ascomycota
  misc_feature (18)..(18): n is a, c, g, or t
ggtgacctgcggaggganattacacaataaccaggcgggctggacaccccccgctgggcactgcttcacggcgtgcgcggcggggccggccctgctgaattattcacccgtgtcttttgcgtacttcttgtttcctgggtgggctcgcccgccctcaggaccaaccacaaaccttttgcaatagcaatcagcgtcagtaacaacgtaattaattacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccctcaagctttgcttggtgttgggcgtcttttgtctccagttcgctggagactcgccttaaagtcattggcagccggcctactggtttcggagcgcagcacaagtcgcgctctttgccagccaaggtcagcgtccagcaagcctttttttcaacctttgacctcggatcaggtagggatacccgctgaacttaagcat

SEQ ID NO: 385 - DNA, 1038 bp, Unknown
  Kingdom: Fungi, Phylum: Ascomycota
acctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcaataagcggaggaaaagaaaccaacagggattgccctagtaacggcgagtgaagcggcaacagctcaaatttgaaatctggctcttttagagtccgagttgtaatttgcagagggcgctttggctttggcagcggtccaagttccttggaacaggacgtcacagagggtgagaatcccgtacgtggtcgctggctattgccgtgtaaagccccttcgacgagtcgagttgtttgggaatgcagctctaaatgggaggtacatttcttctaaagctaaatattggccagagaccgatagcgcacaagtagagtgatcgaaagatgaaaagcactttggaaagagagtcaaacagcacgtgaaattgttgaaagggaagcgcttgcagccagacttgcttacagttgctcatccgggtttctacccggtgcactcttctgtaggcaggccagcatcagtttgggcggtaggataaaggtctctgtcacgtacctcctttcggggaggccttataggggagacgacatactaccagc

SEQ ID NO: 386 - DNA, 1033 bp, Unknown
  Kingdom: Fungi, Phylum: Ascomycota
tacagagttatccaactcccaaacccatgtgaacttatctctttgttgcctcggcgcaagctacccgggacccagcgccccgggcggcccgccggcggacaaaccaaactcttgttatcttagttgattatctgagcgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttactgttgggactctacggcctccgtagttccctaatgcgattggcggagtggcagtagtcctctgagcgtagtaattctttatctcgcttttgttaggtgctgcccccccggccgttaaacccccaattttttctggttgacctcggatcaggtaggaatacccgctgaacttaagcatatcaataagcggaggaaaagaaaccaacagggattcccctagtaacggcgagtgaagcgggaacagctcaaatttgaaatctggccctcgggtccgagttgtaatttgtagaggatgcttttggtgcggtgccttccgagttccctggaacgggacgccttagagggtgagagccccgtacggttggacgcctagcctctgtaaagctccttcgacgagtcgagtagtttgggaatgctgctctaaatgggaggtatatttcttctaaagctaaatactggccagagaccgatagcgcacaagtagagtgatcgaaagatgaaaagcactttgaaaagagggttaaatagcacgtgaaattgttgaaagggaagcgtttatcaccagactttttctggggggatcatccggtgttctcaccggtgcacttcccccagttgaggccagcatcggttttcggagggggataaaagcttcgggaatgtggctccctcgggagtgttatagcccgttgcataatac

SEQ ID NO: 387 - DNA, 1001 bp, Unknown
  Kingdom: Fungi, Phylum: Ascomycota
acttatctctttgttgcctcggcgcaagctacccgggacccagcgccccgggcggcccgccggcggacaaaccaaactcttgttatcttagttgattatctgagcgtcttatttaataagtcaaaactttcaacaacggatctcttggttctggcatcgatgaagaacgcagcgaaatgcgataagtaatgtgaattgcagaattcagtgaatcatcgaatctttgaacgcacattgcgcccattagtattctagtgggcatgcctgttcgagcgtcatttcaacccctaagcacagcttactgttgggactctacggcctccgtagttccctaatgcgattggcggagtggcagtagtcctctgagcgtagtaattctttatctcgcttttgttaggtgctgcccccccggccgttaaacccccaattttttctggttgacctcggatcaggtaggaatacccgctgaacttaagcatatcaataagcggaggaaaagaaaccaacagggattcccctagtaacggcgagtgaagcgggaacagctcaaatttgaaatctggccctcgggtccgagttgtaatttgtagaggatgcttttggtgcggtgccttccgagttccctggaacgggacgccttagagggtgagagccccgtacggttggacgcctagcctctgtaaagctccttcgacgagtcgagtagtttgggaatgctgctctaaatgggaggtatatttcttctaaagctaaatactggccagagaccgatagcgcacaagtagagtgatcgaaagatgaaaagcactttgaaaagagggttaaatagcacgtgaaattgttgaaagggaagcgtttatcaccagactttttctggggggatcatccggtgttctcaccggtgcacttcccccagttgaggccagcatcggttttcggagggggataaaagcttcgggaatgtggctccctcgggagtgttatagcccgttgcataatac

SEQ ID NO: 388 - DNA, 994 bp, Unknown
  Kingdom: Fungi, Phylum: Ascomycota
acatacctatacgttgcctcggcggatcagcccgcgccccgtaaaaagggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagcggaggaaaagaaaccaacagggattgccctagtaacggcgagtgaagcggcaacagctcaaatttgaaatctggctctcgggcccgagttgtaatttgtagaggatgcttttgatgcggtgccttccgagttccctggaacgggacgccatagagggtgagagccccgtctggttggatgccaaatctctgtaaagctccttcgacgagtcgagtagtttgggaatgctgctctaaatgggaggtatatgtcttctaaagctaaataccggccagagaccgatagcgcacaagtagagtgatcgaaagatgaaaagcactttgaaaagagagttaaaaagtacgtgaaattgttgaaagggaagcgtttatgaccagacttgggcttggttaatcatctggggttctccccagtgcacttttccagtccaggccagcatcagttttcgccgggggataaaggcttcgggaatgtggctctctccggggagtgttatagcccgttgcgtaatac

SEQ ID NO: 389 - DNA, 994 bp, Unknown; identical to SEQ ID NO: 388
  Kingdom: Fungi, Phylum: Ascomycota

SEQ ID NO: 390 - DNA, 1005 bp, Unknown
  Kingdom: Fungi, Phylum: Ascomycota
actaccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatcaataagcggaggaaaagaaaccaacagggattgccctagtaacggcgagtgaagcggcaacagctcaaatttgaaatctggctctcgggcccgagttgtaatttgtagaggatacttttgatgcggtgccttccgagttccctggaacgggacgccatagagggtgagagccccgtctggttggatgccaaatctctgtaaagttccttcgacgagtcgagtagtttgggaatgctgctctaaatgggaggtatatgtcttctaaagctaaataccggccagagaccgatagcgcacaagtagagtgatcgaaagatgaaaagcactttgaaaagagagttaaaaagtacgtgaaattgttgaaagggaagcgtttatgaccagacttgggcttggttaatcatctggggttctccccagtgcacttttccagtccaggccagcatcagttttccccgggggataaagacttcgggaatgtggctctcttcggggagtgttatagcccgttgtgtaatac

SEQ ID NO: 391 - DNA, 994 bp, Unknown; identical to SEQ ID NO: 388
  Kingdom: Fungi, Phylum: Ascomycota

SEQ ID NO: 392 - DNA, 994 bp, Unknown; identical to SEQ ID NO: 388
  Kingdom: Fungi, Phylum: Ascomycota

SEQ ID NO: 393 - DNA, 1005 bp, Unknown
  Kingdom: Fungi, Phylum: Ascomycota
acataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccccgggtttggtgttggggatcggcgagcctcacggcaagccggccccgaaatacagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatcaataagcggaggaaaagaaaccaacagggattgccctagtaacggcgagtgaagcggcaacagctcaaatttgaaatctggctctcgggcccgagttgtaatttgtagaggatacttttgatgcggtgccttccgagttccctggaacgggacgccatagagggtgagagccccgtctggttggatgccaaatctctgtaaagttccttcgacgagtcgagtagtttgggaatgctgctctaaatgggaggtatatgtcttctaaagctaaataccggccagagaccgatagcgcacaagtagagtgatcgaaagatgaaaagcactttgaaaagagagttaaaaagtacgtgaaattgttgaaagggaagcgtttatgaccagacttgggcttggttaatcatctggggttctccccagtgcacttttccagtccaggccagcatcagttttcgccgggggataaagacttcgggaatgtggctctcttcggggagtgttatagcccgttgtgtaatac

SEQ ID NO: 394 - DNA, 992 bp, Unknown
  Kingdom: Fungi, Phylum: Ascomycota
aatacctatacgttgcctcggcggatcagcccgcgccccgtaaaaagggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagcggaggaaaagaaaccaacagggattgccctagtaacggcgagtgaagcggcaacagctcaaatttgaaatctggctctcgggcccgagttgtaatttgtagaggatgcttttgatgcggtgccttccgagttccctggaacgggacgccatagagggtgagagccccgtctggttggatgccaaatctctgtaaagctccttcgacgagtcgagtagtttgggaatgctgctctaaatgggaggtatatgtcttctaaagctaaataccggccagagaccgatagcgcacaagtagagtgatcgaaagatgaaaagcactttgaaaagagagttaaaaagtacgtgaaattgttgaaagggaagcgtttatgaccagacttgggcttggttaatcatctggggttctccccagtgcacttttccagtccaggccagcatcagttttcgccgggggataaaggcttcgggaatgtggctctctccggggagtgttatagcccgttgcgtatac

SEQ ID NO: 395 - DNA, 994 bp, Unknown
  Kingdom: Fungi, Phylum: Ascomycota
acatacctatacgttgcctcggcggatcagcccgcgccccgtaaaacgggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagcggaggaaaagaaaccaacagggattgccctagtaacggcgagtgaagcggcaacagctcaaatttgaaatctggctctcgggcccgagttgtaatttgtagaggatgcttttgatgcggtgccttccgagttccctggaacgggacgccatagagggtgagagccccgtctggttggatgccaaatctctgtaaagctccttcgacgagtcgagtagtttgggaatgctgctctaaatgggaggtatatgtcttctaaagctaaataccggccagagaccgatagcgcacaagtagagtgatcgaaagatgaaaagcactttgaaaagagagttaaaaagtacgtgaaattgttgaaagggaagcgtttatgaccagacttgggcttggataatcatctggggttctctccagtgcacttttccagtccaggccagcatcagttttcgccgggggataaaggcttcgggaatgtggctctctccggggagtgttatagcccgttgcgtaatac

SEQ ID NO: 396 - DNA, 1014 bp, Unknown
  Kingdom: Fungi, Phylum: Ascomycota
agtgaccccggtctaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgttcgggaggctacgccgtaaaacaaccccatttctaaggttgacctcggatcaggtagggatacccgctgaacttaagcatatcaataagcggaggaaaagaaaccaacagggattgctctagtaacggcgagtgaagcagcaatagctcaaatttgaaatctggcgtcttcgacgtccgagttgtaatttgtagaggatgcttctgagtaaccaccgacctaagttccttggaacaggacgtcatagagggtgagaatcccgtatgcggtcggaaaggtgctctatacgtagctccttcgacgagtcgagttgtttgggaatgcagctctaaatgggaggtaaatttcttctaaagctaaatattggccagagaccgatagcgcacaagtagagtgatcgaaagatgaaaagcactttggaaagagagttaaaaagcacgtgaaattgttaaaagggaagggattgcaaccagacttgctcgcggtgttccgccggtcttctgaccggtctactcgccgcgttgcaggccagcatcgtctggtgccgctggataagacttgaggaatgtagctccctcgggagtgttatagc

SEQ ID NO: 397 - DNA, 994 bp, Unknown; identical to SEQ ID NO: 388
  Kingdom: Fungi, Phylum: Ascomycota

SEQ ID NO: 398 - DNA, 994 bp, Unknown; identical to SEQ ID NO: 388
  Kingdom: Fungi, Phylum: Ascomycota

SEQ ID NO: 399 - DNA, 1064 bp, Unknown
  Kingdom: Fungi, Phylum: Ascomycota
attacacaaatatgaaggcgggctggaacctctcggggttcagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcaataagcggaggaaaagaaaccaacagggattgccctagtaacggcgagtgaagcggcaacagctcaaatttgaaatctggctcttttagagtccgagttgtaatttgcagagggcgctttggctttggcagcggtccaagttccttggaacaggacgtcacagagggtgagaatcccgtacgtggtcgctggctattgccgtgtaaagccccttcgacgagtcgagttgtttgggaatgcagctctaaatgggaggtacatttcttctaaagctaaatattggccagagaccgatagcgcacaagtagagtgatcgaaagatgaaaagcactttggaaagagagtcaaacagcacgtgaaattgttgaaagggaagcgcttgcagccagacttgcttacagttgctcatccgggtttctacccggtgcactcttctgtaggcaggccagcatcagtttgggcggtaggataaaggtctctgtcacgtacctcctttcggggaggccttataggggagacgacatactaccagc

SEQ ID NO: 400 - DNA, 1046 bp, Unknown
  Kingdom: Fungi, Phylum: Ascomycota
atatgaaggcgggctggaacctctcggggttacagccttgctgaattattcacccttgtcttttgcgtacttcttgtttccttggtgagttcgcccaccactaggacaaacataaaccttttgtaattgcaatcagcgtcagtaacaaattaataattacaactttcagagcaacggatctcttggattcatggcatcgatgaagaacgcagtcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgctttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcaataagcggaggaaaagaaaccaacagggattgccctagtaacggcgagtgaagcggcaacagctcaaatttgaaatctggctcttttagagtccgagttgtaatttgcagagggcgctttggctttggcagcggtccaagttccttggaacaggacgtcacagagggtgagaatcccgtacgtggtcgctggctattgccgtgtaaagccccttcgacgagtcgagttgtttgggaatgcagctctaaatgggaggtacatttcttctaaagctaaatattggccagagaccgatagcgcacaagtagagtgatcgaaagatgaaaagcactttggaaagagagtcaaacagcacgtgaaattgttgaaagggaagcgcttgcagccagacttgcttacagttgctcttctcgggtttttatccggtgcactcttctgtaggcaggccagcatcagtttgggcggtaggataaaggtctttgtcaggtacctcctttcggggaggcgttataggggag

SEQ ID NO: 401 - DNA, 994 bp, Unknown; identical to SEQ ID NO: 388
  Kingdom: Fungi, Phylum: Ascomycota

SEQ ID NO: 402 - DNA, 1032 bp, Unknown
  Kingdom: Fungi, Phylum: Ascomycota
ttaccgagtttaaactcccaaacccctgtgaacatacctatacgttgcctcggcggatcagcccgcgccccgtaaaaagggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagcggaggaaaagaaaccaacagggattgccctagtaacggcgagtgaagcggcaacagctcaaatttgaaatctggctctcgggcccgagttgtaatttgtagaggatgcttttgatgcggtgccttccgagttccctggaacgggacgccatagagggtgagagccccgtctggttggatgccaaatctctgtaaagctccttcgacgagtcgagtagtttgggaatgctgctctaaatgggaggtatatgtcttctaaagctaaataccggccagagaccgatagcgcacaagtagagtgatcgaaagatgaaaagcactttgaaaagagagttaaaaagtacgtgaaattgttgaaagggaagcgtttatgaccagacttgggcttggttaatcatctggggttctccccagtgcacttttccagtccaggccagcatcagttttcgccgggggataaaggcttcgggaatgtggctctctccggggagtgttatagcccgttgcgtaataccctggcg

SEQ ID NO: 403 - DNA, 151 bp, Unknown
  Kingdom: Fungi, Phylum: Ascomycota
gtaggtgaacctgcggaaggatcattacctagagttgtaggctttgcctgctatctcttacccatgtcttttgagtaccttcgtttcctcggcgggtccgcccgccgattggacaatttaaaccatttgcagttgcaatcagcgtctgaaa

SEQ ID NO: 404 - DNA, 151 bp, Unknown
  Kingdom: Fungi, Phylum: Ascomycota
gtaggtgaacctgcggaaggatcattaaattcagtagcttgctactgttaggggggtctattagtctgtatagtatcactactgatgagcagcacgaccctctgtctatacccttgtcttttgcgcactcatgtttcctcggcggctttat

SEQ ID NO: 405 - DNA, 151 bp, Unknown
  Kingdom: Fungi, Phylum: Ascomycota
gtaggtgaacctgcggaaggatcattacctagagtttgtggacttcggtctgctacctcttacccatgtcttttgagtaccttcgtttcctcggcgggtccgcccgccgggtggacaacattcaaacccttttcagtttcaatcagcgtct

SEQ ID NO: 406 - DNA, 151 bp, Unknown
  Kingdom: Fungi, Phylum: Ascomycota
gtaggtgaacctgcggaaggatcattacagagttcatgcccgaaagggtagacctcccacccttgtgtattattactttgttgctttggcgagctgcctttgggccttgtatgctcgccagagaataccaaaactctttttattaatgtcg

SEQ ID NO: 407 - DNA, 151 bp, Unknown
  Kingdom: Fungi, Phylum: Ascomycota
gtaggtgaacctgcggaaggatcattacctagagttgtaggctttgcctaccatctcttacccatgtcttttgagtaccttcgtttcctcggcgggtccgcccgccgattggacaaacttaaaccctttgtaattgaaatcagcgtctgaa

SEQ ID NO: 408 - DNA, 151 bp, Unknown
  Kingdom: Fungi, Phylum: Ascomycota
gtaggtgaacctgcggaaggatcattaaattcagtagcttgctactgttaaggagggtctattagtctgtatagtatcactactgatgagcagcacgaccctctgtctatactcttgtcttttgcgcactcatgtttcctcggcggctcga

SEQ ID NO: 409 - DNA, 151 bp, Unknown
  Kingdom: Fungi, Phylum: Ascomycota
gtaggtgaacctgcggaaggatcattacattcagtcgcctagctacttgtttacacccttgtttttttgcgtacctattgtttcctcggtgggcttgcctgccggttggacaaaacctataacctttttaaatcttcaatcagcgtctgaa

SEQ ID NO: 410 - DNA, 151 bp, Unknown
  Kingdom: Fungi, Phylum: Ascomycota
gtaggtgaacctgcggaaggatcatcacctagagtttgtggacttcggtctgctacctcttacccatgtcttttgagtaccttcggttcctcggcgggtccgcccgccggttggacaacattcaaaccctttgcagttgcaatccgcgtct

SEQ ID NO: 411 - DNA, 151 bp, Unknown
  Kingdom: Fungi, Phylum: Ascomycota
gtaggtgaacctgcggaaggatcattaccgagtgcgggctgcctccgggcgcccaacctcccacccgtgactacctaacactgttgcttcggcggggagccctttcgggggcgagccgccggggactactgaacttcatgcctgagagtga

SEQ ID NO: 412 - DNA, 151 bp, Unknown
  Kingdom: Fungi, Phylum: Ascomycota
gtaggtgaacctgcggaaggatcattaccgagagttgtaggcttctgtctaccatctcttacccatgtcttttgcgtacttaacgtttcctcggcaggtccgcctgccgtaggacaattataaaccatttgcagttgcagtcagcgtctga

SEQ ID NO: 413 - DNA, 531 bp, Unknown
  Kingdom: Fungi, Phylum: Ascomycota
attaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatcaataagcggagg

SEQ ID NO: 414 - DNA, 534 bp, Unknown
  Kingdom: Fungi, Phylum: Ascomycota
tcattaccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaatgttgacctcggatcaggtaggaatacccgctgaacttaagcatatcaataagcggagga

SEQ ID NO: 415 - DNA, 958 bp, Unknown
  Kingdom: Fungi, Phylum: Ascomycota
aaccctttgatttccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgtccggctgggtcttctgtcccctaagcgttgtggaaactattcgctaaagggtgttcgggaggctacgccgtaaaacaaccccatttctaaggttgacctcggatcaggtagggatacccgctgaacttaagcatatcaataagcggaggaaaagaaaccaacagggattgctctagtaacggcgagtgaagcagcaatagctcaaatttgaaatctggcgtcttcgacgtccgagttgtaatttgtagaggatgcttctgagtggccaccgacctaagttccttggaacaggacgtcatagagggtgagaatcccgtatgcggtcggaaaggcgctctatacgtagctccttcgacgagtcgagttgtttgggaatgcagctctaaatgggaggtaaatttcttctaaagctaaatattggccagagaccgatagcgcacaagtagagtgatcgaaagatgaaaagcactttggaaagagagttaaaaagcacgtgaaattgttaaaagggaagggattgcaaccagacttgctcgcggtgttccgccggtcttctgaccggtctactcgccgcgttgcaggccagcatcgtctggtgccgctggataagacttgaggaat

SEQ ID NO: 416 - DNA, 905 bp, Unknown
  Kingdom: Fungi, Phylum: Ascomycota
ggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgtccggctgggtcttctgtcccctaagcgttgtggaaactattcgctaaagggtgttcgggaggctacgccgtaaaacaaccccatttctaaggttgacctcggatcaggtagggatacccgctgaacttaagcatatcaataagcggaggaaaagaaaccaacagggattgctctagtaacggcgagtgaagcagcaatagctcaaatttgaaatctggcgtcttcgacgtccgagttgtaatttgtagaggatgcttctgagtggccaccgacctaagttccttggaacaggacgtcatagagggtgagaatcccgtatgcggtcggaaaggcgctctatacgtagctccttcgacgagtcgagttgtttgggaatgcagctctaaatgggaggtaaatttcttctaaagctaaatattggccagagaccgatagcgcacaagtagagtgatcgaaagatgaaaagcactttggaaagagagttaaaaagcacgtgaaattgttaaaagggaagggattgcaaccagacttgctcgcggtgttccgccggtcttctgaccggtctactcgccgcgttgcaggccagcatcgtctggtgccgctggataagacttga

SEQ ID NO: 417 - DNA, 990 bp, Unknown
  Kingdom: Fungi, Phylum: Ascomycota
tccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgttcgggaggctacgccgtaaaacaaccccatttctaaggttgacctcggatcaggtagggatacccgctgaacttaagcatatcaataagcggaggaaaagaaaccaacagggattgctctagtaacggcgagtgaagcagcaatagctcaaatttgaaatctggcgtcttcgacgtccgagttgtaatttgtagaggatgcttctgagtaaccaccgacctaagttccttggaacaggacgtcatagagggtgagaatcccgtatgcggtcggaaaggtgctctatacgtagctccttcgacgagtcgagttgtttgggaatgcagctctaaatgggaggtaaatttcttctaaagctaaatattggccagagaccgatagcgcacaagtagagtgatcgaaagatgaaaagcactttggaaagagagttaaaaagcacgtgaaattgttaaaagggaagggattgcaaccagacttgctcgcggtgttccgccggtcttctgaccggtctactcgccgcgttgcaggccagcatcgtctggtgccgctggataagacttgaggaatgtagctccctcgggagtgttatagcctcttgtgatgcagcgagc

SEQ ID NO: 418 - DNA, 151 bp, Unknown
  Kingdom: Fungi, Phylum: Basidiomycota
gtaggtgaacctgcggaaggatcattagtgattaattattgagtgtaaaaaactcataatcttctacaaaccactgttttaaatgtttactagaatgtccaagcagttaagctgttgaaatattaaaagttttataaaactttcagcaacg

SEQ ID NO: 419 - DNA, 151 bp, Unknown
  Kingdom: Fungi, Phylum: Basidiomycota
gtaggtgaacctgcggaaggatcattagtgaataaatagggtgtccaatttaacttggaacccgaccttctcacatctaaccctgtgcatctgtattaatggcgagcaattttcggattgtgagccatttcactttataaacactagtcta

SEQ ID NO: 420 - DNA, 151 bp, Unknown
  Kingdom: Fungi, Phylum: Basidiomycota
gtaggtgaacctgcggaaggattattagtgattaattattgagtgtagaaactcataatcttctatacaaaccactgttttaaaatgtttactagaatgtccaaacagttaagctgttgaaattataaaagtttaataaaactttcagcaa

SEQ ID NO: 421 - DNA, 151 bp, Unknown
  Kingdom: Fungi, Phylum: Basidiomycota
gtaggtgaacctgcggaaggatcactaaggtaaacgccctccggggctctctttattcacacacccctgtgcactttggccacctgccgcgcttaactgcgttagtaggtgtgtctctttatttatacccatatacacaagtcattgaatg

SEQ ID NO: 422 - DNA, 151 bp, Unknown
  Kingdom: Fungi, Phylum: Basidiomycota
gtaggtgaacctgcggaaggatcattagtgattaattattgagtgtaaaaactcataatcttctattacaaaccactgttttaaaatgtttactagaatgtccaagcagttaagctgttaaaattataaaagtttaataaaactttcagca

SEQ ID NO: 423 - DNA, 151 bp, Unknown
  Kingdom: Fungi, Phylum: Basidiomycota
gtaggtgaacctgcggaaggatcattaatgaaaatgtgttgccggggcccataatcccggcactaaccttcttatccataacacctgtgcactgttggatgcttgcatccacttttatactaaacaatttgtaacaaatgtagtcttatta

SEQ ID NO: 424 - DNA, 151 bp, Unknown
  Kingdom: Fungi, Phylum: Basidiomycota
gtaggtgaacctgcggaaggatcattagtgaataaatagggtgtccaatttaacttggaacccgaccttctcacatccaaccctgtgcatctgtatttaacggcgagcaatttccgaattgtgagccatttcactttataaacactagtct

SEQ ID NO: 425 - DNA, 151 bp, Unknown
  Kingdom: Fungi, Phylum: Basidiomycota
gtaggtgaacctgcggaaggatcattaatagtgctctctgatgcaaatcattgagttagatctgctctcctcgcaagaggagggtttccatacacaccgtgaattgtggcttcggccatcacaaactgttagtaatgaatgtaatatcata

SEQ ID NO: 426 - DNA, 1377 bp, Unknown
  Kingdom: Bacteria, Phylum: Proteobacteria
tagcaatcctggtggcgagtggcgaacgggtgagtaatacatcggaacgtgtcctgtagtgggggatagcccggcgaaagccggattaataccgcatacgatctgtggatgaaagcgggggatccttcgggacctcgcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgaaagcctgatcccagcaatgccgcgtgtgtgaagaaggccttcgggttgtaaagcacttttgtccggaaagaaaacctcgtggttaatacccgtgggggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaacctggctgagaggtccgggtgcccgaaagggagccataacacagggtgctgcatggctgtcgtcagctcgtgtcgtgagatgttgggataagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacg

SEQ ID NO: 427 - DNA, 1354 bp, Unknown
  Kingdom: Bacteria, Phylum: Proteobacteria
atagcagtcgacgccccgcaaggggagtggcagacgggtgagtaacgcgtgggaacatacccatcactacggaataactcagggaaacttgtgctaataccgtatacgaccgagaggtgaaagatttatcggtgatggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggacatttaagtcaggggtgaaatcccggggctcaacctcggaactgcctttgatactgggtgtctagagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagatacccctggtagtccacgccgtaaacgatgaatgttagccgtcggcaagtttacttgtcggtggcgcagctaacgcattaaacattccgcctggggagtacggtcgcaagattaatactcaaaggaattgacgggggcccgcacaagcggtggagcatgtggtttaattcgaagcaacgcgcagaaccttaccagcccttgacatgcctatgaccggttccagagatggatccttcccttcggggcgtaggacacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggtagtgcgctaaccgcaaggaggcagctatcc

SEQ ID NO: 428 - DNA, 844 bp, Unknown
  Kingdom: Bacteria, Phylum: Proteobacteria
gtcgaacggacccttcggggttagtggcggacgggtgagtaacacgtgggaacgtgcctttaggttcggaatagctcctggaaacgggtggtaatgccgaatgtgcccttcgggggaaagatttatcgcctttagagcggcccgcgtctgattagctagttggtggggtaatggcccaccaaggctacgatcagtagctggtctgagaggatgaccagccacattgggactgagacacggcccaaactcctacgggaggcagcagtggggaatcttgcgcaatgggcgaaagcctgacgcagccatgccgcgtggatgatgaaggtcttaggattgtaaaatcctttcaccggtgaagataatgactgtagccggagaagaagccccggctaacttcgtgccagcagccgcggtaatacgaagggggctagcgttgctcggaattactgggcgtaaagggagcgtaggcggacatttaagtcaggggtgaaatcccagagctcaactctggaactgcctttgatactggatgtcttgagtgtgagagaggtgagtggaactccgagtgtagaggtgaaattcgtagatattcggaagaacaccagtggcgaaggcgactcactggctcattactgacgctgaggctcgaaagcgtggggagcaaacaggattagataccctggtagtccacgccgtaaacgatgattgctagttgtcggggagcttgctcttcggtgacgcagctaacgcattaagcaatccgcctggggagtacggtcgcaagattaaaactcaaaggaattgacgggggcccgcacaagcggtggagcatgtggtttaattc

SEQ ID NO: 429 - DNA, 593 bp, Unknown
  Kingdom: Fungi, Phylum: Ascomycota
ttcgtaggtgacctgcggaaggatcattaacctttcaaatcagggtgcggcgcggcccccgaggagcggaaacaatccttgggaggtatgcgggggcttcgagccccccatttacgcacgcacgactgccatccttactttacgagcaccttctgttctccctcggcggggcaacctgccgttggaaccgaataaactctttttgcatctagcattacctgttccgaaacaaacaatcgttacaactttcaacaatggatctcttggctctggcatcgatgaagaacgcagcgaaatgcgataagtagtgtgaattgcagaattcagtgaatcatcgaatctttgaacgcacattgcgcccctcggtattccgtggggcatgcctgttcgagcgtcatctacaccctcaagctctgcttggtgttgggcgtctgtcccgcctccgcgcgtggactcgccccaaattcattggcagcggtccttgcctcctctcgcgcagcacattgcgcttctcgaggggctacggctcgcgtccaacaagcacatttaccgtctttgacctcggatcaggtagggatacccgctgaacttaa

SEQ ID NO: 430 - DNA, 1420 bp, Unknown
  Kingdom: Bacteria, Phylum: Proteobacteria
cacatgcagtcgagcggggagagtagcttgctacttgacctagcggcggacgggtgagtaatgcttaggaatctgcctattagtgggggacaacatctcgaaagggatgctaataccgcatacgtcctacgggagaaagcaggggaccttcgggccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttttggttgtaaagcactttaagcgaggaggaggctaccgagattaatactcttggatagtggacgttactcgcagaataagcaccggctaactctgtgccagcagccgcggtaatacagagggtgcaagcgttaatcggatttactgggcgtaaagcgcgcgtaggtggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacactgaggtgcgaaagcatggggagcaaacaggattagataccctggtagtccatgccgtaaacgatgtctactagccgttggggcctttgctggctttagtggcgcagctaacgcgataagtagaccgcctggggagtacggtcgcaagactaaaactcaaatgaattgacgggggcccgcacaagcggtggagcatgtggtttaattcgatgcaacgcgaagtagcttacctggtcttgacatagtatcttctttccagagatggattggtgccttcgggaacttacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtcggtacaaagggttgctacctcgcgagaggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagggtaggtccttaacgtctaagggaggacgctaccacgg

SEQ ID NO: 431 - DNA, 591 bp, Unknown
  Kingdom: Fungi, Phylum: Ascomycota
tcttggtcatttagaggaagtaaaagtcgtaacaaggtctccgtaggtgtacctgcggagggatcattacaagtgaccccggtctaaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcaacgcggtccgccgcgtgcctcaaatcgaccggctgggtcttctgtcccctaagcgttgtggaaactattcgctaaagggtgttcgggaggctacgccgtaaaacaaccccatttctaaggttgacctcggatcaggtagggatacccgctgaacttaagcatatcaataagcggaggaa

SEQ ID NO: 432 - DNA, 624 bp, Unknown
  Kingdom: Fungi, Phylum: Ascomycota
tcttggtcatttagaggaagtaaaagtcgtaacaaggtttccgtaggtgaacctgcggaaggatcattaccgagtgagggccctctgggtccaacctcccacccgtgtttattttaccttgttgcttcggcgggcccgccttaactggccgccggggggcttacgcccccgggcccgcgcccgccgaagacaccctcgaactctgtctgaagattgtagtctgagtgaaaatataaattatttaaaactttcaacaacggatctcttggttccggcatcgatgaagaacgcagcgaaatgcgatacgtaatgtgaattgcaaattcagtgaatcatcgagtctttgaacgcacattgcgccccctggtattccggggggcatgcctgtccgagcgtcattgctgccctcaagcacggcttgtgtgttgggccccgtcctccgatcccgggggacgggcccgaaaggcagcggcggcaccgcgtccggtcctcgagcgtatggggctttgtcacccgctctgtaggcccggccggcgcttgccgatcaacccaaatttttatccaggttgacctcggatcaggtagggatacccgctgaacttaagcatatcaataagcggagga

SEQ ID NO: 433 - DNA, 1422 bp, Unknown
  Kingdom: Bacteria, Phylum: Proteobacteria
  misc_feature (39)..(39): n is a, c, g, or t
  misc_feature (47)..(47): n is a, c, g, or t
accatgcagtcgaacggcagcacagaagagcttgctctnttgggtgngcgagtggcggacgggtgagtaatgtctgggaaactgcccgatggagggggataactactggaaacggtagctaataccgcawaacgtcgcargaccaaagtgggggaccttcgggcctcacaccatcggatgtgcccagatgggattagctagtaggtggggtaatggctcacctaggcracgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctygycgattgacgttacccgcaraasaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtrgaattmcaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattmgatgcaacgcgaagaaccttacctggccttgacatccagagwacttagcagagatgctttggtgccttcgggaactctgagacaggtgctgcatggcygtcgtcagctygtgttgwsaaatgttgggttaagtcccgcaacgagcgcaacccttatcctttgttgccagcggytcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccggkccttgtacacaccgcccgtcacaccatgggagtgggttgcaaaagaagtaggtagcttaaccttcgggagggcgctaccactttg

SEQ ID NO: 434 - DNA, 1398 bp, Unknown
  Kingdom: Bacteria, Phylum: Proteobacteria
caacagaggagcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtggtgaggttaataacctcatcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccctcgggagggcgctaccata

SEQ ID NO: 435 - DNA, 1427 bp, Unknown
  Kingdom: Bacteria, Phylum: Firmicutes
acatgcagtcgagcgcaggaagctgacggaactcttcggagggaaggcagtggaatgagcggcggacgggtgagtaacacgtaaggaacctgcctcaaggattgggataactccgagaaatcggagctaataccggatagttcaacggaccgcatggtccgctgatgaaaggcgctccggcgtcaccttgagatggccttgcggtgcattagctagttggtggggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacacgtacgagaggaaatgctcgtaccttgacggtaccttacgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatcccattgaccgcttgagagatcaagttttcccttcggggacaatggtgacaggtggtgcatggttgtcgtcagctcgtgtcgtgagatgttgggttaagtcccgcaacgagcgcaacccctatccttagttgccagcattcagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccataaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaactcgcaaggagcc

SEQ ID NO: 436 - DNA, 707 bp, Unknown
  Kingdom: Bacteria, Phylum: Proteobacteria
acatgcaagtcgaacggcagcacagaagagcttgctctttgggtggcgagtggcggcacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctc

SEQ ID NO: 437 - DNA, 1350 bp, Unknown
  Kingdom: Bacteria, Phylum: Proteobacteria
gcagtcgaacgggcttcttcggaagtcagtggcagacgggtgagtaacacgtgggaacgtgcccttcggttcggaataactcagggaaacttgagctaataccggatacgcccttatggggaaaggtttactgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttacctcgagagatcggggatcctcttcggaggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaaccgcgaggttgagcaaatccccaaaagccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaagggggcaggcg

SEQ ID NO: 438 - DNA, 1350 bp, Unknown
  Kingdom: Bacteria, Phylum: Proteobacteria
gcagtcgaacgagatcttcgggtctagtggcgcacgggtgcgtaacgcgtgggaatctgccctttggttcggaataacagttggaaacgactgctaataccggatgatgacgaaagtccaaagatttatcgccagaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttggggactctaaaggaaccgccggtgataagccggaggaaggtggggatgacgtcaagtcctcatggcccttacgcgctgggctacacacgtgctacaatggcggtgacagtgggcagcaaactcgcgagagtgcgctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcagg

SEQ ID NO: 439 - DNA, 1419 bp, Unknown
  Kingdom: Bacteria, Phylum: Proteobacteria
caagtcgaacggcagcacagtaagagcttgctcttatgggtggcgagtggcggacgggtgaggaatacatcggaatctaccttttcgtgggggataacgtagggaaacttacgctaataccgcatacgaccttcgggtgaaagcaggggaccttcgggccttgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaaagcagtcgattaatactcggttgttctgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaattgcagtggatactgggcgactagagtgtggtagagggtagtggaattcccggtgtagcagtgaaatgcgtagagatcgggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaaacccgcgagggcaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacggg

SEQ ID NO: 440 - DNA, 1402 bp, Unknown
  Kingdom: Bacteria, Phylum: Proteobacteria
acggcagcacagcagagcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtgaggtaatggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgctgtgaaagccccgggctcaacctgggaatggcagtggatactggcgagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacggcggcccgcacaagcggtggagtatgtggtttaattcgatgcaacgcgaagaaccttacctggccttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgtcg

SEQ ID NO: 441 - DNA, 1362 bp, Unknown
  Kingdom: Bacteria, Phylum: Proteobacteria
ccatgcagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccactgt

SEQ ID NO: 442 - DNA, 1378 bp, Unknown
  Kingdom: Bacteria, Phylum: Actinobacteria
ccatgcagtcgacgatgatcaggagcttgctcttgtgattagtggcgaacgggtgagtaacacgtgagtaacctgcccctgactctgggataagcgttggaaacgacgtctaatactggataggactactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacgggcgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttg

SEQ ID NO: 443 - DNA, 548 bp, Unknown
  Kingdom: Fungi, Phylum: Ascomycota
  misc_feature (22)..(22): n is a, c, g, or t
  misc_feature (537)..(537): n is a, c, g, or t
  misc_feature (539)..(539): n is a, c, g, or t
cgtaggtgacctgcggaagganattaccgagtgcgggccctctgggtccaacctcccatccgtgtctatctgtaccctgttgcttcggcgtggccacggcccgccgaagactaacatttgaacactgtctgaagtttgcagtctgagtttttagttaaacaataattaaaactttcaacaacggatctcttggttccggcatcgatgaagaacgcagcgaaatgcgataattaatgtgaattgcagaattcagtgaatcatcgagtctttgaacgcacattgcgccccctggtattccggggggcatgcctgtccgagcgtcattgctgccctcaagcacggcttgtgtgttgggcttccgtccctggtaacggggacgggcccaaaaggcagtggcggcaccatgtctggtcctcgagcgtatggggctttgtcacccgctcccgtaggtccagctggcagctagcctcgcaaccaatctttttaaccaggttgacctcggatcaggtagggatacccgctgaacttaagcatatntnaacgggggg

SEQ ID NO: 444 - DNA, 601 bp, Unknown
  Kingdom: Fungi, Phylum: Ascomycota
  misc_feature (3)..(3): n is a, c, g, or t
  misc_feature (527)..(536): n is a, c, g, or t
  misc_feature (538)..(538): n is a, c, g, or t
  misc_feature (546)..(546): n is a, c, g, or t
  misc_feature (550)..(550): n is a, c, g, or t
  misc_feature (554)..(554): n is a, c, g, or t
  misc_feature (559)..(559): n is a, c, g, or t
  misc_feature (561)..(568): n is a, c, g, or t
  misc_feature (578)..(578): n is a, c, g, or t
  misc_feature (588)..(590): n is a, c, g, or t
  misc_feature (593)..(594): n is a, c, g, or t
  misc_feature (596)..(597): n is a, c, g, or t
  misc_feature (599)..(599): n is a, c, g, or t
gtncgtaggtgacctgcggaaggatcattacctagagttgtaggctttgcctgctatctcttacccatgtcttttgagtaccttcgtttcctcggcgggtccgcccgccgattggacaatttaaaccatttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgcgtagactcgcctcaaaacaattggcagccggcgtattgatttcggagcgcagtacatctcgcgctttgcactcagaacgacgacgtccaaaagtacatttttacactcttgacctcggatcaggtagggatacccgctgaacttaagcatatnnnnnnnnnngnaggaaaanttgngctngaaancnnnnnnnnatccccgctnatattaagcnnnctnncnncncc

SEQ ID NO: 445 - DNA, 600 bp, Unknown
  Kingdom: Fungi, Phylum: Zygomycota
tgcggaaggatcattaattatgttaaagcgccttaccttagggtttcctctggggtaagtgattgcttctacactgtgaaaatttggctgagagactcagactggtcatgggtagacctatctggggtttgatcgatgccactcctggtttcaggagtacccttcataataaacctagaaattcagtattataaagtttaataaaaaacaacttttaacaatggatctcttggttctcgcatcgatgaagaacgtagcaaagtgcgataactagtgtgaattgcatattcagtgaatcatcgagtctttgaacgcagcttgcactctatggtttttctatagagtacgcctgcttcagtatcatcacaaacccacacataacatttgtttatgtggtgatgggtcgcatcgctgttttattacagtgagcacctaaaatgtgtgtgattttctgtctggcttgctaggcaggaatattacgctggtctcaagatctttttttttggttcgcccaggaagtaaagtacaagagtataatccagtaactttcaaactatgatctgaagtcaggtgggattacccgctgaacttaagcatatc

SEQ ID NO: 446 - DNA, 1066 bp, Unknown
  Kingdom: Fungi, Phylum: Ascomycota
ggatcattacaagttgaccccggccctcgggccgggatgttcacaaccctttgttgtccgactctgttgcctccggggcgaccctgcctccgggcgggggccccgggtggacatttcaaactcttgcgtaactttgcagtctgagtaaatttaattaataaattaaaactttcaacaacggatctcttggttctggcatcgatgaagaacgcagcgaaatgcgataagtaatgtgaattgcagaattcagtgaatcatcgaatctttgaacgcacattgcgccccctggtattccggggggcatgcctgttcgagcgtcatttcaccactcaagcctcgcttggtattgggcgacgcggtccgccgcgcgcctcaaatcgaccggctgggtctttcgtcccctcagcgttgtggaaactattcgctaaagggtgccgcgggaggccacgccgtaaaacaaccccatttctaaggttgacctcggatcaggtagggatacccgctgaacttaagcatatcaataagcggaggaaaagaaaccaacagggattgctctagtaacggcgagtgaagcagcaatagctcaaatttgaaatctggcgtcttcggcgtccgagttgtaatttgtagaggatgcttctgggcagccaccgacctaagttccttggaacaggacgtcatagagggtgagaatcccgtatgcggtcggaaaggcaccctacacgtagctccttcgacgagtcgagttgtttgggaatgcagctctaaatgggaggtaaatttcttctaaagctaaatattggccagagaccgatagcgcacaagtagagtgatcgaaagatgaaaagcactttggaaagagagttaaaaagcacgtgaaattgttgaaagggaagggattgcaaccagacttgctcgcggtgttccgccggtcttctgaccggtctactcgccgcgttgcaggccagcatcgtctggtgccgctggataagacttgaggaatgtagctccctcgggagtgttatagcctcttgtgatgcagcgagcgccgggcgaggtccgcgct

SEQ ID NO: 447 - DNA, 502 bp, Unknown
  Kingdom: Fungi, Phylum: Ascomycota
cattacctagagttgcgggctttgcctgccatctcttacccatgtcttttgagtaccttcgtttcctcggcgggtccgcccgccgattggacaaaacttaaaccctttgtaattgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctttgcttggtgttgggtgtttgtctcgcctctgcgcgcagactcgcctcaaaacgattggcagccggcgtattgatttcggagcgcagtacatctcgcgctttgtagtctcaacgacgacgtccaaaaagtacttttttcactcttgacctcggatcaggtagggatacccgctgaacttaagcata

SEQ ID NO: 448 - DNA, 1020 bp, Unknown
  Kingdom: Fungi, Phylum: Ascomycota
attattccacccgtgtcttttgcgtacttcttgtttccttggtgggctcgcccaccacaaggaccaacccataaacctttttgtaatggcaatcagcgtcagtaacaatgtaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtctttttgtccccccccttgcggggagactcgccttaaagtcattggcagccggcctactggtttcggagcgcagcacaagtcgcgctctcttccagccccaaggtctagcatccaacaagcctttttttcaacttttgacctcggatcaggtagggatacccgctgaacttaagcatatcaataagcggaggaaaagaaaccaacagggattgccctagtaacggcgagtgaagcggcaacagctcaaatttgaaatctggctcttttagagtccgagttgtaatttgcagagggcgctttggctttggcagcggtccaagttccttggaacaggacgtcacagagggtgagaatcccgtacgtggtcgctggctattgccgtgtaaagccccttcgacgagtcgagttgtttgggaatgcagctctaaatgggaggtacatttcttctaaagctaaatattggccagagaccgatagcgcacaagtagagtgatcgaaagatgaaaagcactttggaaagagagtcaaacagcacgtgaaattgttgaaagggaagcgcttgcagccagacttgcttgcagttgctcatccgggcttttttgcccggtgcactcttctgtaggcaggccagcatcagtttgggcggtaggataaaggtctctgtcacgtacctcctttcggggaggccttataggggaggcgacatactac

SEQ ID NO: 449 - DNA, 617 bp, Unknown
  Kingdom: Fungi, Phylum: Ascomycota
tcttggtcaatttagaggaagtaaaagtcgtaacaaggtctccgttggtgaaccagcggagggttcattaccagagtgccctaggctctccaacccattgtgaacttaccaaacgttccctcggcgggctcagcgcgcggtggcctccgggcctccgggcgtccgccggggaaaaccaaaccctgatttaatcgtatttctctgaggggcgaaagcccgaaaacaaaatgaatcaaaactttcaacaacggatctcttggctctggcatcgatgaagaacgcagcgaaatgcgataagtaatgtgaattgcagaattcagtgaatcatcgaatctttgaacgcacattgcgcccgccggcactccggcgggcatgcctgtccgagcgtcatttcaaccctcaggcccacccttccgggggagcgggcctggtgctggggatcggcggccctcgcggcccccgtccctcaaatacagtggcggtcgcgccgcagcctcccctgcgtagtagcacaacctcgcaccggagagcggaacgaccacgccgtgaaacccccaattttttaaggttgacctcggatcaggtaggaatacccgctgaacttaagcatatcaaaa

SEQ ID NO: 450 - DNA, 521 bp, Unknown
  Kingdom: Fungi, Phylum: Ascomycota
  misc_feature (20)..(20): n is a, c, g, or t
taggtgacctgcggaaggancattacctagagttgtaggctttgcctgctatctcttacccatgtcttttgagtaccttcgtttcctcggcgggtccgcccgccgattggacaatttaaaccatttgcagttgcaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcgcctctgcgcgcagactcgcctcaaaacaattggcagccggcgtattgatttcggagcgcagtacatctcgcgctttgcactcacaacgacgacgtccaaaagtacatttttacactcttgacctcggatcaggtagggatacccgctgaacttaagcatat

SEQ ID NO: 451 - DNA, 1409 bp, Unknown
  Kingdom: Bacteria, Phylum: Proteobacteria
  misc_feature (1094)..(1094): n is a, c, g, or t
agtcgaacggcagcacagtaagagcttgctcttatgggtggcgagtggcggacgggtgaggaatacatcggaatctaccttttcgtgggggataacgtagggaaacttacgctaataccgcatacgaccttcgggtgaaagcaggggaccttcgggccttgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaaagcagtcgattaatactcggttgttctgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaattgcagtggatactgggcgactagagtgtggtagagggtagtggaattcccggtgtagcagtgaaatgcgtagagatcgggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactntaaggagaccgccggtgacaaaccggaggaaggtggggatgacgtcaagtcatcatggcccttacgaccagggctacacacgtactacaatggtagggacagagggctgcaaacccgcgagggcaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgct

SEQ ID NO: 452 - DNA, 1415 bp, Unknown
  Kingdom: Bacteria, Phylum: Proteobacteria
ccatgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacacacatgggagtgggttgcaaaagaagtaggtagcttaaccttcgggagggcgcttac

SEQ ID NO: 453 - DNA, 1004 bp, Unknown
  Kingdom: Fungi, Phylum: Ascomycota
ctcccaaacccctgtgaacatacctatacgttgcctcggcggacagcccgcgccccgtaaaaagggacggcccgcccgaggacccctaaactctgtttttagtggaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagctcagcttggtgttgggactcgcggtaacccgcgttccccaaatcgattggcggtcacgtcgagcttccatagcgtagtaatcatacacctcgttactggtaatcgtcgcggccacgccgtaaaaccccaacttctgaatgttgacctcggatcaggtaggaatacccgctgaacttaagcatatcaataagcggaggaaaagaaaccaacagggattgccctagtaacggcgagtgaagcggcaacagctcaaatttgaaatctggctctcgggcccgagttgtaatttgtagaggatgcttttgatgcggtgccttccgagttccctggaacgggacgccatagagggtgagagccccgtctggttggatgccaaatctctgtaaagctccttcgacgagtcgagtagtttgggaatgctgctctaaatgggaggtatatgtcttctaaagctaaataccggccagagaccgatagcgcacaagtagagtgatcgaaagatgaaaagcactttgaaaagagagttaaaaagtacgtgaaattgttgaaagggaagcgtttatgaccagacttgggcttggttaatcatctggggttctccccagtgcacttttccagtccaggccagcatcagttttcgccgggggataaaggcttcgggaatgtggctctctccggggagtgttatagcccgttgcg

SEQ ID NO: 454 - DNA, 999 bp, Unknown
  Kingdom: Fungi, Phylum: Ascomycota
atgttgcctcggcggatcagcccgcgccccgtaaaacgggacggcccgccagaggacccaaactctaatgtttcttattgtaacttctgagtaaaacaaacaaataaatcaaaactttcaacaacggatctcttggttctggcatcgatgaagaacgcagcaaaatgcgataagtaatgtgaattgcagaattcagtgaatcatcgaatctttgaacgcacattgcgcccgctggtattccggcgggcatgcctgttcgagcgtcatttcaaccctcaagcccccgggtttggtgttggggatcggctctgccttctggcggtgccgcccccgaaatacattggcggtctcgctgcagcctccattgcgtagtagctaacacctcgcaactggaacgcggcgcggccatgccgtaaaaccccaacttctgaatgttgacctcggatcaggtaggaatacccgctgaacttaagcatatcaataagcggaggaaaagaaaccaacagggattgccctagtaacggcgagtgaagcggcaacagctcaaatttgaaatctggctttcgggcccgagttgtaatttgtagaggatacttttgatgcggtgccttccgagttccctggaacgggacgccatagagggtgagagccccgtctggttggatgccaaatctctgtaaagttccttcgacgagtcgagtagtttgggaatgctgctctaaatgggaggtatatgtcttctaaagctaaatattggccagagaccgatagcgcacaagtagagtgatcgaaagatgaaaagcactttgaaaagagagttaaaaagtacgtgaaattgttgaaagggaagcgtttatgaccagacttggacttggttaatcatctggggttctctccagtgcacttttccagttcaggccagcatcagttttcgccgggggataaaggcagcgggaatgtggctctcttcggggagtgttatagcccgctgtgtaatac

SEQ ID NO: 455 - DNA, 1076 bp, Unknown
  Kingdom: Fungi, Phylum: Ascomycota
ttaccgagtgagggccctctgggtccaacctcccacccgtgtttattttaccttgctgcttcggcgggcccgccttaactggccgccggggggctcacgcccccgggcccgcgcccgccgaagacaccctcgaactctgtctgaagattgtagtctgagtgaaaatataaattatttaaaactttcaacaacggatctcttggttccggcatcgatgaagaacgcagcgaaatgcgatacgtaatgtgaattgcaaattcagtgaatcatcgagtctttgaacgcacattgcgccccctggtattccggggggcatgcctgtccgagcgtcattgctgccctcaagcacggcttgtgtgttgggccccgtcctccgatcccgggggacgggcccgaaaggcagcggcggcaccgcgtccggtcctcgagcgtatggggctttgtcacccgctctgtaggcccggccggcgcctgccgatcaacccaaattttttatccaggttgacctcggatcaggtagggatacccgctgaacttaagcatatcaataagcggaggaaaagaaaccaacagggattgccccagtaacggcgagtgaagcggcaagagctcaaatttgaaagctggctccttcggggtccgcattgtaatttgtagaggatgcttcgggagcggtccccatctaagtgccctggaacgggacgtcatagagggtgagaatcccgtatgggatggggtgtccgcgcccgtgtgaagctccttcgacgagtcgagttgtttgggaatgcagctctaaatgggtggtaaatttcatctaaagctaaatattggccggagaccgatagcgcacaagtagagtgatcgaaagatgaaaagcactttgaaaagagagttaaaaagcacgtgaaattgttgaaagggaagcgcttgcgaccagactcgctcgcggggttcagccggcattcgtgccggtgtacttccccgcgggcgggccagcgtcggtttgggcggtcggtcaaaggccctcggaaggtaacgcccccaggggcgtcttatagccgagggtgcaatgcgac

SEQ ID NO: 456 - DNA, 19 bp, Unknown
  Kingdom: primer
gtgccagcmgccgcggtaa

SEQ ID NO: 457 - DNA, 19 bp, Unknown
  Kingdom: primer
ggactachvgggtwtctaa

SEQ ID NO: 458 - DNA, 20 bp, Unknown
  Kingdom: primer
agagtttgatcctggctcag

SEQ ID NO: 459 - DNA, 19 bp, Unknown
  Kingdom: primer
ggttaccttgttacgactt

SEQ ID NO: 460 - DNA, 18 bp, Unknown
  Kingdom: primer
tccgtaggtgaacctgcg

SEQ ID NO: 461 - DNA, 20 bp, Unknown
  Kingdom: primer
gctgcgttcttcatcgatgc

SEQ ID NO: 462 - DNA, 21 bp, Unknown
  Kingdom: primer
tacctggttgatcctgccagt

SEQ ID NO: 463 - DNA, 17 bp, Unknown
  Kingdom: primer
tgttacgacttttactt

SEQ ID NO: 464 - DNA, 22 bp, Unknown
  Kingdom: primer
cttggtcatttagaggaagtaa

SEQ ID NO: 465 - DNA, 20 bp, Unknown
  Kingdom: primer
tcctccgcttattgatatgc

SEQ ID NO: 466 - DNA, 22 bp, Unknown
  Kingdom: primer
ggaagtaaaagtcgtaacaagg

SEQ ID NO: 467 - DNA, 23 bp, Unknown
  Kingdom: primer
cgttactrrggcaatccctgttg

SEQ ID NO: 468 - DNA, 18 bp, Unknown
  Kingdom: primer
gcrcggaaracgcttctc

SEQ ID NO: 469 - DNA, 20 bp, Unknown
  Kingdom: primer
ttttcccgtttcattcgcca

SEQ ID NO: 470 - DNA, 17 bp, Unknown
  Kingdom: primer
atagactacaattcgcc

SEQ ID NO: 471 - DNA, 16 bp, Unknown
  Kingdom: primer
aaaacgtwtcttcaaa

SEQ ID NO: 472 - DNA, 18 bp, Unknown
  Kingdom: primer
ccctayggggygcascag

SEQ ID NO: 473 - DNA, 18 bp, Unknown
  Kingdom: primer
gagargwrgtgcatggcc

SEQ ID NO: 474 - DNA, 20 bp, Unknown
  Kingdom: primer
agrrttygatymtggytyag

SEQ ID NO: 475 - DNA, 20 bp, Unknown
  Kingdom: primer
hgghtaccttgttacgactt

SEQ ID NO: 476 - DNA, 19 bp, Unknown
  Kingdom: primer
aacmggattagataccckg

SEQ ID NO: 477 - protein, 714 aa, Unknown
  Kingdom: Fungi, Phylum: Ascomycota
MDHTGEFRGIAPYVDNSDSYEVYKTVDPGDGNAIQDAIDSGGRQNQWLASDPRVVYLPPGTYEVGSTINLRTDTILMGDATDPPVIKAAAGFDGDTLLNGKDPSVGNAGELSFAVGVKNIILDTTAVDAGSEFTALYWGVAQVCQLQNLQIKMPQSVDGNGHSGIKLGQGSTLGLADIRIENGLNGIWHNGHQQAFYKNVYFFQNTVGMLIDGGKTITILNPTFETVGIAVRHTGESPFIGIIDAKSINSGVTYNSTGYASVLIDNLDKDTSSDVVMLPSGIALGESSHVDTFTYGNTVGRSPVYGSTTTNVARPEAVAPGGRFPAVAAPNYGDLTAGDFINIKDPSQNGGQTINGDGQGNEVEALTAALQYAAKNNKIAYFPSGDYRVESTLTIPVGSRIVGEAWSTISAAGSFFKDASAPKPVIQIGTQNDVGIIQVQDMRFTVAEVLPGAIIVEVNAAGNRPGDVALWNSAITVGGTRGADDLTNNCWDPSNPCQGAYLGMHLTEGSSAYVENVWNWVADHFTEDLNRGSVIAGKGGALVESTKGTWLYALGVEHWWLYQLNLRNAENVAVGMLQSETNYDQGVYAQSLVPSPWTADKNGWGDPDYAWCGGDDGYCRMGVSNWINGGSNIYYYGSASWAFFSGPDKHSCPNDGADCQEFIHWIEKTPDNFQSFGWCAKSVKYALRLADATNIGTSPDFTGSWGSLVGRYTP

SEQ ID NO: 478 - protein, 558 aa, Unknown
  Kingdom: Fungi, Phylum: Ascomycota
MYSQTFLALVATSFSALVTAQTSIGVDVSTKHQEMEGFGFSQAFGRASELKNAVSSVQSGALDLLFSTTSGAGFTIIRNRIGSGGNGDSIEPASPGSPDATPKYVWDGNDSGQFWFTQQAVSRGVKTIYADAWSAPGFMKTSGSDSSPGYLCGTTGHTCSSGDWRQAYANFLVKYVQLYAQQGITITHLGFLNEPDYSPGYSQMQISINAQEAISFIPTLYNTVRAAGLSTNITCCDAVGWADQAKYTTALVNAGSTQYLGAITSHMYSADPSSPLNETSLPKWNTEGGPLSDPFSTTWYASGAANEGMTWAQKLASAIVNSDLSAYLFWEGFEQNQHQSAAHLVDTDSSGKTAVANSILWAFAMWSRHIRPGAYRVATSGSMANVITGAFQNTDGSVVLVFTNDGTTTQTPRTSFGSFTPDSASAWLTNQGNTFATTAATLSGGAVTVSVPAKSVVTVKLTPGSSQAAVSNVSTQSTGATKEPVTKESTTKEPATKEPVAKQSTTKEPVTKEPVTKESTTKEPSTKEADAKKQTKPAGRYRGRPRPSSPNKECSGEE

SEQ ID NO: 479 - protein, 430 aa, Unknown
  Kingdom: Fungi, Phylum: Ascomycota
MPSPSKLLGLAAATTGASAAFQGFNYGATFADGRLRVESDFEGMFKAAQSLAGTDGAFNSARLYTMIQGNTDNEPISAIPAAIKTKTSILFGLWASAGQDNFNKEIIALQKTIDQYCDQLDGLVAGISIGSEDLYRNSPIGIEAGEFAGADPNTIVQYIQQVRKTIKGSCLEKAPLGHVDTWTAYVNATNKPVIQALDWIGMDAYPYFENTKPNSIDEAKSLFDAALANTEGAAGGVEVWITETGYPTKGKTSGAAVANTQNARTYWEDVGCPLFGKTNTWWYTLQDSNSDNAITDDTPSFGVVGDNLQPKYNLSCKGVKPKPSSSSATPQSTSTQSSGDKTSAASTAGETSAKTTGSASSPSGLSTVSSPAAAATTSGSGSGSDNSSESGKGEQASASPSHVPADGAGAQLKGSFGAIIIALGLTFFAL

SEQ ID NO: 480 - protein, 369 aa, Unknown
  Kingdom: Fungi, Phylum: Ascomycota
MLSNALLLGALASTGLASPTWEQEAGIEPRGVSCTFNTLAQVLQGKSTCDTITLDNINVPAGQTLDLTGLKSGCNLIFSGNTSFGYTPWTGPLIAISGQNVAVQGADGHIIDCQGQRWWDGKGANGGKKKPKLLSVKKLDNSVIQGLYIKNQPVQGVSIDTVQNLNILNVTLDAQDGDKLGGHNTDGFDIGNAQNIYIYGATVKNQDDCMAINSGTNITFTEGSCSGGHGLSIGSVGLRSNNNVSDVHITNSVVSNSDNGVRIKTIVDATGSVDGVVYDNITLQNIAKMGIVIEQDYQNGNATGHPTGGVPITNVTLNDITGNVLPNGANVYILCAAGACSDWVWNDVNVTGGQKPKSCMNVPSPAVCS

SEQ ID NO: 481 - protein, 168 aa, Unknown
  Kingdom: Fungi, Phylum: Ascomycota
MEKYWKDQQGNDESFWEHEWSKHGTCISTLEPDCYQNYEPTEEATAYFEKTIALFKTLPTYQWLSDAGITPSDSDTYALEDIQATLKQQHGAEVTLGCKNGQLNEVWYHFNVRGSLQDGEFVASEPDGTKGTCPDQVTYAVKSEQNSFTRKNRVFKGYREHGTAEMHI

SEQ ID NO: 482 - protein, 388 aa, Unknown
  Kingdom: Fungi, Phylum: Ascomycota
MVHTTYILMALAAIGVIATPVTPRAKTLTVPLKHSNNVKSIKGLVEKGQARLRNVNGAVHFNNDVSSGTVINEDVSYVAPVKIGGSTYDLIVDTGSSNTWCGAQNSCEPSSTGQDTGNSVSVSYGSGSFSGEEFVDTVSFGGLTVQSQSVGAASSSTGFNSVDGIIGFGPVGLTQETVSGVNTVPTFMDNLYSQGSISTEVLGVSFRPESGSDTSDSNGELTLGGTDSSRYTGSISYFPLLTSGKASQYWGISIAKFAYGSTTLASSASGIVDTGTTLIYIPTSAYNSFLSAAKGKTDSSSGLAVFSTKPTANFSITFGSKTFTLTPAQYLVPQAQYSFYGLSSGKYYAWINDGGSSGVNTIIGQKFLENYYSVYDTTNSRIGFATAA

SEQ ID NO: 483 - protein, 180 aa, Unknown
  Kingdom: Fungi, Phylum: Ascomycota
MRFSIAACLTALAAPIAAASIANGQAPSLVKRGDDDNKVPGDSPLEFCPGDHSKDLVEISNVDLSPNPPKPGQELLIKASGVVKEKIEEGAYVLLTVKYGLIRLISTKASLCEQVENVDLKCPLEEGKVEVTKSVDIPNEIPPGKYTVLADVYTEDDVQITCLTATVSFTRGTNILGLEL

SEQ ID NO: 484 - protein, 440 aa, Unknown
  Kingdom: Fungi, Phylum: Ascomycota
MKSHTILAAGFASLAVAADLPAVTIKGKALYANNQRFYVRGIDYQPGGSSANDDPLLDESTCKRDIANFQKIGINAIRVYTVDNSKNHDACMSALADAGIYLALDVNNPDYSLNRADPAPSYNPTYLQSVFATIDAFAGYSNTLMFFSGNEVINNANNTVSAPYVKAVTRDMKQYIGERGYRKIPVGYSAADVAENQYLMARYMSCGDSNAQGDFYAINNYEWCSPSSFTESGWDKLVATYQNYSQPLILSEYGCIKPSRDFSETKELYNTSMTSVVSGGFVYEYSEEGSGYGLYQISGNTVTPIKNQVSDLTAALKDSPDPSGDGDLVTSGMVSQDCPEQSDDWNTSPFTGSSIPAMPAGAEKFLKSGAGTAPGLQGGSQNAGGGSSATAASGAGAVTTTFPAGSKKTGSDDDNASDYIKVSKGLVVALAGLWAVNAAL

SEQ ID NO: 485 - protein, 787 aa, Unknown
  Kingdom: Fungi, Phylum: Ascomycota
MKSITTSGLVGAFLAVTAAAAPTVEERDVDTAYPYTGPDVPIGDWVDQTVNGNGKGFPRLVEKPAVQPKSSNPTNNVNVISLAWVPGGVNIHYQTPFGLGEAPSVQWGTSSASLTKTATGSSHSYDRTPPCSAIAAVTQCSQYFHEVQISGLKPSTTYYYQIPAANGTTESDVLSFTTAAKAGDKKSFSVAVVNDMGYTNAKGTHEQLLKLVNSGTAFTWHGGDISYADDWYSGILPCEDDWPVCYNGSSTELPGPAPVPDEYKDAPLPKGEVANQGGPQGGDMSVIYESNWDLWQQWMSDVTMKAPYMVLPGNHEATCAEFDGGNNTLTAYLNDDKANSTAAKSGLTYYSCPPSQRNFTAFQHRFRMPGEETGGVGNFWYSFDYGLAHFVSIDGETDYPNSPEWSFARDLAGKKGDHVKPKDTFVTDSGPFGKVDGDLKDNKAYEQWNWLNKDLAAVDRTKTPWVFVMSHRPLYSSEVSKYQLAMRAAWEDLMLEHGVDAYIAGHIHWYERLLPLGRNGTIDVDSIKDNSTYLVNNGKSITHLTNGAAGNIESHSTPQGNPILNFTQVLDYVHFGLGKLTVVNETVATWDYVVGDTGDIRDHLTLIKPSGASTGSHDHSNPSSSNSTSSSSYSSSSSSSSSSGSTASATHGGVTTTTEVVTAYTTWCPAGAVVTAGSHTYTVTEAASLTITDCPCTLTHTLPAPAASTWTPAGNSTGTMGSPSGNGTATAGSSGNGGGQQGSGSQGGVPQGSGVSTSTQAVPTTAAASRSSIGGLLAVSFIAMWFL

SEQ ID NO: 486 - protein, 541 aa, Unknown
  Kingdom: Fungi, Phylum: Ascomycota
MGVSKLSLSLLALTGSALGADLPAITMKGSKFFYENGTQFFMKGVAYQQDTSAAGATFDKSTNYIDPLADETSCKRDIPLLEELGTNTIRTYAIDPTADHSVCMKLLQDAGIYVISDLGEPATSINRDDPKWDTELFSRYKAVVDELAKYPNVIGFFAGNEVSNNKTNTDASAYVKAAVRDTKAYIKSKNYRWMGVGYAANDDKDIRAEIADYFNCGKSEDSIDFWGYNIYSWCGDSSMEKSGYDEQIKFFEEYSVPVFFAEYGCNLPDGAAGRIFQETAALYNDDMTKVFSGGIVYMYNQEANDYGLVKVDSSGKATKLKDFDALKKQVLKADPKGVDESSYNPTLKAADCPPVSSTWQVSGNDLPPTPDQDLCDCMVKAASCGPASDLSTKSYGDIFSFICGAKPDVCKGINGNTTTGVYGAYVGCDAKSKLTYVLDAYYKDQKNAADACDFKGKAAVKSGSNDDKCKSSLQEAQAHNDKVATATSGADAPFSTSSSKADEEDFAVPGAALMRLFSLGDYAVGLYMVVAVAVGGSMIVL

SEQ ID NO: 487 - protein, 648 aa, Unknown
  Kingdom: Fungi, Phylum: Ascomycota
MQFFTSVVLLGSVALQTVFARPGPARLSTAKVQLSTRAVGDFINTETPIALEQLLCNIGANGCNSAGVSSGLVIASPSKQDPDYWYTWTRDSALVFKSIVDRFTNSYDAGLQRHITDYIAAQARLQGVSNPSGGFSDGSGLAEPKYNVDGSAFTGAWGRPQRDGPALRAIAIMSYGEWLLDNSYTDTAKNIVWPVVRNDLEYVAQYWNQTGFDLWEEVNGSSFFTIASQHQALVQGYRFAARVGASGAHYQATAPSVLCFLQSFWNPSKGYIDSNINVNDGRTGLDANSILASIHTFDASIGCDSTTFQPCSDKALSNLKAVVDSFRFYNINNGIPKGTALAVGRYAEDVYYNGNPWYLNTLAAAEQLYDAVYVWKQQGSVTVTATSRAFFADLIPNIAVGTYQSGSSTYNSIIQAVSQYGDGFVNVVATYAQSNGSLAEQFSKQDGTPLSARDLTWSYASFLTAAARRAGVIPRPWSGGVEALPGTCSAVSFTGSYTSATATNFPASQTPVTGTGTVTVTGTSPPTTSTTAQPPSTTTACAIAPQVTVNFVARVVTNYGDTVKLVGNVDKLGNWNPSSGVVLSASDYQANNPVWKGSVVLSAGQSIQYKYVKVLSDGTVKWEADPNRTYSVPRSCATAVSRSDTWQT

SEQ ID NO: 488 - protein, 398 aa, Unknown
  Kingdom: Fungi, Phylum: Ascomycota
MHTSQLLAALAAAGFASAQTKTCTKDIQVTQPTPVIDCEVVKADIIVDESVAGDLSIEGPKQLQGDLIVKNASINALSSTSLNAISGKFVLEGCQFLRNLRMNSLTEVDEIQFINLAQLEGLAFGSSGKLEINKITISDTFIDDLSGLNVVTVEDFLINNNQRMVSFQSDLVNITGSSGLRIEGNGREFQLNLPKLESATELQLQDIKSIQFPSLQTLNQSLKLDDNRELTELSAPNLTSIGEALSLINNVKFSNVSFPKLETIGGDLTVLNNTAMEQVAGFPELRTIGGGIRMGGNFEEVELPSLKDVKGASNVTSTTDIKSFCEFFDKASEEKILQGEAKCTSNNTKALEGEAGGETNDGSSGSGSKSDKEDAAGLLNVNMAVLSLAVVFGVAQLL

SEQ ID NO: 489 - protein, 220 aa, Unknown
  Kingdom: Fungi, Phylum: Ascomycota
MVSLTALVSLLGVAAALPNPQAGTKQLIVGGTSAATGEFPYIVSLQQNSRHFCGGVLLNANTVLTAAHCTEGSSASSVTIRAGTNRWASGGVTSRVSSLRVHPNYVSSTTDNDIAIWKLGYTSEDSGAVASSLLKVTVPVVSRATCRSEYGSSAITNNMVCAGLPQGGKDSCSGDSGGPLVNASGTLVGLVSWGNGCARAGYSGVYTRVGNYVQWIAQNI

SEQ ID NO: 490 - protein, 321 aa, Unknown
  Kingdom: Fungi, Phylum: Ascomycota
MIHPEMPSTRLLLTWLAATVATIQAAECDCYVTDGGPSPTYFKEYGFWDFRTLSQYSRSPPLIDTFEGNSQAGFTSDFFSSTSSFQSFWAPQNWNDDQEILRTNSFNNLYITPSSSSASRNATMLRMRTARGSDFQSTAAFQSKDMVDHASMRMLSRTHGSAGACTSIFTYLGAENMLDVQEADIEILTKDPETRIRYTNQPAHYGNGTLVHGAGHRVTLPDGKKWTEWLTHRMDWTPGLTTWFVDGREMRSQSFQAPVDPSRIVLNTWSDGGNWTGTMDQGGQAFQDIQWIEIAYNLAEEGSCARVCSVNGGAAGSPQPV

SEQ ID NO: 491 - protein, 106 aa, Unknown
  Kingdom: Fungi, Phylum: Ascomycota
MAIYEITSNDAFYQAIKDHKTVMIDFFATWCGPCKMIAPLIEKHSAEEKYSNIYFTKIDVDKLSKLSDDLDIQAMPTLLMFENGEKSDTILDPNPKTLVEFLDKFA

SEQ ID NO: 492 - protein, 582 aa, Unknown
  Kingdom: Fungi, Phylum: Ascomycota
MQISLSAAALASGLLLFPSVAVAGPLGPLPLPDVKISLNDGCRCLPGDACWPSVQEWQRLNQTVDGRLVATVPIGSPCHDPHYDEAACKQLQDDWLLPQTHLPSSSSLMQPFFANQSCDPFTDKDTPCKLGNYVVYSVNVAEPKHVAAALKFCKEKNIRPVVRSTGHDFLGRSSGAGGLGIWMWNLKSTQVLDYSDKFYTGPALKVDSGVLGAEAVEAAAAKGLAVVTGECPTVAVAGGYTQGGGHSALSTAYGLAADQTLEFQVVTADGQVRTASRTQNSDLYWALSGGGGGNYAVVMSVTIRAHPAGQVGGAKLAMSAQYTTPEKWEQAIAAFHKLLPGMIDQGASVVYYVSNQIFAISPLTVMNSTGDAVRDEILAPFTAKLAELLIPSQVSYTTLSYLDHYDTYMGPLPWGHIEVSAYQFGSRLIPKSLLVDEPDKFQSAITNLTNNGVLAVGSAAAYKSRFDVSNSVLPAWREAYIQMQLTTPWSNDPSQLGAMIDAQHRMTNEFNPQLARITPTSGAYMNEADFREPNWKQTWFGDNYAKLLAVKKKYDPENLLYMFKGVGSDAWTVAESGRMCRT

SEQ ID NO: 493 - protein, 515 aa, Unknown
  Kingdom: Fungi, Phylum: Ascomycota
MAWLPRKPPNRVRELYAGGIMRFALAVVLAQPQHAQLERIVAQVHSLILFPGNTLLQTALPFIMILNTFLAAALGAAASVSAAKSPARYAMYFDQYHTAALPNKTMTAGITHVITAFANSSLFTSEPSGVYTPFQPLSDIRALFEQDVKLCMSIGGWGDTAGLSLGSKNDTTRRLFARNVASTLDRLGYDCVDIDWEYPGGNGADYKQIPNSKKKGEIAAYPHLLKELKKAIGTKELSITVPGLERDMIAFTSAESPKINEAVDFVTVMAYDLMNRRDTVTKHHTPVVGSLQAIDKYLSLGFSAEKLNLGFALYAKWFTTAPGVDCSNGLGCRTALLENPDGSDTGASGAMTFEAANFHPPPTNLTIAPDASCGAGTFHKCAEGSCCSQYGFCGDTSAHCGTGCQGGYGRCNGTSTLQSFYDAVSKSKTDEVQGGQWYWDSEGPFFWTFETVDLIGRKFKEIYKARNLGGVSVWSLGEDSYDFELIKAIQSGVKDSCGASAKSTHVGRHQRRSAH

SEQ ID NO: 494 - protein, 409 aa, Unknown
  Kingdom: Fungi, Phylum: Ascomycota
MVGLALRTAVFVTVVAASTVKRPSSSSGYIAVPLTRDEGLTAYFAELQVGTPPQKEYLKIDTGSPRYSVLDSRNAVCASAGQSCSEFGTFDNITSSTCHYEGGGFVDDLSWVGNGDYLSDTIVMGGVSIKDMYFGYTSRYAFPDHVVGDPYTILGLSLECGLAGPTCTDRVSAYMLPELKNASKINHMASSIYLGPDDKQAANAQMLLGGFYDKAKIDGELITIPMVDPFNEDLTSGQTNNVNVTAVEVVLGEGYGANHTLESYGQKDVGVPVLLDTGVANFYLTDKTVAPIYRAFGNIGAPPSGQQYSVVDCKYADPKRSDGHITVEFGKHGKVTIPLHALVSQFPDGTCGAFVTSRGDSVFTFGDPFLRGVYSIFDQENFSISLGQVKHTAEQNIVPFPKGGFKPAP

SEQ ID NO: 495 - protein, 134 aa, Unknown
  Kingdom: Fungi, Phylum: Ascomycota
MSEKKVAVSTDKAPKPLPGIYSQAIKAGGFVFVSGATPTCNIIQDPETGKLIPGDVQAHTHRCIQNLQAILEAAGTSLENVVKVNVFLASMDDFAKMNEVYTTYWGDVKPCRTCVAVKTLPLNTDVEIECTAVL

SEQ ID NO: 496 - protein, 522 aa, Unknown
  Kingdom: Fungi, Phylum: Ascomycota
MNIDIRFRAGTEETRAREIRQREEECSSTILTMSTRMGRRRQGVACKVEAESRIASDTPLARIIGKDGGTHPDAASPEGAGQTLSAPLHVRKSDIMRVQIASLLALASVPFVAANGEGCGASTSKTGWETVYTASGTADVAAAAATAKTSSPTSHVKGKVFDRIAFIWFENTDFNLAAGDPNFARYAQKGIKLTSYYGVTHPSEPNYMAAIAGDYFGMQNDKFNRAPKNVSTVMDLLEHRGISWGAYQEDMPYSGYEGFEWVNHQNGRNDYVRKHNPPVLMDSVTYSEKRLSQIKNISLTDPEHSQFHKDLKEDKLPQWIFITPNMTSDGHDSSVTVAGQWCKTFLDPLLNDPNFMKNTLVVITWDENETYAKANNILGILLGDAVPQHLVGTTDDSFYNHYSEIATVSANWGLPSLGRWDVGANVYRFVGEKTGDKIRQWSKKGNFQGHYWNESYAGPFNSGGGNPEFAAPNLELDHNVAGRDILSSVKKEWKHSTVPTYYEDTIEIPDGLNPPKGYAPVA

SEQ ID NO: 497 - protein, 324 aa, Unknown
  Kingdom: Fungi, Phylum: Ascomycota
MKFLLGSCLALAGSVAAQCDVPASPHWTDFGGPLAQPKNGWTALKDFTMAPYNGGHLVYGSKVQNGAYGSMNFGVFNDFKDMASASQNGMTSGTVAPTLFYFAPKSIWVLAYQWGSTSFSYRTSTDPTNANGWGPEQPLFSGSITDAKYGPIDQTVIGDSSTMYLFFAGDNGRIYRSSMPIGSFPGSFGTASQVILQDTAENLFEAVQVYKMKGLQKYLMMVEAQNNGGRYFRSFTATSLGGAWTPLSGLFSNPFAGKANSGATWTNDISHGDLVRSSNDQTFEIDVCNLQLLYQGRDPNANADYNNLPYRPGLLTLQNPVTVS

SEQ ID NO: 498 - protein, 412 aa, Unknown
  Kingdom: Fungi, Phylum: Ascomycota
MQLPKSLSASVLGLLALLNGANGAAKPSKMVASTYFAGFHANEGFPVSAIPWDRYNDIKYAFAETTPDGGLSIAKAAPDQLPVFVAAAHKHCVKARVSIGGWTGSRYWSTSIGSAANRTAFVKTCLDFVKKYNLDGFDIDWEYPNRQGIGCNAINKDDTANLLKFLQEVREDPHGKKLYLTVAASLFPWNDASGAPSKDLSGFAKVLDNIMLMNYDIWGPWLATGGPNAPLYRSCDARNNQGSAEDAVTSWEAAGVPASKLVLAVPAYAHGFSVTNKDAFANGKLSEYPPQNASIRFQGSSWDNDPPIDECGNKNPPGGTYTFWSLVTEAKFLDNSGNPAPGIAYVWSNCSRTPALYSKERDIWVSYDNARSFAEKGKFILDNKLAGFTMYEAGGDYHNILVNSIRKATGMD

SEQ ID NO: 499 - protein, 862 aa, Unknown
  Kingdom: Fungi, Phylum: Ascomycota
MKFTNFASIWPLATTAVTALTIPDSHPAAGFELGRDIRKRDETRTNEFMTTYASEDILPTSKTVSVSTSTAATGTAVVAPPLSSVNPDLQPHTDGFVISTVENPAETEPPVLTSSIPVPTKLLPPVGSLISSSGAPEETGQTKGPENSDLGKRGTNIFAAPIDTSAPLSMFKRVTDHPVPRKGISKNGPLQTNKFYTNLFMGNQTSPVFTFPYSLAWARGTGPAASWGMAISHVEARQRVFGPVQYNNAARYYLNPIAIQSIIISAKELGKNTVLTTESGTQLYVKAALRKDSSSRPAIIFPIAQGMVFTTAYFSGTTPMIQSSVFFKSMTKVSQDPKTDVRKYNFVLEDGTTWRLYAYRKSGDPLDLKLINNGLAQSTNGFTGYIQVAKDNFMPKSQAVLDNGCGVFPNGVDVEGSVSGAQGSYTLRFTRAGHSAGNLFMFALPHHVSSFDAATRANIKAYQLQTTTKGLATAVIGNSWTMTESALPVEMGFAPRSTMGNRGLSTAAKNAIRPIAHLEVSEDMQAQTNLNSMYFAGKALAKFGTIVYVINNMLGDKALGQAGLNELKKAFSLFGSNKQQYPLYYESAWGGLVSSASYITGQQGFDFGNTYYNDHHFHYGYHILAAAYIGSMDSTWLAANKAYVNHLIRDFANPSAADPWYPQYRSFDWYHGHSWATGLFDQLDGKNQESSSEDIMAAYAVKMWGQVINDSNMVARANLQLAVMARSMQNNYYYTSDNTIQPNNFIGNKVAGILFENKIDHTTFFDSSIEAVQGIHMIPILPTSNFARTNKFVNEEWNAYFSNGRIDKIDNIWKGIIYGNYATVQPRLAWNFFNSTSFKSAWIDGGASRTWFLAYAGALGGI

SEQ ID NO: 500 - protein, 282 aa, Unknown
  Kingdom: Fungi, Phylum: Ascomycota
MLTHTIVSAAALAGLTTALATPTREPAVSPRSAPFIPGGKKAGSAGGNAVPFWQDHLGWWYDWTPQPTSVPGVVSVSMLWGNGQNGPEDAQRFADFENLEETPAYLLGFNEPDCSGQDVSANMGVADAVGIWNEMIAPKGSQGALLGSPAMCMQKDETWLRQFNTAGLSRSWDFTAIHVYKPDMAGVQADIDYYWDTYGKPIWVTEFGCVFDQDNFTPCSDQGQISSWISDVVDLFEGNDHVMAYAYTDGGGLGQAWLPTQNGGQELSESGKAYLSAISKYH

SEQ ID NO: 501 - protein, 247 aa, Unknown
  Kingdom: Fungi, Phylum: Ascomycota
MFFQPLVTSGLLLAVGAHAAMHNSSYNWAGGVVELPGKIIEASVQVVVPECTDSNFNSIAGMSGWVGIDGYGACDDVLLQTGFGCSIINGDGKQNLSYNAWTEWYPAPSVTYDNFDIKAGDLLSLSVSAKSKTSGSTSIYNHRTGQRKETQYTDQPSLCFDYAEWIVESEFFEDHGIVGGELTANFTPVDFKQASYLTSDHKTGTVAVDDLFNMVQNDNTTVAESCFKSAGNFVVRFTQPASWHPWE

SEQ ID NO: 502 - protein, 323 aa, Unknown
  Kingdom: Fungi, Phylum: Ascomycota
MTSSLDQLKATGTVVVSDSGDFASIAKYKPQDATTNPSLILAASKKPEYAKLIDVAVEYAKDKASDVDAKVEVALDRLLVEFGKEILKIIPGKVSTEVDASFSFSTKASVDKALRIIDLYKEQGIEKDRVLIKIASTWEGIKAAEILQRDHGINCNLTLMFSPVQAIAAAEANAYLISPFVGRILDWFKASTKKEYSKEEDPGVASVKSIFNYYKKYGYKTIVMGASFRNTGEITELAGCDYLTISPNLLEDLLNSTEPVPKKLDASQAASLDIEKKTYINEEATFRFDFNEDQMAVEKLREGISKFAADAITLKGIIKEKLA

SEQ ID NO: 503 - protein, 428 aa, Unknown
  Kingdom: Fungi, Phylum: Ascomycota
MSAPAHKFKVADLSLAAFGRKEIELAENEMPGLMQTREKYAADQPLKGARIAGCLHMTIQTAVLIETLTSLGAEVTWTSCNIFSTQDHAAAAIAASGVPVFAWKGETEEEYNWCLEQQLTAFKDGQKLNLILDDGGDLTALVHNKYPEMLKGCYGVSEETTTGVHHLYRMLKEGKLLVPSINVNDSVTKSKFDNLYGCRESLIDGIKRATDVMIAGKVAVVAGFGDVGKGCAMALHGMGARVIVTEIDPINALQAAMAGYQVIPMEKAASIGQIFVTTTGCRDILTGEHFEAMPNDAIVCNIGHFDIEIDVAWLKKNAKSVQNIKPQVDRFTMASGRHIILLAEGRLVLAQIMLYKAADQEWAKKYVEFAKTDKLEVGVYVLPKILDEEVARLHLAHCQVELSKLTQVQADYLGLTVEGPFKSDIYRY

SEQ ID NO: 504 - protein, 362 aa, Unknown
  Kingdom: Fungi, Phylum: Ascomycota
MKFSSLFNGGLALISLPLALAANSFSASNLYYAAGLTVDQQHTLLSGLQSAGVKVLRVWLDGQSGTVKGTPINGFNGLEGSSPASWDDTVLNRLDDFMANAHGYGIKLLVSIHSYNALAANVDFYGKWYGTGDFYTNGDAIQYFKNRIAHVMAHVNPHNGKPWSQSSEYIFAFEAQNEAMHDQANPSALQSWQCTMAQAIKDNLKGSTAILVSTGGGAWLANSLLDGYFSCAALDVLAIHAYGVGDFATSALKPYVTRAQQAGKKLIMQEWGACYTTASNNNCNGGSPLNSGTRDNNIKNWAASITAAGIPWFYWQILPNEDPHQGWDYEVGINGVNWNSLKAAGLAAGQAQAAFDFSKWLL

SEQ ID NO: 505 - protein, 185 aa, Unknown
  Kingdom: Fungi, Phylum: Ascomycota
MHFHQALITFSLALTGAQAQCVGPDINAAAIDLIKSFESWQPDIYIDPTGNPTVGYGHLCADSSCSDVSYPIPLSVADGESLLRDDLTQFQDCITLDTTSNVVLNANQYGALVSWAFNVGCGNAGSSSLISRLNNGEDANTVIAEELPKWNKGGGEVLPGLTRRRAEEVELAQTATSDPALPACS

SEQ ID NO: 506 - protein, 267 aa, Unknown
  Kingdom: Fungi, Phylum: Ascomycota
MASLLRTLAPLVALLPATALAGSKSCPGNLPLSCHNNTAVEDTCCFIPAGQLLQTQFWDTQPATGPADSWTIHGLWPDNCDGSYPKQCDSSRAYTNISDILTANGAGATLDYMQKFWKDYKGDDETFWEHEWGKHGTCISTLAPSCYDGYKPTEEAAAYFSRTVELFKSLPTYQWLADAGITPSGSKTYALDKIQSVLQAKHGAKVTLGCKGKVLNEVWYHYNVQGSLQSGKFVAAEPDGAKGKCPSKVQYKVKSNSTSQRGYSFAA

SEQ ID NO: 507 - protein, 536 aa, Unknown
  Kingdom: Fungi, Phylum: Ascomycota
MADIIAQLEVLSRDSGCLLDLSALIDLGVCKNIDIKTDRPHKIEQKDDYVCVTPTGPKPKPKPVPSTHYTKRCEKPGGCYEVTEAVCKKPTVVLDLELLVLLGLLTEEQLEEYMKTTGAIGENDNINVEDDEVTVDPLLSVQLGDNGDILNLELLGEDGLLNLDLLNQGKSKRSYGSYGSYGPGSGNGGDGSSEDGSSSGGIDQLIDIDALGQTDKGKPALIDVDLLNHERRDFDQLIDVDALGTTDKGKPALIDVDLLNQNKRGYSNQLLNLQVGGKKKGGKPAIIDIQALVQGRKRADQPLLDVDALGDAEDNNALIDVDLLTNLLGGDKQTSGGSSGSNGGSSGSSGSSGSGSSSGGDRPLLDVDALGDAEDNNALIDVDLLTNLIGGGKNGGGSTDSGTKPITPGGSQPTTPGGKKPCNACSKGLKKRDNYLTHYQPICGKGFKKEHRDATDKCHATDVNHCLSLCQSKAALATIDAKVKVGDIANILVCAAVEFNSNEAGDNCHWLVAPETEPCHDDQLEPVQDCTAFVRN

SEQ ID NO: 508 - protein, 279 aa, Unknown
  Kingdom: Fungi, Phylum: Ascomycota
MDKSKSVSAYYAPRGGLPPQTQILTDRAMFTESYAVIPKGCYSDIVTSFLPFWERTRLWVIARPLSGFAETFSQYIMEVQPGGGSDRAELDETAEGVLFVVEGEVTVTLSGEDHTLHAGGYAFLPPKSGWTLRNKGKDDARFHWVRKAYEYVEGLPVPDPIFLNEADIPPTPMPDTDGAWATTRFVDPSDMRHDMHVTIVTFQPGGVIPFAETHVMEHGLYVLEGKAVYRLNQDWVEVEAGDFMWLRAFCPQACYAGGPGPFRYLLYKDVNRHAKFRLP

SEQ ID NO: 509 - protein, 616 aa, Unknown
  Kingdom: Fungi, Phylum: Ascomycota
MLRSVLSLAAVAGLASAVTIAEINGNKYLSPLNGTKVEGVKGLVTAKNGQGVFLRSTEPDDDERTSESVFLFNSAVRGQVKVGDIVTLDARVEEYRSNVLHAYLTELTNPSNVKVVSSGNKVTPLVLGEDTASPPTELFSSLDEGGIFGVPNDVTRISAQNPTLQPDKYGMDFWESLVGELVTIKDVVQVSRPNTYGDVWVRAGSLKATGVNAHGGITMLDGDANPEAITIGTPCDGTKNPSDTKMGDELGDVTGIVFNAFGFYRILPLTAVSPVKNATADYPPVSFNSTGDCRGITIGSYNAENLNPNSAHLPGVVDQIIEMLRTPDVIFLQEVQDASGDANDGVVSGNATLFALSDQIEQKSGVVYDWAEVEPVNNQDGGAPGGNIRQAYLYRPDVVELYNPNQGGPNDKTEVVTDAENPKWPTLSFNPGRIEPAAEAWANSRKPLVAQWKPVKGTGKTFFTVNVHFGSKGGSSSVHGDPRPPINNGVLKRDEQARITADFIASILEADPKARIITAGDFNEFTQVQPIQTFMSRGSMLDLDEVAGVAPEERYTYLFDMNSQQLDHLFVSEGAVSPKKGATLLEHLHLNTWQNFDGQVSDHDPSVARLNLCGCA

SEQ ID NO: 510 - protein, 341 aa, Unknown
  Kingdom: Fungi, Phylum: Ascomycota
MRFSVTSVLAAALLTAGLALGQATGTIAKGAVPKDLNGSNFTYPFPVQVFQFKSQNDNLQMAFMDVKPKCKPNGKTAVLLHGKNFCGATWETTIRVLTQKGYRVVAPDQVGFCKSSKPTHYQFSLRQLAWNTRGLLDTLGVENVTVIGHSFGGTLSTMFGLQYPETVDELVLVNPIGLEDYSGKGVPYISIDNHRVNEAASTYQSIRGYEQAVYYLGQWKPAYDVWVNMLVNVYYGSQRDAFIHCQAKIVDLVLTQPIAQYFKQLKPRTALMIGAKDTTAIGAQWAPPEVAQQLGHFDVLGPQVASEIPNGHLISFPSEGHAPQISLPGQFHEKLLAWLST

SEQ ID NO: 511 - protein, 423 aa, Unknown
  Kingdom: Fungi, Phylum: Ascomycota
MRTSMIPIWGTLVTVVAGQVTVSLSHFPAIALKADRAVTSATELFRQSCPEEVAKSLGFNPEVLMSSYADFGEDDSSVFPEGSVYPSSDSIVRGAVEAWAQHQNLVLRPDEIWFEILAQLNFYMTAHAEDVRHLFVTHEGKEEIQVWDFTWKDVIARFGDEIQQRVLTDWLLEWIMPGFTTSTTNDGMTATVLMMGLMQHYFSFSGGITCGIPKVTLLGVKEDWVRLAEKLDHLADWGDEPAQYAKNLAPILEMFVRTWEEPRSKSVTDFWKQIVRTHKQFSCGAGPTEYDISGWITGFLHWREDGSVRVWDAANIQPSEYTTTVGNVTYAPQALSDLPTGYAKAPLKMLDYPAPGESTQAFLLAGNIGVQRSVGSEGGWATAKPMSSWFMYAPVDANATTPRTYGSAIELQNLTEGARTCQL

SEQ ID NO: 512 - protein, 625 aa, Unknown
  Kingdom: Fungi, Phylum: Ascomycota
MRSPGLASAVLCLASIASASFEGNLNYESPSRRHAGLGLNVPLIERRSWKRDNVDYKPSDLSFTHGVASGDPWADSVILWTRIAPSNKSDDSEVTVDGTAPLYSHETEKYIKADSNPICVEWKVFTSRKGKSTGNIVRSGKAYTTSDIDYTVKVEAKGLRPLTEYFYQFNVCGSGSNKSILGRTKTAPRANDAVSSLSFAVFSCSNYPNGYFNAYGNAARKDEQDFVIHLGDYIYEYAAKGERASNPPNEIFTLYDYRTRHGQYRSDKDLQLLAQNHAWITTWDDHEFANNGYRDGFSGLNNTEDSFLNVGPKVSVDTRKVHATRAYFEWMPIRQTDLDDGLRVWRSFQMGKLLDLVILDTRNYDRSITDLGWNYDYIDLIRDDPSRTMMGSRQENWFYNSLSQSQQRGATWRIVGNQVIFSRILENDKGALSGDNWNGYIANRNRTLQHLYDNKITNSLFLAGDSHQNWVSDLAWLGTKDYDTNTGEGAVGVEFAGTAVSSSGQTGPIEPKAGDYARGMIKRNDELQWQEGYYRGYFVLNVNPTEATAKFYGSPSVATRNSWDIPLANFTVKAGANHLERPVAGGRVESGALRGGEVKHTNLTLNTDNGEWKVIGFDKMFIPKP

SEQ ID NO: 513 - protein, 338 aa, Unknown
  Kingdom: Fungi, Phylum: Ascomycota
MRYSASIVAGATALLFGGAQAQYSLTNTYDASNFFDSFNFFTGSDPTHGFVEYVDGPTANAENLAGTVDGAIFMGVDKTTVNPPKGRRSVRLESRDTFTKGLFIVDVAHMPASECGAWPAFWMFGDGSPGWPYQGEIDIIEGVNNQVSNINTLHTGPGCSIANVGSANGTHLEGGDCNAGNANVGCGQQTSNNQNYGDGFNDIQGGVYATEWTSDHIAVWFFPRAAIPQDILAGAPNPASWGPPQARFNGGQGCNIDEHFYGHKIIFNTTFCGDWAGSPEVWSSNPECSAKAATCIDHVSNNPGAFEDAFWKVNYLKVFSANQTNQTKREVVPTAFRA

SEQ ID NO: 514 - protein, 399 aa, Unknown
  Kingdom: Fungi, Phylum: Ascomycota
MRATAAFVVGLSAGGIATASSLHQQHIRDTPGCGKKHNGSDSTFPGSLVSGGMQRNYSIHLPANYSADDPHPLVLGFHGSSSIGLFFEADTHFSDVADRTGDGVIMVYPDGIGGAWAGANYSAATVRQDLDFVLDLLSDLRHQYCIDNDKIFATGMSIGGGFVDTIACNETVGGEFAGFAPVAGAFYTDNDENYKKCEPSKPVYMMSFNGDKDDSVPYDGGEGSGGELPAIPEWLDRWADRLGCDQSTYTRESADKSYETEYWNCRKEGRLVHLKLAGRHHSWPSDEPNFSQQLAGDKPSSFDAANVILNFFLQPNWRDPNWSPEEAGANVPGAEETGTTPAAESTTAAETGTTTTSSGSATKSATASTAEASPDAGSCLGLDMRVASLVLLLQLLLRT

SEQ ID NO: 515 - protein, 266 aa, Unknown
  Kingdom: Fungi, Phylum: Ascomycota
MPQQIPTASRLLDLFNMKGKVVVVTGASGPRGMGIEAARGCAEMGADVIITYASRKEGAVKNVEELTRDYGVKAEAYKVNVSDYNDVQRFVDEVVSKYGKIDAFVANAGATADAGVIDGTVEQWNKVIDIDLNGTAYCAKAVGTQFKKQGHGSLVITASMSGHIVNYPQEQTSYNVAKAGCIHMARSLANEWRDFARVNSISPGYIDTGLSDFIDQETQALWRSFIPMGRNGDAKELKGAYVYLCSDASTYTTGADIVIDGGYTCR

SEQ ID NO: 516 - protein, 250 aa, Unknown
  Kingdom: Fungi, Phylum: Ascomycota
MSTRGLLLTALLSGLSASQSNINPDAEGACDPTQGGDGACGPNGSEEWLNSGISGDGWSPPFLDINGLSHVSLEDYYGGVGSACAQYDDNFRASGEKYNIDPAILAFIAMQESSCNADEGGPTPGLMQCDPSNCPNGSGSCQYPVQDNVDCGAQVLRNYLDNAGGNAVHALGAYNGWFTADDNTGLNGGKGLTQDYPCSGEGQSNGVPQNLNYLHQVLNGWFQGYDIYGDDSGLGGSYNCQGNCDNGALC

SEQ ID NO: 517 - protein, 432 aa, Unknown
  Kingdom: Fungi, Phylum: Ascomycota
MRQNVLLVPLLSLAVKAWLPESRDLAAFNQTARFEKLGKRFEPSLPDGVTKIRGVNFGGWLISEPWMMGDHWRVEMGCGDQGTELDCMTNVYGGDNRDNGNQAFQKHWEEWINPDTVQSVHDVGLNTIRIPIGYWAYSDIVDYDTKPFPDSGPMLDLLDNVVEKAAELGIYVIIDLHGAPGAQQEDAFTGQTQSPAGFFTEENFGLAEQWLSWMTTRIHTNDAYRSVGMIQVLNEPVSSHDGDRYPAPGQVPGLLESYYPGALAAVRDAENALQPPVADESRLHVQFMSEKWGSGDPRTVPEITADPAVAFDDHNYIGFALQGADRADQFKLMNLACTDSRLVDGQDLIIAGEWSMTSDVAWQDADFFKKFFTAQQQLYEKPGMAGWIFWTWKTELDDPRWTYSKATFENLIPQDAAGLENNVFQDVCAGFT

SEQ ID NO: 518 - protein, 297 aa, Unknown
  Kingdom: Fungi, Phylum: Ascomycota
MKTAIVIAGLGALGAQAVRIIQSNDDGWAESYIRTLNDALNEAGHDVVLSAPADNKSGSSSLDIPPSPRKQPCQYNSCPANSGPVGSDPKRPDLNWVNSFPVTSIRYGIDTFGPQMWDGEAPELAVTGPNVGTNLGIQVPFSGTVGAACYAAHDAGIPAIAFSGASEGNLPYTDPAPPRSLIYAELATILTDKIVESGKPYLPDDVFLNVNFPEVQQGCNKVEDFQWVLSRITWGLLSPKDVTWCGEDRLPQENDVLKAGCYISVSVGDAKDKTTSNDVKKQQAVLTKIQDLLVCLP

SEQ ID NO: 519 - protein, 169 aa, Unknown
  Kingdom: Fungi, Phylum: Ascomycota
MASITTTLRAVRPAVMRLAPRAAPVARVPFRSFSATRLSLARKYTKDHEWVDLSADGKTGVVGISEYAAEQLGDVVYVELPEGGEWIEQGDTLGAVESVKSASDINAPIRCKVTAVNELLEEKPATINRVPEDDSNGGGWISKIEVDAEGAKQYEGLMDADAYKAFISE

SEQ ID NO: 520 - protein, 437 aa, Unknown
  Kingdom: Fungi, Phylum: Ascomycota
MRSFTSISLAATAFIGTVAAATSGSISLLTMNVAGLPEALQGNDVPGDKATNARQIGTYFAQYNYDIIHIQEDFNYHAHIYATDSHPYRTATSGGVPFGSGLNTLSNNWWFDFRRIKWNKCSNASGADCLTPKGFTFMRMHIDDGVYVDVYNLHADAGTESDDLSARASNIQQVADYISYWSEGNAVIVMGDTNTRYSRTGDNIRVLMTQNNLSDAWIVRERGGVVPTQESLCNNPSLVNSCEIVDKILFRGNAITSLDATFFNYESSKFLQPDGNILSDHNPITVDLAWKSSATRRQSDFWGGPHGDWFNDIGSLGDNPKTRIITFSGASRLDSVGLTLTSGTRFSHGGSGGTQVSLTLDASEYWVSAKLCQSKHNNTTRIFYIQATTSTGRTLASGTQTGECVTYSAPTGWQIVGYIGQSVDEVDLLGFIYAPQI

SEQ ID NO: 521 - protein, 355 aa, Unknown
  Kingdom: Fungi, Phylum: Ascomycota
MLHAPSQVSSDSHQDKTTSRVNMLTMKSVTNLLAAGLLLAGQTVYARSNAGAFDDSDDTPLPLVIWHGLGDSFDADGIQQVGKLAEEINPGTFVYTVKLAEDGNGDRSATFFGNVTQQIESVCEALATHPILSTAPAIDAIGFSQGGQFLRGYVERCNSPPIRSLVTFGSQHNGIIEFRACGTTDWLCRSAMALLRFNTWSTFVQNRLVPAQYYRDPSTLDTYETYLENSNFLADVNNERILKNKAYADNIAKLKNFVMYLFEDDSVVIPKSTSWFQEVNGTETIPLRDRELYKQDWLGLKRLDEAGGLHFLSITGEHMDIPEDVLNKTMVDFFGPYKRKFGSSGPAGEALSPEL

SEQ ID NO: 522 - protein, 319 aa, Unknown
  Kingdom: Fungi, Phylum: Ascomycota
MKTAPLWLAIVLTLAPAIVAQGLRQATGGSGTATYTHQWYPEPSEEVSDCEAKLITTLCDYKEPLSGTAVASSGKKSCWEYCNKNPPCNFVIFVAGNPYTGSGTCWVYPGEEFDEGAGEPGCDALSVFDKPVCAGNTTPTSGACEATTSPSALAEICGYPTPDDSCFSSCAASGGASSCMSQCVEADSCSYAVFNPHNGNNSPYHPGTCWMYLSGTFDKSKAKTCKGDPEQFVYENPCPKPRPSSSVPSSASRTSSSGGDNDSSRPSKSSEAGSDQDSATEDQDRSKKDEDNDNSSTMVGVSLSSLITLGLTILMWQNF

SEQ ID NO: 523 - protein, 296 aa, Unknown
  Kingdom: Fungi, Phylum: Ascomycota
MGLIQASTAILVLLAQAGLASPLVARAEASSTILSVPESTSSSTPEYDWSSGWETKYQIHHSCNSTYRHQLEAALAEMEQLATHARDHLLRFGNKSEIVQKYFGNGSTAEPAGWYDRVVAADKSAVLFRCDDPDQNCKTQDKWAGHWRGSNATSETVICDRSFEIRRWLSGMCGLGYTVAGSPLNTFWATDLLHRVLHVPDISEGLVEHYAEDYADALRQAKEEPEKSAHDSDVLQLFAVDAWAYDIAAPGVGCLGEVVEEKPAESVPSATASAAPSAASVANSACHTHDDGFVHC

SEQ ID NO: 524 - protein, 263 aa, Unknown
  Kingdom: Fungi, Phylum: Ascomycota
MDASPVFQYGPPVGQGPGRLLRPSISAALPGLSSSLPLPCPWYSDLQVLMTVLLPLPPHDEKLPTVRAKTPPKPPSTIAHVNTIAINPCDRHRLRYLLPTLCPPCGRHFPNPAILADSLTEEQVSEFKEAFSLFDKDGDGQITTKELGTVMRSLGQNPSESELQDMINEVDADNNGTIDFPEFLTMMARKMKDTDSEEEIREAFKVFDRDNNGFISAAELRHVMTSIGEKLTDDEVDEMIREADQDGDGRIDYNEFVQLMMQK

SEQ ID NO: 525 - protein, 454 aa, Unknown
  Kingdom: Fungi, Phylum: Ascomycota
MKTFTLALAAMAVGAHAHSGHHHAHLHKKDAAAPVVDKREPAVVTKYAAAATNVVYELNGKILSPEEAKAGIKEGDFVVVGETEPTYTPPPPPPPPPPTSTPKPKPTTSSVDLGAQFIESLSSEAHTTTTATTSSSVAPPPAPKPSPKPAPAPAPAPAPPASSGSSSGSSGGQGLNRPFPDGEIDCSDFPSAYGAVGLDWLGFSGWSSLQFTPQFNWNVQSISEIITGVSGQSCTKGCMCSYACPPGYQKTQWPQAQGATKQSIGGLWCADDGKLYKTRKSSNTLCEAGAGGVSVQNKLGVQAVLCQTDYPGSEGMYIPSVASPGSTIQITNPVQSEYYQWNGMATSAQYYLNPKGVKKEIACLWDSPNTPANTGNWAPVIVGVGKASDGITYISIFQNKPTSLQKLDFNIKIVGDVSSECSYDANSQTFYGGNDPDGCTTGMSNGGTATIVFS

SEQ ID NO: 526 - protein, 472 aa, Unknown
  Kingdom: Fungi, Phylum: Ascomycota
MRASSGFAWLAIATQALAAPQPVADNCPRTTLTSTIYKTVFETSALPKTTTSKATSQTATTTAVAADSTLVSALTNIRATTSGYRNILYFTNWGVYGAQFFPKDLPVDKLTHVLYSFGDINSNGEVVSSDSYADVEKQLPGQTIDWNSPVKKAYGCVGQLMELKKKNRNLKVLLSIGGWTYSQAGKFRVPSSTDAGRKRFAESAVKLMANWGFDGIDIDWEYPENKQQGDNFVLLLKACRVALNNYATRNKQSYHYELTVAASAGPAKYSLQNLKGMDSYLDAWHLMTYDYAGTWDTTTGHQANVFKDTRNPLTTKFDSDSAIRDYISRGISPGKIVFGLPLYGRSFGNTNGMGKPFSGPGRGPLEAGMYLYKNLPANGARATFDSKTGGTWSYNSATKELVSFDGPKSANFKADYIIKKGLGGSFFWEATGDKQGAQSLVGVMANRFQGRLQRKQNMLSYPESQYANIKNR

SEQ ID NO: 527 - protein, 381 aa, Unknown
  Kingdom: Fungi, Phylum: Ascomycota
MKLKLILLSTQVLAARPFLEEPDTGLESIFGDVQFGSLPDLKSIVGLPDFQWAARNYLPLSNFTYYRNAAGGEWSYRNNLEVFSRYSLRPRFMRDVTRTSRTMQTSILGYNFSAPFFISPTARAGFGHPDAELNYVRAAADQDILYIPSLRATLSIEEIAAAKSPNQTTFQQLYLPPSGKLSDELLKQIEGSGARAIFLTVDSPANGDRQRAFREQGSIPEAEYRYLTWDTYDEIASRTDLPVVLKGISSVADAREAVKHNVPAIFLSNHGGRQLDTAPSALEVALEIHEEAPEIFKQLEVYADGGVRYGTDVIKLLALGVKAVGLGRPFAYANVYGFEGVKKAIEIMKREIAVDAANLGVVDLQNVDERLVNWKPNNWNQ

SEQ ID NO: 528 - protein, 473 aa, Unknown
  Kingdom: Fungi, Phylum: Ascomycota
MIFPRSVVALTVLPSQLNISSPYSVRNAAATLAYDTMKYYDGNVSTDPLQVGDLHKPYYWWVAGLLWGTMLDYYHLTKDPTYNDVVIQALLAAPNLGENQDYVPQDRSLEEGNDDLFFWGTAVMAAAERNFPQPNANLPSWLQLAENVFNSLVSRWNISNKCGGGLLWQIYATNPNGLTYKNSVSNGGFFHLAARLHRATGNATYLEWAEKVWDWSVDIGLVDNQTYHIYDGVNINDNCQTVNRQSFTYTSGIYLYGAAVLANQTESQTWSDRAQGLLKGGDWYFSPYPNATDVMYEAGCEPYERCTVDASTHKSVLARYMWQTIQMMPSLREDIETKLNASAKAAAKSCTGGQDQRTCGLKWYTGAYDGNPGLGPQVNALGTIQGLLIDESAPPLKGDQIQTIRDTNWTALDTYKPDSPPPPPPPPEEPKNNTDTNKDGKDEEDAAPCRRSDGGLMLGAMTLAVAAGILLVV

SEQ ID NO: 529 - protein, 289 aa, Unknown
  Kingdom: Fungi, Phylum: Ascomycota
MAPTGTGHDATGAARGNPTSQASTAATRREDTDTSSAAPAPSPPKAPAGDPQPQRQLGPSSGSNAHWSSLLAENIAPRLFFVLSAFLLLAAYIIFVFPSTPPHQVSSEICSCPTSESPLLSSLQPASPTAVSNITMSSAEQTFIAIKPDGVQRGLIGPIISRFENRGFKLAAIKLVTPSKEHLEKHYEDLAGKPFFAGLIEYMLSGPICAMVWEGRDAVKTGRTILGATNPLASAPGTIRGDFAIDVGRNVCHGSDSVENAKKEIALWFKEGDVVSYKASQFNWIYEKA

SEQ ID NO: 530 - protein, 311 aa, Unknown
  Kingdom: Fungi, Phylum: Ascomycota
MGVLWLLNFVLIAFPIGTTVGVLMGLQKHRIATGQPPLFVDNGIKWNNYCDKTLGISPPSKGDHYTLNPNQWGVTADTVGSLCMNVTTFNNETYATDATAPEFAVTWIYNQGPETAPVHAFPNCKVASQVFPASFNNINKLMLDLEWTYGLGNNTAVSTSKTDLEKNLVNTNVAIDIFADPDQNVATNTEKAKMEIMVWFAAYGPATQPLGMATTGIVETQVVEGISFDLYTGENAAGQKVFTWYSATPIHNYTGDLMPLMDILLAKNDPDYPSTKDYIGYMSLGSEALSANTSVTFHVPTLAIDVELKQS

SEQ ID NO: 531 - protein, 407 aa, Unknown
  Kingdom: Fungi, Phylum: Ascomycota
MPDLSKHIAILSLLTSVALVSASSSHGIAVDLPRRQDDCNAVHLFLARGNNEPYPGRQQAMVQAVCDGVSNCGYEDLIYSALYTDLSCQTAYDAVHAAYAQVSQYACRCPDAKLVLTGYSQGGNIYTDFLGGGGGELFNECIQPETPALDRKTFPGNRIDAVVVFGDTRHTANQPYNVGGGSGINGIFPRPDSQLEALKDWTDILYSYCGANDPVCAAGQDKNNYNVTQHLTYYDTHAGEAAAWIKKVAKIEDNDPGFVTQVPTSLSGTAQEYSTIATNYVPSGTVASVPISTATCSTTSKASSTRTSSTHTSLTHVSSTHMSSTHVPSTRMTESISESTSANAESASALTTATSSTAAESTTEDSTTSVTETSAAAAETTASDDGAASLGSVGLLGSFFLAAAAVL

SEQ ID NO: 532 - protein, 509 aa, Unknown
  Kingdom: Fungi, Phylum: Ascomycota
MTPISIAVGILAFASTAQASGAQTLLDPVRPILTPDGALAKNPLGHLGGNGPWQPGPNVHGISADVPEGCSVDQAAYVLRHGSRYPDPGAHGGWLEMIKLFKEKNYKATGPLSFIHNWDTPLEDPAIQIAQVSKTGYKELFDLGYTLRIRYPDLYKEGDEFIVWANKYPRVIQTAQLFVQGYLGANSSLGTVVSVAGKGFPEHLGDTLAPSDMCPSFVDDSSVQQNAWQAKWMPAYINRLSKYIQGDLNLTDSQWNSFPYICGFESQIRGRLSPFCDTFTQEELEQYEYQQDLRYYYGVGPPVEVASKMMVPFLDSLMERFSAGPDAEGTDFNGGKFKVPKLLMSFLNDGQLNELVVASGIFDAQKPLPVDRIAKDRLWRNSAISPMRGTIAFERLNCRKPSPPPTSTRSCKPRPTGKSSPRPKSPQAPEQTYIRIRLNDAVYPLPSCQDGPGKSCSVRKYADYVNNKLQKQGSFAKICNATDPATPTKVAGASFFTNLAQSHLQAVEV

SEQ ID NO: 533 - protein, 916 aa, Unknown
  Kingdom: Fungi, Phylum: Ascomycota
MTSQHSNTDDSVERRDSTGEHVVDEKKGTAPSSDVQRVDTEVINLAGKLGEREDGLAPLDDIAFVMPRIEVMTVDEAREIVVTMLEEHKYDYNFSEAQRVKLRKLLEGVPEGQTSDEWELELKTEAAVMRYYSPYPEVRAVTNPTDDPDMACETIRAHLLGYLWACLAQFTNSLFNSRFPQIIVSSVVMQLLLYPCGVLCARILPDWGFNLQGKRVSLNPGPWTYKEQMLSTIIVDVGLTSAYCFWNIQTQTVYYGDKWLTPGYGILLLLSTQLMGLGFSGLLRRFVVYPTEALWPSILPSVALNRALLVPEKKETLHGWSISRYRLFWYITGAMFVYYWLPDYLFQALSLFPWMTWIAPNNFNLNLITGSQTGLGVNPIPSFDWNVISTYSQPLAAPFFSTAQQYIGTWLGFFVIVGLYWTNTRWTAHLPANSSGIFDNTGARYNITRVLSPGTAILNEAEYEKYSPPFYSAGSLVTYGSFFAFYPFTFVFIILDMWRPMWKAYKAMAQDAVESTSRIIVSIKRSAAALLKGDFRGAYEAFNTKGGTSIYDGFDDPFIHLMKKYPEVPDWWFLIIALVAFIFAIVIVQHWPELDTPVWTIFFVIGLNLVFLVPMSYLYAVSGTTEGLNVVTELIVGYALPGHPEALMFVKAFGYNINGQTDNYISDQKMGYYAKLPPRAMYRGQVISATITALVAYGVVQFVDTSIDGICTPDQSSGFNCENGSQVYYSSSVVWGAIGPKRTFSQLYPELKYTFLLGFLLALVWWGVKRTGSRMRQGVKNVIPSGLFSVLNTVLFRPIASLQHVHPSLIFNGMLTWAPLNMSYYTGGLYFSFAFMFYLKRYKTAWWEKYNYIISAALSGGVAISGIIIFFAVQYHNKPIHWWGNDVLGNTIDGGGASGQVALMPPTEPFGPTTWY

SEQ ID NO: 534 - protein, 653 aa, Unknown
  Kingdom: Fungi, Phylum: Ascomycota
MAPAVGIDLGTTYSCVGIFREDRCDIIANDQGNRTTPSFVAFTDTERLIGDAAKNQVAMNPQNTVFDAKRLIGRKFSDPEVQADMKHFPFKIIDKASKPVIEVEFKGETKTFTPEEISSMVLTKMRETAEAYLGGPVNNAVVTVPAYFNDSQRQATKDAGLIAGLNVLRIINEPTAAAIAYGLDKKVEGERNVLIFDLGGGTFDVSLLTIEEGIFEVKSTAGDTHLGGEDFDNRLVNHFVNEFKRKNKKDLSTNARALRRLRTACERAKRTLSSSAQTTIEIDSLFEGIDFYTSITRARFEELCQDLFRSTIQPVDRVLSDAKIDKSQVHEIVLVGGSTRIPRVQKLITDYFNGKEPNRSINPDEAVAYGAAVQAAILSGDTTSKSTNEILLLDVAALSMGIETAGGMMTKLIPRNTTIPTKKAEVFSTFSDNQPGVLIQVFEGERQRTKDNNLLGKFELTGIPPAPRGVPQIEVTFDLDANGILNVSAVEKGTGKSNKIVITNDKGRLSKEEIERMLADAEKYKEEDEAEGARVAAKNGLESYAYSLRNTLSDPKVEEKIEAADKETLKAEIDKVVAWLDDSQSASKEEYEEHQKELEAVANPIMMKFYGSGEGGMPGGMPGAGGPGGFPGAGGPGAAGAGGDDGPTVEEVD

SEQ ID NO: 535 - protein, 219 aa, Unknown
  Kingdom: Fungi, Phylum: Ascomycota
MRSLLVLTAGLVLAYAAVKVPCCPHKATITYDKSVPDKTPFHLTQVDLCYTADSLELTFTAYNETNFHFDPSQGTNDDIWAYEVMEAFIHRGTHDPQTYLEFEVSPNNVTYQAFIYNPSKVRAEGAPFDHFFVSDPAADGFSAETTLDRDAETWVSEARIPLGLFNVDKGEAKGTQWRMQFLRTVTSPATFPHQELGAWNPPDVASFHITPEFGHLEFV

SEQ ID NO: 536 - protein, 144 aa, Unknown
  Kingdom: Fungi, Phylum: Ascomycota
MSSTTQSVQCFGKKKTATAVAHCKAGRGLIKVNGRPLSLVQPEILRFKVYEPILVVGLDKFANVDIRVRVTGGGQTSQVYAIRQAIAKSLIAYYQKFVDEHSKNLLKQALVQFDRTLLVADNRRSEPKKFGGPGARARFQKSYR

SEQ ID NO: 537 - protein, 701 aa, Unknown
  Kingdom: Fungi, Phylum: Ascomycota
MADRDEARMSGHFHDQHRPHHHQHHSVSVPGEIPIPHGPGAESESEDDYPIHDAATAHERRIFSHVTRPDDSYTSDGVYWADLPWLQRAKFVAKVDREAAAEELKTTGAMIKKDPLSPLSWYFRNAVIPGAGLGLEGYVLFSIGNLEPLFAKVWPECWEKHEVCSKNWVSSVTYLEIIGIMVGQVGVGIIGDWVGRRWGLIQDAIIMFIGLLMITASWGLTLQGWVICYAWSLFFYSLGVGGEYPITATSSLENAVSAGKLSTREDRLHRGRRVTMAFLMQGWGQFVNQVLLIVLLVIFNSGDGGPPYTKSAAQWCFRLSFAFPAVGTAWLAYYRTWKMPHASKKLAEAKTRSKVTGYDINSLRYCFKHFGGRLLATAGTWFCNDVFFYGNKLFQGQFIKVISSNPGSLMTTWTWNLVNITVSLAGYYLASLLIDNKLYGRKMMQQVGFLMCFLMFVIPAFNYEHYSSPAGIHSFQAMYFLSSFFNQFGPNSVTFLIAGEVFPTPVRATAHGFSACIGKAGALLASVLYNYIDTQTKFYVVPWFGLAGMLLTFLFLPDTTGLDLKEQERRWGYLTSGRADEYHGIAVHPKHLSLWERMWGVGKSYDPELDWKAKIEDMRREWHDFQEANASLKAAENGGTDSAPNNGLPEDGEFSQEIHDYFKRSSPRVPGRGGVLNNPEKEKAADPSEGSSSASGTRKES

SEQ ID NO: 538 - protein, 519 aa, Unknown
  Kingdom: Fungi, Phylum: Ascomycota
MVHLATIPAHERKKGESSSAATHQKARLQISDYADEFTTSVYGSKYARNDLPRHEMPDGQMPRDVAYRMIKDELSLDNNPMLNLASFVTTYMEDEAEKLMAESFAKNFIDYEEYPQSADIQNRCVNMIGALFHAPSDGSAIGTSTVGSSEAIMLSVLAMKRRWKNARKAEGKPFDNPNIVMSSAVQVCWEKAARYFEIEERYVYCAKDRYVIDPKQAVDLVDENTIGICAILGTTYTGQYEDVQAINDLLIGRDLDTPIHVDAASGGFVAPFIVPDLKWDFCLERVVSINVSGHKYGLVYPGVGWVVWRSPEYLPKELVFNINYLGADQASFTLNFSKGASQVIGQYYQLIRFGKQGYRSIMSNLTLTADHLSDALEELGFIIMSERGGAGLPLVAFRFKSVEEGGEERNFDEFSLAHQLRSRSWVVPAYTMAPHTADMKMLRVVVREDFTKSRCDLLIKDIKLCMEMLSQMDNEAVKRLKDYSKQNVVKAHQSTHNHHKYKNEKHSLQGKHGKTHGIC

SEQ ID NO: 539 - protein, 381 aa, Unknown
  Kingdom: Fungi, Phylum: Ascomycota
MADELELDCNGDAVDLGQRGLRIASIFIIGSAALFGAMLPVLLARQSKMHVPKFTFFICKYIGTGVIIATAWMHLLEPAVENLSDPCLQPRLGDYPWAFFIGLMTIMMMFLVELLASSADPVDESHSHGSSFDTDADPSLEVLALSKSAQKNSKKNNTPFDNKEALAEPCPHVADDVERNGSFHGPDQRAIPGPPDDVSYPPGGQDHLGHAREHKEGDSHTGLAGQLTAIFILEFGVVFHSIFIGLTLGTTDNLVILLIVLVFHQLFEGLGLGSRLALAHWPEGKKWLPYVLAGLFALSTPVGIAAAMGARINNANTQKLVNGIFDAISSGILMYTGLVELLAHEFMFNPHMRRAPLKIQLFAFGCVLFGVGVMATLANWA

SEQ ID NO: 540 - protein, 269 aa, Unknown
  Kingdom: Fungi, Phylum: Ascomycota
MGHEDAVYLAKLAEQAERYEEMVDNMKIVASEDRDLTVEERNLLSVAYKNVIGARRASWRIVTSIEQKEESKGNSSQVTLIKEYRQKIEAELAKICDDILDVLDAHLIPSAKSGESKVFYHKMKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETSATGGQADAPAKEETAATAEPPAAAEEPKATE

SEQ ID NO: 541 - protein, 338 aa, Unknown
  Kingdom: Fungi, Phylum: Ascomycota
MAPIKVGINGFGRIGRIVFRNAVEHPEIEIVAVNDPFIETHYAAYMLKYDSSHGVFKGEISQDDSNLIVNGSKVKFYSERDPANIPWSETGAEYIVESTGVFTTKDKAAAHLKGGAKKVVISAPSADAPMYVMGVNEKTYDGSADVISNASCTTNCLAPLAKVIHDKFTIVEGLMTTVHSYTATQKTVDGPSGKDWRGGRGAAQNIIPSSTGAAKAVGKVIPDLNGKLTGMSMRVPTANVSVVDLTARLEKGASYDQIKEAIKEAANGPLKGILAYTEDDVVSSDMNGNTASSIFDAKAGISLNDNFVKLVSWYDNEWGYSRRVLDLLAYIAKVDASK

SEQ ID NO: 542 - protein, 418 aa, Unknown
  Kingdom: Fungi, Phylum: Ascomycota
MHFTPRVVAGLGLAAALVCGSPCGPGGVSPIKNIDLGPRPFFLVDDMDDGPLKKKLDSCKEKKMKASDFSIGHRGGGTLFIPEHTRESNLAGARMGAAVLECDVAFTKDRELVCRHAQCDLHTTTNIVTIPELNAKCTKPFQPASKGTAASAKCCTSDLTLKEFKTLCGKMDSSNPNATTPEEFLGGGPDWRTELYATCGTVMSHHEHIALVEGLGLLFTPELKTPEVEMPFEGDYTQAMYAQQMIDDYKNAGIDPSRVWIQSFLYDDILYWLANEPEFAAQAVYLDETGDTPETFETAVQNLTRYKEDGVKIIAPPFNYLLTAKDGEIVPSKYATKANELGLEIITWSLERSGPLADVEEDGNYYYSTFAEAVKKDGDMYKVVDVLVQQVGISKLFSDWSATVTFYANCFDLGLKKW

SEQ ID NO: 543 - protein, 288 aa, Unknown
  Kingdom: Fungi, Phylum: Ascomycota
MLGPQALVTLFTLFCATGSALQPPSYTGFSGKWSDHFDAAADALPNSSKWNTIATSSVFNNEWQTYTRNKANIRHTGAGRLQILPRKDSSAVRGWTSGRIESKYTVTPTAGKITRIESQLRIGGAPRSQKQGVWPAFWLMGQSYRQGTLWPASGEIDVFENVNGDNICVGVIHCDRAPGGVCNEPVGLPGRTTIDTNSWVTWRVEIDRRQSDWKKQAITWYKNGVQFHRVLGSTVNSQAVWNTLTAQPLYIIFNVAIGGDFPGPPNSQTASGQGNILELGYVAHYVSN

SEQ ID NO: 544 - protein, 345 aa, Unknown
  Kingdom: Fungi, Phylum: Ascomycota
MSSDKMEVEKAEEKMATMEHSEQHYFKSYDHHGIHEEMLKDEVRTRSYMNAIMQNKHIFKDKVVLDVGCGTAILSMFAAKAGAQHVIGVDMSTIIFKAREIVKQNGLSDKITLIQGKMEEIEMPFPKVDIIISEWMGYFLLYESMLDTVLYARDRYLEKDGLIFPDKAIIYFAGIEDGDYKDEKIGFWDNVYGFDYTPLKDTALSEPLVDTVELKTVVTDPSSVLTLDLYTCTTADLAFTVPFQLSVKRDDFIHALVSWFDIEFTACHKTIRFSTGPHTKYTHWKQTVFYFKDVLTVQDGESVQCNLMVRPNAKNRRDLDVKIDYSLETDDANRTAKGSCEYRMC

SEQ ID NO: 545 - protein, 564 aa, Unknown
  Kingdom: Fungi, Phylum: Ascomycota
MLHVFSAATFLPASCTWIKELDAAMILPVLLLSLGGLAGIVNAQAYEPADFNVTAALEELGIEVSELPPLANLAKRAGTGACSAACLTLSLLYNKESVLTKADAAYDVFTSSYWSEIQNEVSPRCVFKPSTTKDVSAAVLLSRLTQCPFAVKSGGHAAFAGGSSAEGGITISLEKLNYVRLSCNKKKVTIGPGNRWADVYRKLDTRDLTVAGGRVSSVGTGGLTLGGGISFFSNIYGWACDNVVKYEVVTAAGYIVQVTAKSDPELYWALRGGGNNFGIVTAFTFETLPLPKGEMWGGTKTYLESSFDKVSDAFSNLIASSPKDPNAGSWVAWLQNSGMKLAATELWYAKPDGDQAAIFSEFQNITPIADSTQNRVLHEYTDVLDASNAYGFREVYYGLTVKANAEIAKVARRIFFEELPATAGLPGANPVLIFQGITEGQIAHMSKNGGNALGIEPADGPLYIIHVAAWWENESDDDTIYSFISKVLKRIKSESQKLGLASDYVYMNYASTFENVIASYGSQNAARLKKIAASYDPSGVFQKLQPGGFKLDRAPSPNSAYFSG

SEQ ID NO: 546 - protein, 403 aa, Unknown
  Kingdom: Fungi, Phylum: Ascomycota
  misc_feature (381)..(390): Xaa can be any naturally occurring amino acid
MFSTSLRPKAFLEDVTIGGGTDTRRGFNSAVRIFCSKVNGLTVEAGGYLSMTTEVFLNGGKNPSTYGVVGFVDFEVHNKIKQDHQISESSCIAYLQALSKPGGKCSGEVNADTKGGTWQVGNNAISYHALGNKVPPKQDAINKLYRGGALETQSVNKRNGAALSPWPFHSADGVKPTTCHSHNDYDRDIPLWAAMSAGCIASEADVWYVGGELLIGHILPGIGRTLRAQYIEPLRAILDHNNGGAPGPKGLYPASPSQSVVLMVDFKTSDPRTLDTVNAALQPLRDGGYLSRVESGRFVERQITIVASGSASYDRINAGDGVPNRDIFYDAKVDAWSSKYTTANSYYASADFQDAIGNPGSVAGFTAAQREKVRSQVQNAXXXXXXXXXXAYAKELEENLFAD

SEQ ID NO: 547 - protein, 439 aa, Unknown
  Kingdom: Fungi, Phylum: Ascomycota
MGKEEKTHINVVVIGHVDSGKSTTEAAELGKGSFKYAWVLDKLKAERERGITIDIALWKFETPKYYVTVIDAPGHRDFIKNMITGTSQADCAILIIAAGTGEFEAGISKDGQTREHALLAYTLGVRQLIVAINKMDTTKWSEARYQEIIKETSNFIKKVGYNPKTVAFVPISGFHGDNMLAPTTNAPWYKGWEREVKGAKQTGKTLLEAIDGVEPPKRPNDKPLRLPLQDVYKIGGIGTVPVGRIETGVLKPGMVVTFAPANVTTEVKSVEMHHEQLTEGLPGDNVGFNVKNVSVKEIRRGNVAGDSKNDPPQGAASFDAQVIVLNHPGQVGAGYAPVLDCHTAHIACKFAEIKEKIDRRTGKSVEEAPKFIKSGDSAIVKMVPSKPMCVEAFTDYPPLGRFAVRDMRQTVAVGVIKSVEKAAAGSGKVTKSAAKAGKK

SEQ ID NO: 548 - protein, 329 aa, Unknown
  Kingdom: Fungi, Phylum: Ascomycota
MLRPTALVALAAFISSSVAQISDDFEGGWDQTKWKTYAPDCNQGGSISLDTTTAHSGKSSMRVNGAGGYCGHIFFGTTAVPSGDVYVRAWIKASKALTDSHVTFITMPDSGLGTNKHLRIGGQNSILMYNRESDDATLPDLSPQGVAASTKLPTGDFQCFEYHLGGDGTIETWLNGNPISALQAGPNANNPNGAQWQRAGYKPKVSGVYFGWESYGGDTNTFWYDDVVVASSRVGCDGGSGSNPPPSSTAKTSTSASATGPSTIITTTRASTTSSSASSTRPPVTTTSSAAGPSQTKYGQCGGNGWAGATSCESGSTCTKLNDWYSQCL

SEQ ID NO: 549 - protein, 188 aa, Unknown
  Kingdom: Fungi, Phylum: Ascomycota
MHFNVLSLLLPIVGLSFAQLQPNWTSPAGVSIYNPEDFFDTTGPWSLMSSAGDNLYVAEGSLQLEEGLETDIGKSPGMRGIDPVTSQLVETGHARVRQAYQNMKTLVEMQGTDVYSCLRLVVYVTDMAQYRPMCNQVQEEIWGSDPSRYPPRTIIEVTALNQDDIVEVEGTFYAPHLSQKKCHGETRF

SEQ ID NO: 550 - protein, 380 aa, Unknown
  Kingdom: Fungi, Phylum: Ascomycota
MQSYDQKHGAPPSNFYDVDYDEPYVRPRRAVQSSMPWWNPRYWTKRIWIILGIVLVAIVVVAVAVGVTQSKSNNRDSYPNYTNLTYNLVDTYGGESFFDKFDYFTGYDPTFGFVHYVPRPQAQQLNLTYATSNSAVLKVDTSVGPESEPNASTGRFSVRITSQKTYENGLFIFDIHHTPFGCGTWPALWLTDPNNWPEHGEIDVMEAVNQADNGNMMTLHTSPGCEMDVRRKQIGTALQSNCDGLINNNTGCGVEGAADTYGQAFNRNDGGVMALEWRNEGIRMWQFQRGKVPGDITDQKPNPAGWGEALADFPNTDCNIANHFKNQSIVANINLCGQLTEHAYSKDNCPSNCTDYVANNPQAFTDAFWEFGSFEVYQSV

SEQ ID NO: 551 - protein, 410 aa, Unknown
  Kingdom: Fungi, Phylum: Ascomycota
MRFTSALAAGALAAGVSADGKNYLGFNSGATLPDRSAKFKADFEAEFKTAQGLVGAPGTFNSVRLYTNIQAYSKDDPIEAFEAAINTKTSMLLGVWTSGTDNIDKEISALKKAVSKHGSKFTDLVIGISVGSEDLYRNSATGVKNKAGVGAQPETIVSYIKDFKKAFADSPLGKVPVGHVDTWDVWGNATNKPVLDAVDWIGVDEYPYYENDKGNDIKNAGHLFDKAYEATIAAAGGKPVWVTETGWPYTGKKWDQAVASVENAKYYWDEVGCRKLFNKTPTFWYTLRDSNPDNTMKFAITDNLSTKPRFDLTCPTTFDTKPESSSVSGTATATGTGSGSATGMPTASSTSGSGSGGSGSNGSGNGSGKSGASGTTAGASATPTGGAASQKVSGVAFAGVAVMVGALALF

SEQ ID NO: 552 - protein, 495 aa, Unknown
  Kingdom: Fungi, Phylum: Ascomycota
MFLKMSRAKLALLAVAGAQLASAQTSGTADAHPGLTTYRCTTSGGCVSQKTSVVIDYQYHWIHSPSGSQASCTTSSGVNSTLCPDQATCDKNCVIDGTGNYTSSGVTTSDDTLTMYQYVQGANGLQNSSPRLYLLAADGKNYEQLQLLGQELTFDVDLSTLPCGENGALYLSEMAANGGSKGQAAYGAGYCDAQCPVSTWRNGTINYSNQGFCCNEMDILEGNSRANAFTPHPCNSAGTDCDKGGCGLNPYAQGHQNYWGPGGTVDTSKKMTVITQFITDNGKTTGTLSQITRKYIQNGRVVASAIQGGDTITTALCNQWDSSAATFGSLPAMGQALGRGMTLVFSIWNDNSQFMNWLDSGSNGPCSATEGDPSLIMKNAPNTHVTFSNIRWGDIGSTTSEGSTGGDSDTTTKKTTSTTTSTTRTQGITSTSTKSFTTTTTKASSSTISTTTTSKPSQPQQTHWGQCGGSGYTGPSACEPPYSCKAQNDWYSQCL

SEQ ID NO: 553 - protein, 494 aa, Unknown
  Kingdom: Fungi, Phylum: Ascomycota
MVGLGPRAPPSRKGSKADIPRDLLEQVKILEEQFTVGTEKLKGITEHFISELAKGLTVEGGSIPMNPTWVMSFPDGYETGTFLALDMGGTNLRVCEITLTDQKSEFDIIQSKYRMPEELKTGQSDELWDYIADCLYQFVETHHGDATKLPDHLPLGFTFSYPATQNYIDEGILQRWTKGFDIAGVEGQNVVPMFEAALVKRGVPIKLCALINDTTGTMIASAYTDPKMKIGCIFGTGCNAAYMEEVGSIPKLAHMNMPPDTPMAINCEWGAFDNEHKVLPRTSYDIAIDRDSPRPGQQAFEKMIAGLYLGEIFRLVLVDLHDNKDVEIFPGQDIALLRKAYTLDSSFLSAIEEDPFENLQETFDLFKSRLNLTCARGELELIRRLAELIGTRAARLSACGVAAICKKKNYTSCHVGADGSVFNKYPHFKARGAQALREILDWPEKPAGSKEEDPIEVLAAEDGSGVGAALIAALTLKRIQAGNSAGVLHPENYQ

SEQ ID NO: 554 - protein, 306 aa, Unknown
  Kingdom: Fungi, Phylum: Ascomycota
MKFTTSTVLFAAALGASAHPSGHAHKHAHRSLEARANFVMNLKPVPVAPVAPTTTTTQQPAPAATSQTAAAPQSAKPSSTGPPPSKGSGAAKPFCGGQSYAKSYSKKRATVADIFYKGNIGAPNAYGCNLMLVDEDVADQYDHVTTFTNADTKTQQCACFNKIGPVGGQVNGFFNGNEALKFTVAPGEKKYLAADDNTQGGCSCGPGEVALTTWGEFADTWLEFDFASDINKGWSGADASCLVAAAEKMPIQGMNVCGHGTCSTINPGGTGTNAYLGGMEAEDGVGLNIPPGPVRLSVTLAYNGSN

SEQ ID NO: 555 - protein, 824 aa, Unknown
  Kingdom: Fungi, Phylum: Ascomycota
MPRLYRYPYKLQVTSATTAHTEAKAHIPLPFAMAAPRSCSNLSRHFLTASRPQQTSTWTSAKNQCCQRTRRQTQQRRWLSAAPAGLKSLLRVSEEVAEAVATKKPVVALESTIYTHGAMGKQLAQEHDELVRKHGGIPAIIGILDGVPNVGLTPREVVRMIEDKDTVKVSRRDISYLVGMGLAGRKINGGTTIAGTMVLARLAGISVFGTGGLGGVHRDGHNTMDISADLTELGRTRVAVVSSGCKGFLDIPRTLEFLETQGCLISTFADGRTGNIDFPGFWARDSGSKSPSVVQNEREAAAIIYSQEQLGIESGMLFANPVPEGLGIPLPEIQAAIETAVTEANEKGFTGSRNTPYVLGRLKELTGDKAVVANMALVKSNIIRATNVAVELSRLQASSGISASSIPPPKPVHATPVSTAAKSEARQKTNILVAGAVALDLSCDYAGTKAGDITPQAHTSNPSRISQSIGGVGHNVALAAHRASTKNKVQLCSMVGADVAGSTILAAVEASGLDATHIRRLGQEYKSGNRTAQYVAVNDGQKNLVMAMADMDIFTTHSFPVHWRSVVETSKPDWLVVDGNWSGRDIREWVRAGEDNGCKVAFEPVSVAKSRGLFAPQRGLPKLGLFPNATLSLASPNIYELAAMYEAAKENGYLDSLEWFQVVDWFGMRGARDRFVHLTSAKLTDAGVPVQTVQLLPYIPTIITKLGAEGVLLTELLGKEDPRLRDRDSEEYILTRCMSPNSPVGGIYMRLYSAAEKVEDVVSVNGVGDTFLGVMVSGLAQGGKVEKLVDVAQKGAVHTLRSAESVSPGLSQIEEELTRVVSRR

SEQ ID NO: 556 - protein, 320 aa, Unknown
  Kingdom: Fungi, Phylum: Ascomycota
MFVSQAALVFGAAALTAAAPLEKRGGITDDVILNYALTLEHLEDTFYREGLAKYSEQDFANAGFDSTFYANIKRVSSDESDHVSFLTTALKAAGATPVAACEYDFGYDSLQTFLATASILEGVGVSAYLGAAADIMSKAYLTAAGSILTVEARHSSYIRGGLKQVPFAQPFDAPLSYNEVFSLASGFIKSCPETNPALPVKAFPALAADTSSGDAIKAGSTVTLLTPVRKPPNSNGLPFLLVEEADTPVQEYTLKGGKVYAAFIAVTGPVFVDATPVEGGFTVKIPEGFAGQTYVVLTGCKDFVTDDTVAAGPAIIEISS

SEQ ID NO: 557 - protein, 313 aa, Unknown
  Kingdom: Fungi, Phylum: Ascomycota
MTHIFHLPTKISNESLHGSNALPSQVLSLNHLTPTESITTTNPFDLLLRRSNTVIMAHPGAQISKRKKFVADGVFYAELNEFFQRELAEEGYSGVEVRVTPTVTDIIIRATHTQEVLGEQGRRIRELTSLIQKRFKFPENSVSLYAAKVQNRGLSAVAQCESLRYKLLNGLAVRRACYGVLRFIMESGAKGCEVVVSGKLRAARAKSMKFTDGFMIHSGQPAKDFIDSATRHVLLRQGVLGIKVKIMRGSDPEGKAGPQKSLPDAVTIIEPKEEQTVLQPISQDYGAKAVQAQASQDARNAEEGGEEAAAEEQ

SEQ ID NO: 558 - protein, 826 aa, Unknown
  Kingdom: Fungi, Phylum: Ascomycota
MVNFTVDEVRALMDKPTNVRNMSVIAHVDHGKSTLTDSLLAKAGIISTAKAGEARATDTRADEQERGITIKSTAISLYGHLEDPEDIKDIVGQKTDGQDFLINLIDSPGHVDFSSEVTAALRVTDGALVVVDTVEGVCVQTETVLRQALGERIKPVIIINKVDRALLELQVSKEDLYQSFSRTIESVNVIISTYLDKALGDVQVYPYKGTVAFGSGLHGWAFTVRQFAVRYAKKFGVDKNKMMERLWGDNYFNPHTKKWTTKSTYEGKQLERAFNQFILDPIFKIFHAVMDFKKDEITTLLEKLQLKLSADDRQKEGKQLLKAVMRTFLPAADSLLEMMILHLPSPVTAQRYRAETLYEGPMDDEVAIGIRDTDPKAPLMLYVSKMVPTSDKGRFYAFGRVFSGTVRSGLKVRIQGPNYTPGKKEDLFIKAIQRTVLMMGGKVEPIDDMPAGNIVGLVGIDQFLLKSGTLTTSETAHNLKVMKFSVSPVVQRSVAVKNAQDLPKLVEGLKRLSKSDPCVLTMTNESGEHIVAGAGELHLEICLKDLEEDHAGVPLNISDPVVQYRETVTEKSSMTALSKSPNKHNRLYMVAEPIEEELSLAIEGGKVSARDDFKARARVLADDFNWDVTDARKIWTFGPDGTGANLLVDQTKAVQYLNEIKDSVVSGFQWASREGPVAEEPMRSIRFNILDVTLHADAIHRGGGQIIPTARRVLYASTLLATPALLEPVYLVEIQVPEQAMGGVYGVLTRRRGHVFSEEQRPGTPLFNIKAYLPAFPQSVFDHWQVLPGGSPLDPTSKVGAIVTEMRKRKGIKEVVPGYENYYDKL

SEQ ID NO: 559 - protein, 206 aa, Unknown
  Kingdom: Fungi, Phylum: Ascomycota
MKFARSSFLISVFATLVVAQLSAVPIVEEIAPGSKQCTDASNNECRTAEQAAPFIASGMTRYGIYSVNEMAAVISLMAFESVDFKYKTNQVPGRPGQGTANMQMAAYNLKYAKSIDKVKGQVADINSVDGLSDDELNRIRSLVTPDEYNFASGPWFLTTQCEDSVRQELRANIDQGFAAYMGCVGVEVSAERTAYLDRAKKAFGIQ

SEQ ID NO: 560 - protein, 227 aa, Unknown
  Kingdom: Fungi, Phylum: Ascomycota
MVSFKTLALGSAAICSALAFPFNATELQEMFKRDSELQPRTNPGTGTDNRYFYSFWTDGAGSINYQNGQGGSYTVNWQNVGNYVAGKGWNPGAARTINYSGSFQTSGNGYLSIYGWTQNPLVEYYIVETFGSYDPSSAAQVVGTVNVDGGTYNILQTTRYNQPSIEGTSTFQQYWSVRQNHRVGGSVDVGAHFNAWAQHGMKLGNHNYQIVASEGYQSSGSASITVS

SEQ ID NO: 561 - protein, 376 aa, Unknown
  Kingdom: Fungi, Phylum: Ascomycota
MRGSWATRESVLSWSKQRYGADRSVACRGQPSTVAALPALAVESMLVLVLSAILFPKPHPASTVHPQAPSSRRSILFPPSIHFILIHHLPAPCINNISTSRLHLLLFPQSNTLSPGLDTVARRHFSSFSPPPAQVAPITMAEIRRKLVIVGDGACGKTCLLIVFSKGTFPEVYVPTVFENYVADVEVDGKHVELALWDTAGQEDYDRLRPLSYPDSHVILICFAVDSPDSLDNVQEKWISEVLHFCQGLPIILVGCKKDLRYDQKTIEELRKTSQKPVSPEEVRTSLLLVAQAAVVGREPCSPDSVPYPPPARPMHNMLTNYQGEEIRKKIQAYKYLECSAKTNEGVREVFEHATRAALLSRSGRSGKPKKKCMVL

SEQ ID NO: 562 - protein, 380 aa, Unknown
  Kingdom: Fungi, Phylum: Ascomycota
MKKQVEFVLSLMKVIACIGFIFLGIIINVGGVPTDDRGYIGARYWHAPWGGFINGFQGFCSVFVSAAFAYVGTELTGLAAAETINPQKEIPRASKQVVWRILVFYIVNLFLIGLNVPADSPLYTGEGSSSRHSPFVIAIQLAGIKVLPSIFNAVILISVLSVANSCTFGSTRTIQALAVNGMAPKALTYIDKKGRPVPVIILQLLFGCLAFINLAENGGVIFNWLLALSSLSALFVYGSIALAHVRFRMAWKANGHSLDELPYKAYFGVWGSYVCILINVIAFMAQTYVALYPVGGPNVDANVFFQSYLACPLAIFLYLVWKVYSWFVYPEHRAPWVPVNKIDIYTGIRVAQGTMSDDSELEKEATGVKGFARRILKTIM

SEQ ID NO: 563 - protein, 560 aa, Unknown
  Kingdom: Fungi, Phylum: Ascomycota
MSPVTDAPPVGGDGQNPVQRQESNSLTQTPSVNDVKHEQKITVAACFLGLVASVGGFMFGYVSGQISGFFLMEDFLDRFGELNTTTGERSFSAARQGTIVGLLSVGCLFGCLIAGRLADVIGRRSTISASAFFSCVGIIIQISSNKTWAQFAVGRLIDGLGIGALSVSVPMYQSESSPAIIRGVIVSCYQLFVTLGIWTSNMVNYGTNTISGSASWRIPNGLGFAWALVLGAGILLLPESPRYAFLKGREEEARKTIASLAGVDLHAPSVNAEIEEIREKVQEMKEGAETKWYEVFTGPRMLYRLMLGILLQSGQQLTGANFFFYYGTTVFQATGLNNSYVTQVILGSVNVGCTFGGLVVVKKCGRRSALIVGALWMMMCFLVYAFVGHFKLDDDDPASTPQAGTILVAFSCLFIAGFATTWGPCKFTLTGWSDDVDDSVACAVGANKIPVVWTVVAEIYPARYRSTAMGIATASNWLWNFLISFFTRFIVDQIHWLYGLVFAGCCAALAVLVFFTLNESKDRSLEEIDTMYTTRVNPITSSKWKGMEAEAAHKESVRGS

SEQ ID NO: 564 - protein, 331 aa, Unknown
  Kingdom: Fungi, Phylum: Ascomycota
MVALTNIAFGLGAAALSLAAPATSPSPLDERGPMNFVMGYDHPLAKRFGNFSVRAVGPAMEARSNTNYKQDYITGGSVNFSPGTNSFSLNWNTQQDFVVGVGWNPGGHSPITHSGTFSVNSGLGSLGVYGWSTNPLVEYYIMDTNHGISTGGTQKGTVTSDGATYAIWEHQQVNQPSIQGTSTFNQYISIRQSPTSSGTITLDNHFKAWAALGMNLGTLNYQVIAVESWSGSGSAQQSVSNTGTADNAGGNTGANNGGSSNNGGNTGGNTGGNTGGNTGGGNNGGNTGGNTGGSGSCSAIWGQCGGNGWTGPKCCSSGSCKFQNDYYSQCM

SEQ ID NO: 565 - protein, 363 aa, Unknown
  Kingdom: Fungi, Phylum: Ascomycota
MPEHNVVVFAGDHCGPEVIAEAIKVIKTIEELRPTAGKFNLQNHLLGGCSIDETGNPLTDEALAAAKAADAVLLGAIGGPKWGTGAVRPEQGLLKLRSEMSAYGNLRPCFFASDALVESSPLKAEVCRGTDMMLVRELTSGLYFGERKEFDGNDAFDTTVYTKSEVERIARMGGYLARTRGETRVISLDKANVLATSRLWRTVVNEVFQNEFPDIKVEHQLIDSAAMIMVKNPRSLNGVLIAPNLAGDILSDEASAIPGSIGLLPSASLCGIPSSPVSGIYEPIHGSAPDISGKGIVNPIGTILSVAMMFRYSLNLAHEAQLIEDAVRNAIDAGLRTKDMGGSTGTVEAGDAIVAELVKILKA

SEQ ID NO: 566 - protein, 250 aa, Unknown
  Kingdom: Fungi, Phylum: Ascomycota
MRSSAHILLPLAAALWLGATAAAQDPDCAPGGNFDLSKFNLQLPIGSDSNPDSPRTISSGELIGCDGWSDTSYFFTSSSGSLIMKVPGSPSSSGCVTTPNSDHCRTELRETSPGSWDPNSSVNRLKVRLAVKVPGNGGIAIGQILHNLQPNKPVAELYYEPSGDIEIGVAQTTAGGNQIRQPVGHVDVGDIFTFELRYESNALSIALNDGGFQDLDTYDLDAPPCYFKTGNYNQGDAPTEVSFHDISVSH

SEQ ID NO: 567 - protein, 947 aa, Unknown
  Kingdom: Fungi, Phylum: Ascomycota
MRSITAVLGLATLFTAAVQASSSPSSSQPKWRRDPNEASHQLPDATPKRYIVELTSLSCSERVAARLSSSDGLRIVKTFDHELFPALSVECDNGCDVDSLTRLLNDDDAGGDVHSKGARDVAAVYKPATMELRLPKEGESFSDDAAAPKYSFHGLTGVEELHKAGIIGEGATVAIVDSGVDWSHPDLGNGFGPGHTIIGGYDLVGDGDWPDTPPQPDGYPDDQFGHGTHVAGIVAGKGKQFVGVAPGAKILSYKVISRDGKSNEEMVIEGFLKAFDSGADIISASLGEKSGWSTNAWATLASRMVDRGVFISIAGGNDGDEGAFLMSNGAAGEHVMTVAAADPDMIPVYPFTARFSLGGSANSSELGYAPAVVSGDQDFFTSDVADWPVVPLSLNTSAVGDACGESLPEGSLPALDHYILLVRVGGCDLLQKVRTLSAANVPYVLFYQDASPYAAPPSDSSGITKVGVIDAKAGEAIINTIVEGGSVTASFNESTTRYVGMRDTAGGRPAVFTQWGPNYDMALKPDIMAPGSRVLSTYLGGGYKILSGTSMATPYVAGVAALYVGKHGGRRAHADDPAWAKRLMSRIMSTARSAPWVDEWQEVTRPEFRAPPVQVGAGLLDAQRVLEATTTFGFEGRKFELNDTAHFRGKHSVDITNAGEDQVTYTFSLESAAGFESWKPNEPGQPPAFGLNTFKAYNDMQPAKMVPEVKMPTEMTLQPGQSATAQFEFTPPVGVNASLIPVYGGRVLVHASNGEEFGIPYYGVASDIKAVVPGNWDRGASLPNMISGPNGESILTKTTQTVFGCREIRWDIFDAKFTENDWSYPPVVGENHFVGSATAWSGSMDHSYFDPKAQNASDVYTFPRYNVPRSLVSYNMWLGQFANGSHIRPGKYQFRLAALRPFGDPHVAQDWDVFQIPQITVLPRHGACNKTRTRNKRLSRPRTARLE

SEQ ID NO: 568 - protein, 204 aa, Unknown
  Kingdom: Fungi, Phylum: Ascomycota
MSSNRNYDFLIKLLLIGDSGVGKSCCLLRFSEDSFTPSFITTIGIDFKIRTIELDGKRVKLQIWDTAGQERFRTITTAYYRGAMGILLVYDTTDQRSFDNIRTWFANVEQHATEGVNKILIGNKCDWEEKRVVSTEQGQALADELGIPFLEVSAKSNINIDKAFYSLAADIKKRLIDNQKNESPSAAGVNVGDKGDGGAGSKCC

SEQ ID NO: 569 - protein, 493 aa, Unknown
  Kingdom: Fungi, Phylum: Ascomycota
MADHIAAVAPPVENNKKVDVPDVEKGEGSDSGDNSNVGGIVGDSSEYGMTKAVDPQTLLAQQKTEEGAHKFSRLGWKRLTVILIVEAIALGSLSLPAAFASLGMVAGVILTVGLGLVAVYTSHIVGQVKLKYPQVSHYADAGRLLFGRWGYEIVGAMFCLQLTFLVGSHCLTGTIAFLNITDNATCALLFGGISAIILLLLAIPPSFAEVAILGYIDFASIILAIGITVIATGIQSSDAPGGLSAVHWSAWPKEDLTFSAAFNAITNIVFAYSFAVCQFSFMDEMHTPKDYVKSIWALGIIEIFIYTLTGALIYAFVGEEVKSPALLSAGPTVSKIAFGVALPVIYISGSINTTVVGRYVNGRIWDGTKRSINVYVNTKEGWLAWIALITTITVVAWIIAESIPFFSDLLSISSSLFISGFSFYFPALMWFMLIREGGLFERKNMVKTVANTIVFIIGAVVLVCGTYAAVTEINRKYKDGTVRGVFSCAPMDA

SEQ ID NO: 570 - protein, 452 aa, Unknown
  Kingdom: Fungi, Phylum: Ascomycota
MKTGTVAAFAAALGLANGCLMERELEADREFLRTGKRSEVHAPHPRQASTTFPIGKDDRFKRGCKVPKGLGVEDRDLGSILNVGEVESALKGLKKGFPNEVELFEPPFETYEGRKFYGAIVGEDPRVFIMSGIHARERGGPDNVIYFLADLLQARKAGTGVTYGSKSYTAQQVETALSAGVIILPNTNPDGVAYDQSTSSCWRKNRNPESAIGAANGRDVGIDLNRNYDFIWDYTTHFHPDTSPASKDPRSETFYGTAPESEPETKAVVWTLDQYQNITWFMDLHSYGPSILYAWGDDDAQTVDPNQNFVNPEFDGKRGLTGGPDPADAQYQEYFLPNDLKIEEDVTSSMIDAMLTAGGAPYEAYPAVGLYPTSGASNDYAMGRFYGNISCGASRMFGLTMEFGAPSRSYPSCPFYPNKDEYHRNVRQVGAGFLEMMLLAAGKAGDPLYAEC

SEQ ID NO: 571 - protein, 170 aa, Unknown
  Kingdom: Fungi, Phylum: Ascomycota
MGSKVFFDLEWEDKNGPQTGRINFNLYTDKVPKTAENFRALCTGEKGFGYEGSSFHRIIPEFMLQGGDFTRGNGTGGKSIYGEKFADENFALKHTRPGLLSMANAGPNTNGSQFFITTVVTSWLDGRHVVFGEVADEESMKVVKALEAVGSSSGAIKFPKRPTIVKSGEA

SEQ ID NO: 572 - protein, 349 aa, Unknown
  Kingdom: Fungi, Phylum: Ascomycota
MAVRHLAQALAGFALLGSADALFTVNCAPLTIQRGDPIVSPGRISSHVHVVTGGTAFQLYEPNQVAVNATATTCDKILDNSNYWQPQLYHMRKDGRFELVNMQGNAAYYIPRACDYEPGRRNCNDALAPVAPPAGLRMVVGDPLRTTLDTSNFEDRAISHVCLRETNSSETYELPREKCLRMRAQTFFPSCWDGTNLDSANHKSHVAFPAIGDYNGGVCPESHPVAIFSVFFEFFYDTNAIQNFNRLVWAQGDAQGYGLHGDFLNGWTDQDRLNRSMETCTGPRGVDDVNCSLNVGPNGPGRASEQPLQVAPPAEEVGRNGPLDKLPGNNTVFGLGNDVQPVHTGCPAS

SEQ ID NO: 573 - protein, 249 aa, Unknown
  Kingdom: Fungi, Phylum: Ascomycota
MGATTVPTNEQILVPETLLKKRKSQEKARAERTAAQEKKKTSNKEKRGVIFKRAEKYVTEYRDAEREKIRLARVAKKNDSAYIPAEAKLIFVVRIKGINKMPPKPRKILQLLRLLQINNGVFIKVTKATTEMLKIVEPWIAYGYPNLKSVKELVYKRGYGKVNKQRVALTDNSIIEENLGKYGIVCMEDLIHEIFTVGPNFKQAANFLWPFKLSNPTGGFRTRKFKHFIEGGDLGNREEAINALIRQMN

SEQ ID NO: 574 - protein, 505 aa, Unknown
  Kingdom: Fungi, Phylum: Ascomycota
MDENQQEKTAAVVHQRGNGDDTPVAEVEPAPVSKKQSLSDIFTIFCAGFALISDGYQNNLMTMTNVLFKKAFSAEYTSTVSTRVSNALLVGEIIGQVVIGLTCDYMGRKTAIVLTTLLIVLGGILATAAHGKTIDGMFWMLTVARGIVGFGAGGEYPAASASSSEAANEHTPKHRGPVFILVTNLPLSFGGPLAVIVFLIVLSAAGGATANLSTVWRVCMGIGVVLPLTVFYFRLRMLNSKLYRRGAIKKHVPYKLVLRYYWRTLIGTCGAWFLYDFVTFPNGVFSGTIISSVVPSAGDDVLRSTAEWQLLLGSIALPGVFLGAYLCDRVGRKNIMMLGFSGYLVFGLIIGLSYDRITKIIPLFVVFYGLMQSSGNFGPGDMLGLLSSESYATSVRGTCYGISAAIGKTGAALGTQAFKPIQDNLGKRWTFIIAAICGVVGVLVTWFFVPNVTGEDLAIQDEKFRVYLVENGWNGEMGEDDMQGLAEDVQTEQLPDGDKAVKTAV

SEQ ID NO: 575 - protein, 202 aa, Unknown
  Kingdom: Fungi, Phylum: Ascomycota
MSSFEPVVVVDGKGHLLGRLASIVAKQLLNGQKVVVVRCEALNISGEFFRAKLKYHAYLRKMTRYNPTRGGPFHFRAPSRIFYKAVRGMIPHKTARGAAALERLKVFEGVPPPYDKQKKMVVPQALRVLRLQPGRKYCTVGRLSHEVGWKYQDVVARLEERRKAKGAAYYERKRVAARQLSDAKKNASVKPETAKALAAYGY

SEQ ID NO: 576 - protein, 613 aa, Unknown
  Kingdom: Fungi, Phylum: Ascomycota
MGGLPKGEEPSTVPAIDADVDASLDKGNDGVPTHDNNNNGEHIPASRAVRDLKSPGVARVEAISNSITFTDRIFIFFGIFLVAYVYGLDGTLRYTFQTYATSDFGQHSLLSTVNTVRAVIAAAAQPTSAKIADVFGRVELILLSIFFYVVGTIVEAVATNVKTFAAGAIIYQVGYTMIILLLEVVIADITSTRARLFFSYIPALPFIINTWVSGNIAEEVMNNTTWHWGIGMFAIIYPVCALPLIVSLLVVSRRAKKNGLLDNWQSSFQIFGVSNVFLELFWVLDIIGIILVIAVFALILVPINIADGNPDVWKEAHIVAPLVIGVCCIPAFILWELKAPHPLAPFRLMKDRSVWAPMGIATLLNFAWGMQADYLYTVLVVGFDFSIKTATRITSLYSFTSVIVGPLLGVLVFYVRRLKVFIVAGTALFMVAFGLLIRYRGSASGDGKVGVVAAQVVLGIAGGMFPYPAQASLQVFLRHENLATMTGLYLATYSIGSALGNAVSGAMWRQILPGKLDTGLGNINATLADAVFADPLGAAITYPMGTPERSAIIEAIQQVQRYLCITGISLCVPLIVFAICMRNPKLNGAQTLAKGSDSDSETDVDKKRSTDRA

SEQ ID NO: 577 - protein, 694 aa, Unknown
  Kingdom: Fungi, Phylum: Ascomycota
MDLNLEGSLRQSAAEMGSTLQKSLKLTEGTLIVSTYSFETHSKSAQIRVYNVKDAGSHVVADDPAAHEPVWISDTEIVYLLPGKKGGTSLVRLDVRKQPVEPETIYDTPGALSNPKVKIVSDGKVVFCCSAPTTPAGKLFCEAAEPKQHSTAKIYDSLMVRHWDTWVTKNQNSLWYGLLERKDGRWSLGDHGLSNLLAGTSLSSPVPPFGGTGDFDVSSKGIAFVAKDPKLNEARHTKTDLYYLPLRDFNKEPDTLPQMVKTGRLRGYSMAPAFSKDSKKLAFVRMRSDQYESDKTRLLFIPDIEDLSNVQEFYETEDGEGGWELRPDWVVWSNDGRELYVSAEQYGRTVLWKIPASPRHATQLPPEAIHEDGCVVDAKPLGPNNSLLITRRSRVESSSFAILDPNTKSVSEVSSSSKHGKSVGLRRSQCHDVWFSGGAGYDIHALVMRPSDFDPSKKYPLALLIHGGPQSAWADDWSTRWNPAIFAEQGYIVVCPNVTGSTGYGQAHIDAIAKNWGGTPYDDLVKCFEYVEKKMPYVDTDRAVALGASYGGYMINWIQGHDLGRKFKALVCHDGVFSTRNQYASEELFFPEHDFGGTPWDNMEFYDKWDPAKYTKNWQTPQLVIHNELDYRLPISEGLSMFNVLQARGVPSKLLMFPDENHWVLKPENSLVWHKTVLDWINKYAGVEAESTTG

SEQ ID NO: 578 - protein, 205 aa, Unknown
  Kingdom: Fungi, Phylum: Ascomycota
MSTINIGSSGEWDKLLSGTTVVIADFYADWCGPCKMIAPHYERLAKEHSRPKKVAFAKVNTDSQSDVARSNGISAMPTFKIFHNGACVETIKGANPSALNDAVTKAVKLAGGGATAGELFKTPGRTLGGDSGSGSSSGGIFSASNLIQILMAFFDPYKAAENSRFNVKRKPGDDKKSKQGGFGPGRGAPVQKTPFTTFADLNGCG

SEQ ID NO: 579 - protein, 485 aa, Unknown
  Kingdom: Fungi, Phylum: Ascomycota
MYARFTTTVLCNSLVQNAVRDCGLTQQEAEPLCADTCAEFARSEAFITADRSLCQNPSSNLNDLIRADFTNCALPEAALSGSTCISGIDNEPENCGYGNSTTGFCSYCAAGGINSTDTCCYSAQAEKRCQNVALPTISQTMTFDAPTATGSSSPSSSSPSSTAPSDTDDEHDKDGGLSGGAIAGIVVGSIAAVALLAILLFFCLRRRRRGGSTKGSIFNQPSPARKGASMSMTQSAPQGYEVLPGGRIARMSALEGHSGESPSRDHHGGMAAGALGAGAGAGAGYMAGRRKNDTQSSSSDFGDSPASDGRAGVLRAPPAALKRDGSLSSGSVLGSSVPQSPTSAGFSSPQGLASQQSEQLPFFKDYYSSDDIHPGDRVAVLWAYQPRAADEFALERADMLKVVGIWDDGWATGILLNERAEEWEARRQAQRDSGVSNTSGRRDSSPAASGEIKAFPLVCVCLPEHWRKTIEGDGSTESGSGPAIP

SEQ ID NO: 580 - protein, 463 aa, Unknown
  Kingdom: Fungi, Phylum: Ascomycota
MKSVATFLSIVTALSAAPAFAADKEAWKTRNIYFVLTDRIARGSDDTGGNACGNLGDYCGGTFAGLEGKLDYIKGMGFDAIWLTPVVSNVDGGYHGYWADDLYSVNKNYGTADDLKNLVNAAHEKGMYIMADVVANHVGAGDVTTYAPEPLNQTSSYHTDCDIDYDNQTSVEVCWIANLPDIKTTDSAIRTMFHDWVSWLVSEYGFDGLRVDTVKHVEKDFWPGFAEASGVYTVGEVWNGDVNYLAGYDGLLGGLLDYATYYPMNRFYQKQGSSQDLANMVSSVASSFGDPAALGAFLDNHDNPRWLNQESDTALFKNALTFVMLGRGIPIVYYGTEQGYAGGNDPQNREDLWRSGFNTDADLYRFLAALTGAKSAAGGLGGNDHETLYVADKAYAWSRENGRLIALTTNGGEGTSGQHCFNSGVKNGSWNILLGGQGSVSADGSGRVCLTVQYGLPVVIVDS

SEQ ID NO: 581 - protein, 401 aa, Unknown
  Kingdom: Fungi, Phylum: Ascomycota
MRLNLVAIATALLLASNSSATRCAKNFKDNYCFRSVASAEPRSKAIHDCAEYLRVTVTPQASTTTTVLTNPTTAVSTIVTTSVTTVDEATTDSTQTNWISETRTVHKDTSTSTVTEYAIKTVEAGSDPQARDVNLDARYATAKEEEYPAYAATCGSFEKYSSACRCLGVCPQTITAPRPTVTATRTEYSIKVSTKVVLEQFTEINFTPVTETTEKTTYLATETAWKHTATQTTTIYTATITSIVRNGGFESGEFEPWIDSDDNQIDIYVSQPGDNSKWMLESGNMVNNNLLEIYQVTLATAGATYQCTYDWKFDNYYETYYQSTGKTYIPYVHVYIGDSTSYIDWVSPDETTKGTWQTSTFQFTAAGADKLWFDCASPQPRRGTGGGRNKVYLDNIACSLA

SEQ ID NO: 582 - protein, 601 aa, Unknown
  Kingdom: Fungi, Phylum: Ascomycota
MTSATQLDADAIAQSGLNAPEFRAHDARASTDVNEKIQDPYVTTTDDDEDWPDKPTDEELRTLRRVSGKIPWAMFTIAFVELCERFSYYGSSILYTNFVNNPLPEGSTTGSDPGAEGKPGALGQGTQAAQGISLFNMFFAYLMPLLGAWIADARMGRFWTLHLAIGISTIAHAILVASSAPGVIVHTDGAFAAFIIGMLCLCVGTGFFKANVSPLLAEQNLDARMHVVEQKGERVIVDPAVTNTRVFLYFYLCINIGALSGQISMVYVEKYHSFWLAYLIPTILFLTAPFVLWSNKKKYHLTPPTGSLLSKFLKVFWYVRKNSPSAFNFNWEVAKPSGIPVHERPAWMTYDDAWVDEIKRGLGATRVFLFLPVFFLAYNQMTGNLTIQALAMQRNGVPNDILQNLNPISIVIMIPLIDHLLYPGLRKLGIAFTPIKRMTWGFGISALSMVAAAVMQHYIYKMSPCGEQALDCDEPAPINVWAQSLPYILIGLSEILTNVTSYEYAFSKAPENMKSLVMSVNLFMSAVSAAIGQAFTPMSKDPLYLWNYVVVACIAAAGGIAFWFCFRHLDSEEDKLNMLKKTKFIGQNQPTETAETKQVDA

SEQ ID NO: 583 - protein, 553 aa, Unknown
  Kingdom: Fungi, Phylum: Ascomycota
MDVKTVEFKPFQDQKPGTSGLRKKVTVFQQPHYSESFITSILLSIPEGVEGSTLVIGGDGRFWNPEVVQLIAKIGAAYGVKKLIIGHNGILSTPAASHIIRLRRATGGILLTASHNPGGPKADFGMKYNLSNGGPAPESVTNKIFEASKTLTSYKITSIPDVDLSTVGTQTYGNLEVEVIDSTADYTAMLKDIFDFDVIKKFFASHPDFKVLFDGLSGVTGPYGKAIFEEELGLKGATQNCEPSPDFNGGHPDPNLTYAHSLVEVVDKNNIPFGAASDGDGDRNMIYGANAFVSPGDSLAIIAHHANLIPYFQKNGVNGLARSMPTSGAVDLVAKKQGLDCYEVPTGWKFFCALFDAQKLSICGEESFGTGSDHIREKDGLWAIVAWLNIIAGLGVKNPDVVPSIKAIQKEFWGIYGRTFFTRYDYEDVDSEGANKVVGELKSLVADEKFVGSTIGDRTVTKAGNFSYTDLDGSVASNQGLYACFSSGSRIVVRLSGTGSSGATIRLYIEQHSSDPSTYDLDAQDFLKAEVKFATELLKFKEHVGRDEPDVKT

SEQ ID NO: 584 - protein, 633 aa, Unknown
  Kingdom: Fungi, Phylum: Ascomycota
MFTSVLLSPHPGLLDPGSQPGLSPSRDEGLPQGLALLRAFVSNPGHHSSNNTEKTTDLSLSGENRFTMKGSIAAAALAAMAAGANAHLPHQRAHDLFKRECKPVCTTYVETIYGKPTWIPDAPKPKPTKEAPPPPPPPAPTTTTTTTTTTTEIPVVPVPEVTVCPTPGIYTIPAQTITVDKTVTVCAAASTHLPPGTHTYGEITTVVESSTTVTCPYATATNGEEAPVTTHVCPEAGVCTVVPGTVTVVETETDIYYACPTTYAPGTYTAPATTVTVTVDQYVVYCPYATSEKPAPPPAPTTQAPPPPPKVEQPKPQAPQPQAPKPQAPKPQAPQAPQEYTPKVSQPQSPSVGGGIAVTGKLGEGGGDHYAITYTPYNPANGDCLDAASVESDIINIKGAGFTTLRIYSSDCNTYETVAPACKKHGLKLIVGVFVKGGCSYSAPDVQEQVDTIAQWADWDSVELVVIGNESIMNGHCTPSELKQLITTCKSKFSGYTGPWTIAETLDIWERSEVPGTLCDVIDIVGANVHAFFNPNVKAEEAGTFVKGQLDILGKMCPGKEALNLECGWPNGGKCNGAACGSPSEQKVALDSIRKEVGEKSVFFSFKNDQWKQGDALDVESHFGCDSYFTSLY

SEQ ID NO: 585 - protein, 1506 aa, Unknown
  Kingdom: Fungi, Phylum: Ascomycota
MKLLATLLAFAGLANGLADTDTITWGGDNSRTGYQTNHNMDPAIVGSAQFGQIFRTQLPGRYGGAAEEMFSQPLVYTPSGGDKQYVYISTTQNNVYKLNARTGEILASRNLHIPFLTADLDGCVDINPNIGITSTGVIDPDTDTLYLTSKTYRDQSRLNVAQGRDEARIFVHALDANDLSERPNFPVDLEGIPARNNPARLFGGGIHLQRPALLHTGQYIYAGFASHCVHHNFTGWIMGWDKTTGQTVEHFSMHGEGVPSPLKGGGIWMSGGGLASDDAGSIFFASGNGNSSQLANVPVAGFNPPTALEQAAVHMTQNEDGSLDVVDFFMPWEKQALDGADQDLGTSPLEILPSEFSCGEYKRIGVVTGKSGKTYWLNLDNLGGYRNGPDGLDDVIQVYQNENSVYAGAGVYPLEGGYIYINVIQFPSHVFKFSCNNGRPAFTKVADTPVNNAYILGVSHGTVTSLNGQPGTGMLWITDVQGSHLRIYDAVPRDGEMVLLNSFSVPGSMKFGRPVFGDGMMYQCSNQGYVYGFGAPINQPLNCSGTVDFGTVDIAVTSETRTVTCEALINLEITSMGLAEDKNFILSGNPTLPLQLAAGKTVTFKAAFKPSTVGFLTTDVAFNTTNNAQGFASRSSTRLTGTGSSADALLFVSPNSVFFQGVITGQDPNSAVENIQVTNRGNSLLTVSEVQYSTESANGPFKSFAGSGDLVVGKFRISDIPTEVGANTGATLNVRFDSSESGDFSAFLKFVTNGGTKAVTIAGSSGPGPKALVEFQTTDGEGWVEYEEGKPFTFGNVTENTSRSLRMRVSNVAPKGAVRLYLTVSKPPAGGSSIIRAANSIDLGEGTSLGPGENATAVITCTSAKRQWNTDPRNGTATWTMNTNDATFEKHVIDFFCNSVAEQAPPLLPGGQGQYRYIGCFKENTPGRQLQSQLYGNDNNTNPMCIEACATRGLTFCGTQYTRECWAGNKIPAVKVDDINCNYACRGDIHQVCGGNGENEGAGGSYISLFADSLTFDGNYTRPDDGQTGGGGGGGGGGGGTAPKPVANPGVLGYKHIGCHTEATTGRALQQQVTLQTPTVENCVEACLGRNYPFAGVEYAGECFCGSALRAGANPAPASDCNLACKGNTTELCGGGSRLNVYQLDDGSIPTTTPGTSTFTTSTSGVSTSMSSTPGGSTSTSSTTGASTSISSTPGTGPSTTTSSSTGAPVPTTPSRTSRVGDYRLQGCWTEGTNVRALSGKTYARDDMTLNSCATFCAGFTYFGTEYGRECWCGNTLGNGSVKATNQLDCSFKCAGNPLQYCGAGNRLELYMLESASTTSVSSSSSSSSITSSSISQSSSVPSSGSNSTPRASSSTTEIKTKTTTSISSVTDRSVSSSTRTSTSASVSPTAPIIDPGNGNFTFYSCAVEPSSGRLLTRQIYNDGDDMTIQSCLERCWNYKWVGVEYGRECWCNNEVNWKGNTGATAGRNATDNKECNFRCPGDSMVWCGGSSRMSLYTRKEDEDEA

SEQ ID NO: 586 - protein, 548 aa, Unknown
  Kingdom: Fungi, Phylum: Ascomycota
MRASSRLSAPLRRRCAASSRFQRQAQLRAATYRHYHVPTRLASACAPLNRHIRPLTHHSLSTSRGHATAAARPASDDFGPLQEYDRRVETGQLKNDEHQRGIIESLQWLHDDLCDYQAPPVVHPSHDLLKPVKKSVFSSLFGGKGAAASKSAIGAIPENLPRGLYLYGDVGSGKTMLMDLFYDTLPSSVRSKTRIHFHNFMQDVHKRLHKIKMEHGSDADAIPFVAADIAEKGNVLCFDEFQCTDVADAMILRRLLEALMSHGVVLVTTSNRHPDDLYKNGIQRESFIPAIKLLKTRLHVINLDSPTDYRKIPRPPSGVYHTPLDTHAKFHADKWFRFLGDSQNFHPHPETQNVWGREIYVPQASGRCARFTFDELIGKPKSAADYLELVRAYDAFIVTDVPGMTIRERDLARRFITFIDAVYEGNAKLVLTTEKPLTELFVSRDEIAEALLDGDADREKNKNDSAEQAKQAMDSILEDVDESAEKLKSSNLFAGEEEAFAFARALSRLKHMESQEWVERGMGLEKKGGKQDRDGWAKARSRQMEDSM

SEQ ID NO: 587 - protein, 646 aa, Unknown
  Kingdom: Fungi, Phylum: Ascomycota
  misc_feature (623)..(632): Xaa can be any naturally occurring amino acid
MKRFQIFASLAAVFGLAEAQFPPTPEGLTTIKSKFHENVTISYKEPGICETTPGVKSYAGYVRLPPGFLNDINGEAQDYPINTFFWFFESRKDPANAPLAIWLNGGPGGSSMMGLLEENGPCMVGEDSKSTVLNPWSWNNEVNMLYIDEPVQVGFSYDELTNCTVKMGNKLDYLYQIIPTDFSDGLPELNYTTYAGTLASQVQSHTANSTAQAAHALWHFAQTWFFEFPAYKPEDDRISLWAESYGGHYGPGFMRFFQTQNEKIENGTIEVDHAHYLHLDTLGIVNGALDDVIQGEAYIDFPYSNTYGIKAFNDSIYEELKYNWTTPGGCRDQFQECQDRLKKYDVATINRNRALAADLCDNIDLSCDMGAVSEYMKLDYGWYDIGHPQADPFPPPHMQGYLTEADVLQAIGSPVNFTWASPAVGTAFSSTRDMVHGGFIEAVGYLLDHGVKVHMMYGDRDYACNWFGGEAASLAIPYSRSADFANAGYAPLLSPDGATGLTRQYGNYSFTRVFQAGHEVPSYQPATAYSIFMRATFNTDIATGLLKVTDDYSTIGPKDVRAVPNQAPERPEPRCYVRKPDSCSDQVWEKVVAGKAIVKDWFVVGFVDEEDATNGDDDGPEEXXXXXXXXXXPPLMPSQRLPYLLT

SEQ ID NO: 588 - protein, 247 aa, Unknown
  Kingdom: Fungi, Phylum: Ascomycota
MARKFFVGGNFKMNGSISSIKEIVNNLNKADLDPNTEVVISPPALYLLLVRELLRPEIEVAAQNVFDKPNGAYTGEISVSQLQDSNITWTILGHSERRTILNESDELVASKTKVATEAGVGVIWCCGESLEQREAGKTIEVVSKQLEALKAQISDWSKVVIAYEPIWAIGTGKVATTEQAQEVHKAIRDWLKGVSDKVAEETRILYGGSVNEKNCGELSKQPDIDGFLVGGASLKPAFVDIINAKKQ

SEQ ID NO: 589 - protein, 283 aa, Unknown
  Kingdom: Fungi, Phylum: Ascomycota
MILKAFTAVLSLAAVAKAVEAPNYSGFTRIWQDTFAGAAGSSPNGDNWEIIQGDLGVNNELQIYTASNANLQLSGGSTLQIVPWRDGSAARGWTSARVESRYVFTPGDGKVTRAEAQIRFGDGNSKQGIWPAFWQLGQSIRQGVSWPACGEIDILETVNGILTGYGTVHCGQYPGGPCNEPNGIGGPVGIPDQSWHTWRVDYDRRSGNWRDQSITWFMDGFQFHQVTGDRVNDEGAWRALGQSPVFFILNVAVGGDWPGYPNDSTQDGYSSMMEVAYVAHYST

SEQ ID NO: 590 - protein, 418 aa, Unknown
  Kingdom: Fungi, Phylum: Ascomycota
  misc_feature (35)..(37): Xaa can be any naturally occurring amino acid
MTTALESQSAVTPEVESSQSTSLSDGNSVQLLSSXXXASFASAHPGHDLTEEILERRQFINSVHRKDLSHCSEKLRARGFESRSIARRAAAVEEARARRGFSKRDTADFLAASHDRSNLGYTESTDASVLFSDNASCLLTPEMAQGPFYVSGEFVRDDITDGQPGIDLTLEYQVIDVDTCEPVPDVYVEIWHCNSTGVYSGVVASGNGDAEDETNMDTIFLRGIQKSDSEGVTQFKSIFPGHYPGRAPHVHVMVHTNATLMANETLGNDVYASHLGQVFFDQDLIMSVRKMAPYSTNTQELMLNANDRIVREEVGDVVDPFMNYVFLGDDLDSGLFAYMAFGINSSYTRHVTPTANYYQDGGVALPKPGNGAGPGGNGTTPGSMSTAATETSTAAAALATLPLYGAVAGGVGLAMLLQ

SEQ ID NO: 591 - protein, 236 aa, Unknown
  Kingdom: Fungi, Phylum: Ascomycota
MMKSLLLLPLATLALAGGLCGQYDYYGANGYYANNNMWGANMGTGSQCTYVDKMTVDGVSLGVEWNWSGNKDSTKAYPYAGRELGPKKLIKDITAIPSHADWASVGNSLRANVAYDMFTSSSANHDPSSGEYEIMIWVGNEAKLWPVGSAGNVVTVANKQWTLWDGYFGGARVFTFVATSDLHVVDLDIKLFFNYLRDRKGFPVNNQYLTTLQFGIEPRWGGPATFQLNWFAANVY

SEQ ID NO: 592 - protein, 179 aa, Unknown
  Kingdom: Fungi, Phylum: Ascomycota
  misc_feature (63)..(63): Xaa can be any naturally occurring amino acid
MVHADASNFADGVSKQEAYEQVLLMAEGLFHGQPNWVCNLSNAASLLWHAYKSLPSPSNQVNXDTASSKPQLILGPFQGKVACQTILFGEGVCGTAAETQQTQLVRDVEAFPGHIACDGDSKSEVVVPIVVPVAEGSDEKRTVAIIDIDCAELGGFDEVDQKFLEELAALLAKSCAWPQ

SEQ ID NO: 593 - protein, 321 aa, Unknown
  Kingdom: Fungi, Phylum: Ascomycota
MRRSITTAAVAASLLAPAASAQDITSKSCVDGLFMVVARGTNEQPGPGVTGLIAERIADRIKDSDVVALDYPATYTDPLYTESVDDGTKEMAAVIKNYTDNCPDGKVAVFGYSQGAHVASNVFCGGNGGAFDSDAPLPKKLVDDHVISIELFGDPSHVANTTYDIGTSKNDGIFQRLNITACENYSFMKSYCDTGDVFCDSGNNSAVHGSYVQHYGTEVVSNVLNAWNKATGGDVDTDGGAPFPGRASGNNTSTPEATSSATKSTAATSTQTRTQETGTQTSESGSGGSGGDKPGAAIGLSAVGSLVVGAPLILLAMLSVM

SEQ ID NO: 594 - protein, 523 aa, Unknown
  Kingdom: Fungi, Phylum: Ascomycota
  misc_feature (293)..(296): Xaa can be any naturally occurring amino acid
METSIDETLSRAATSQTQGRQGGVEQQQDHAGSLPNQSSKHRLVEFEDGDPEDPKTWSKAYKWYCTMVVAITCFVVAFASSVITADIAGVAREFNVSEEVALLSITLFVVGFGIGPMAFAPLSEIYGRHIIYASTLFLAVVFIIPCAVAPNITTLLVCRAIDGIAFSAPMTLVGGTLADLWRNEERGVPMAAFSAAPFLGPAIGPLVGGFLSDATNWRWLYWIQLIMAGVVWVLISFTVPETYAPIILARRAQKLRTETGDSSYMTEQELDSRSLYDRLRVFLVRPFQLLFGXXXXFFVAFPIIYQKGKGYSAGKTGLMFIPVAVGVVLSACCSPWVNNHYMTFVHKHDGKPPAETRLIPMMFACWFIPIGLFIFAWTSYPELSWAGPAMGGLPVGFGFIFLYNSANNYLVDSYQHQAASALAAKTFIRSFWGAAVVLFTEQMYDRLGDQWASTLLAFISLACCGIPFLFWRYGARIRARSRFAYGGDAQDDSEDDLEKAAEQEAHHARDVALMRAISYVSNP

SEQ ID NO: 595 - protein, 252 aa, Unknown
  Kingdom: Fungi, Phylum: Ascomycota
MLLKTLIPVFALRASAELIVGLGSSYAEGPGLAQPIGEILRQKLTDRDGQEWSFSNIAVSGSLLEDIVTNQSPQLEGTNPRIAYIVSGGNDLSYATCLGNPSDSACQNSISEDEWKQRYRDVLDSVIQHTAGDPALTVFCVTYIRALGADTVCPSDDCPVQPAEKEANDNLYNRVVDYTVRAIDEWKATGDNGQYDVRLIPMRQYSEEHYVGTAEPWINGAQVPEGAGGITWHPNNAGAEAVAQFLFESFTS

SEQ ID NO: 596 - protein, 616 aa, Unknown
  Kingdom: Fungi, Phylum: Ascomycota
MRVRVILCTLIAALGVNGAAIPEPEPDSTLSARQTQTSTDPKWTNHQGFRDAIVNRHNQYRGEHAVGRLTWNTTLSGFAAQYLNKKGTGKNTCPDFAHSGGPYGENLAIGYGTPTQAVVAWGDERKNYNFNKPGFSSATGHFTQMVWKDTRQVGCARKYCTSSNTIRGWYLVCEYWPRGNVIGQFDKQVLRGSYKGKRDEESLVDELLVLDADASVDVDGEELIGEPLVFYEGLVSGSIVGPIVRCPAPGHLEHPGKVDSRQAAVASSGALQNLTAYLNETLAQLGSTLQGSNDYISETLGLPPSIVYSSLAALVAVPLTMSRYGWSSSRDQISPYSSMSGSGPAVTDEDFSYITSQDLEDPSLGLPSTRPRARSRAGRPDPDDDVLLIKNKGVIYPTQFPAYSIGDGKLRVVDVRNRICVMMDLPQRFANRIKLLYKGKQLKDASAPVREYGVKNKSEVMAVLPEGEVAGSTSEEEEEVIVDGTKSRRRKKKKSKKGSDKKDGSGSSQAQQPVATGPIATGPIAKLNDLHAEFIDKWLPLCKQFIAAPPTDPKKKEEEHRRLSESILQQILLKLDGVETDGVPEVRAQRKEQVREAQAILKELDVVVGKERPGGF

SEQ ID NO: 597 - protein, 226 aa, Unknown
  Kingdom: Fungi, Phylum: Ascomycota
MSSPAPLRLGSIAPNFQAETTQGKIDFHEFIGDNWVILFSHPEDYTPVCTTELGAFAKLAPDFEKRGVKLIGLSANTVESHEGWIKDIGEVTGGNVAFPIIGDKQRQVALAYDMIDHQDATNVDSKGIAFTIRSVFVIDPKKTIRTILSYPASTGRNAAEVLRIVDSLQTGDKYKVTTPINWVPGDDVIVHPSVSNEQAKELFPEFRIVKPYLRFTPLPKEKATVL

SEQ ID NO: 598 - protein, 507 aa, Unknown
  Kingdom: Fungi, Phylum: Ascomycota
MALLSGLPLFGGTAGASSTLFWGGTIVGFNNDTNSLEVYRNGSILVENNRIAAIHERTQSKDEVGDGVEVIDVTGQILTPGFIDTHRHGWQTGLKTLGSNTSLAEYFGRYSSPASGADFRAEDVYIGQLAGIYEALNGGVTTMVDHAHHTWSNETSWAGLNASAESGARVFWCYAFENTTNAEGPRTVVEQLANFRAMINSERWKSSATEIGIAYDSWGPRPDVEERGKVMKLATEFDVPVITTHSLGGPWGITNMPSDLAELDLLKGDIPIIFSHASFLSPNDRDLLRQNNHYVSITPESEMHYGHTHPHSYLIQDQAALGVDTHFTFSTDILTQARIWLQSTRYRLFSQVIENWKIPRNTPETVNQAFLLATRNGGLALRRHDLGVLNKGAKADLIVWNARESPALLGWNDPVAAVMLHASVGDILDVMVDGKFVKKGGKLVVEGYGEVRERFIASAKRLQEVWAAKDYPVLEGQWMSGGSEFADTMKVDVVSGQGNGYGELFVA

SEQ ID NO: 599 - protein, 599 aa, Unknown
  Kingdom: Fungi, Phylum: Ascomycota
MLPSRNGITGDGTYQELQDDQLPQHELTNLNMTANSKTLSGGDSDYMTTAESTTTATTTQKDAAHAQHPRKDLPAWKWQGTLAVCFLTSLVNGYDVSNVANIQPRIYEAFGNIELLPWIGLSYSLAFFACLSFARKILNIFNLRWVLIFFCFVFVVGAAVAGAAPHMTAVIIGRVIMGLAGACIQQCDMSYLAVFATPAESPKLFAILSSCWAIGLVIGGPIGSAFAANVTWRWAFYLNLPWVGICAAIAVACLPSHSLAPSDLSVFQRLRKIDPLGIMFNIAAPVLFGIALTFAGPIWAWDDGRTIAVWVVFGVVFVSWWVQQYFCFFTTPEERAFPLHILPRRDLIPIWIASGCAGASYAIVLYYTPLFFAFVKGATEMQQTVRLLPFILVFIVVVLTTGASLPAIGRYQVIYIMAGILTLSGAAAMASTVDASSSESLVMGLGALIGAGLGMHWQHGASLCNVINKDARQKVDAIVIFNMSQMGAIAVALSMGGAIFQNVGFSLLSKAMAGEGYSDHDIREALAGVSSRVWQSRNPEVLKRGAEAVADVIAREFWIVVAGGSLCLVCGLLMKREKLDFGRAQKVKPESKEVSTETA

SEQ ID NO: 600 - protein, 501 aa, Unknown
  Kingdom: Fungi, Phylum: Ascomycota
MRLSQNMMISMLALPATVAALASSNTSIEWVPCPRGTSSRLDCGEIHVPLTYRTGSSIEAADNRTIVLGLTRLNSTGNNTRGPLFVNPGGPGGATQAIIAAGLDDEEYRFGKDVMELYDIVGLDPRGVGKSTPVKCDPDLFNRRTQMLVNSTKTFEAVKKYGKDLGESCANLTGPLINYLDTIHVAKDHEVVRRALRAEKFDLLGYSYGSMIGSTYLELFPKHVGRMVFDGVADHAQSEVSTLFTEATTFEATLNQWFKWCDDQDDCAMKADVNDTKRVFELLAHNATLSPLPATGCNNTCQPTVTFEDLMTNVQASLGTYPDGWSDLADNLALAVLGNASEISAAIMTSTTPDPADGFSPYAGLAIGCQDWKHSAASAQDIIQRLAAVEVFAPITKGVTQSLSYQTLCLGWPTNTTFPQRPLNETAAREAPPVLLVNSVYDPECSLVWADGVREQLPSAVSITRNGSGHTSHGMLGDTRDAIDVFFATGKLPRDGTVYQS

SEQ ID NO: 601 - protein, 290 aa, Unknown
  Kingdom: Fungi, Phylum: Ascomycota
MAPSNLPSVLNATSQDIEMLLAAQSHLGSKNLQVHMEPYLWKTRADGVNVINIGKTWEKIVLAARIIVAIDNPADICVISARPYGQRAVLKFAAHTGASSIAGRFTPGSFTNYITRSFKEPRLIIVTDPRTDAQAIKEASYVNIPVIALCDTDSPTEYVDVAIPTNNKGRHAIGTVWWLLAREVLRLRGTIYNRETPWDVMPDLYFYRDPEAEAEEKVEEEKAPGVDEEGPAAIETGTAAAGGDWDAAPAAGFTGAATAGAGWDGAEGGEWAAAGQTTEWAAEASKETQW

SEQ ID NO: 602 - protein, 596 aa, Unknown
  Kingdom: Fungi, Phylum: Ascomycota
MAIASSPASQPLRGGQSGYELVDQHDEDGQGSGPLKPAPYLPPRALNRPDHRQRVTTISLSTAVVLLLASTLYFSLPLSFSSRQPGSCPCLPSDVPQYFQTSPNRWPGPTATGAAAFMAQTRTFDPEATYVPNAPLQTSLPIDGMSQANRSIFQMMGYLSPYTPSTGFGVKEYPLPPGADIVQVQMVSRHGARYPTSNSNVQRLGDRIAEAGGSLKASGQLEFLNDWKYQLGGEILVPKGRQELFDSGVLHSYMYGNMYNPNSKIIVRTTTQDRMLKSAENWMAGFFGLEWTNNATIEVIIEGKGFNNSLAGSAICPNSWNKSAHQDALNTWTGIYLRDEAQSRLRDMTEGFEWTIEDVYAAQTMCPYETVAYGYSRFCELFTYEEWRDFGYSIDIVFSGGSGFHSPTGRAVGIGYQQEVIARLKNHTLGYSGSNINTTLDSSTETFPLNQTLYFDFSHDTNIVAILTAFGLRQFAEELPADKYPGDHAFTVSNVTPFGARLDIEIIKTPKPLSSNRDGYQDGKETKYIHFILNQRTVPLGKSFPECDPDRVDGWCELDAFLKVQEEMPERAKFDYACYGDYDKVPYGHLTDGAPL

SEQ ID NO: 603 - protein, 304 aa, Unknown
  Kingdom: Fungi, Phylum: Ascomycota
MKFLHYLLIPILAVVGSPAKAKSKYVAPWQTLPPTPSLPQPYWNGTAPINGIKLWHALFGRPLHQCKDAPVPVVFLHGGFANSDYFGHQIRHLQSLSYSIIAVDTRGHGRSTDDLSRPLSYDLIAQDTIALMDHLKVEKFAVVGWSDGACTGFNLAMNYTERIDRVFSFGGTYSYTNVNETIGNSPVFTKYLDRVKVEYEHVSPTPKGYATFEERMGVMWSVEPVWRAESFQKIPSLFDDRDAPLMWIVDGDSEEACKRDVPRTLFDWIWGSAMVILPSVSHFAFLQDPDTFNAVLERFLATHK

SEQ ID NO: 604 - protein, 730 aa, Unknown
  Kingdom: Fungi, Phylum: Ascomycota
MRSVTMKTLSLLGILGLASAADLYVSTEGSDQNDGSAQSPFLSLETALQTVEQLVSGGISEAVTVHLADGVYSLNAPLNFTGAHSGKSGQPVTWKADGGNAIITGGLRVTGWTEGENGVYSASVPKGTKSRNLYVNGKASNYARRKIANRKDFSYTSTGMTWTDPQYDWLQTTPGIVGGEVRFINSFTDRYNPIQSVGDRELVMAPDSWANNIWGWDTVVNPFADFGVWVQNVRALLTEGGEFYLDSDAGLIYYKPLDGEDMSTVETYLGILECLISVSGTYDNPAHDILFSGLNFAHTTWMFPSENGYVDQQTGGYIGNFTAYPEFEATRPHWWQMPSAIQISAAHNIAFTGGSYSQLGAGGVGIGNDDNAHISGVGLGAQNVSVTDAHFTQVMGNAVTGGGIQAEAHHPDSELKINKDILISNNVFTNNTALFSASVPIFVTYLQFSEISHNDISHTTYSGICHGYGWGANDAGGSPEYEKRGLYKYQPLYTTPTTSMNNLIEANLVNEYGYSHTDLGAFYTLSKSPSTLFHENYAFGATWAAIYTDEGSNSMTFLQNMFLSDQNWVAVNGVNTGNNTYTKNYYLTGSNYANNTQVQSVSNADALGQRVAYRAGVTPSKRAGRPTTNPSDLADGYLGMSCQNGVLTLTLWNFDDLPLQNVKFSVTAEGASLSPKDVPNTVRGDTWAQATYDVSNGECPSFTSQAQYTNSRTGQEETREGVNATPPTGQ

SEQ ID NO: 605 - protein, 693 aa, Unknown
  Kingdom: Fungi, Phylum: Ascomycota
MVFFRLFGRATALAILWNVAQAAPSTVESTILVFGDSQYQLDNAISGLDAYGIPSQGIIVPKEGITLPALNSTPTDGNYGGIIVMNSVTYEYEGGNWRSAITQDQWDVIHAYQAAFKVRMVRLGDTPSTSSDTAAAGGSHPGDVEQLFSFTDTSGFPTAGLKQGATVSSKGFWHVPATITNTTTTRRIAKYGPSTGFTADTTAAVINTFPGGRQQMVFFISQASDWSQTSNFIQHAFIHWMTRGLFVGKRKVHLSMQVDDVQLETEMYYPQGEVVKISTSDLVDHITWRMGLNLRLPAGSDIMLELAHNGNGDIIAACTKSNAARYCNPDQAVDYDSPPDTALEFQKPLGTGTDIWPPTLLTYPWTKQCCQLDQFASWFLVAGNRDAYAHVSHTFTHQELNNATYNDASREIHFNQAWMKQMGIDKAKRFSPKGLIPPAITGLHNGDAIKAWMDNGLAYVVGDNTRPVLRNQDSKYWPLITTVANNGYAGLVVVPRFATMIYYNCHTPECTTKEWEDTSQGASGGWQGLLDLSRTDNTRNLLRLQADPYMFHQANMLRGKSIMTIGNQRGRLSILQAWAETVVQEMMRLTSWPITSLTHDQTAQYFLDRKALDDCEPRLTYQYASGGSTISSVTVRTKNNQCGVPVPVTIPKGLVTVQGAQSRADKVGNEPLIQWVTMAGSAVTLKLSSPVGV

SEQ ID NO: 606 - protein, 331 aa, Unknown
  Kingdom: Fungi, Phylum: Ascomycota
MLSISTLVQALVLLPAIASAAEDKFDYDSLSLREVGARNTLDWRIWLEKDGQPISFWHDIPLYPDESNQQIINFYVEIPRWTDGKVETKRNEPLNPIFHDDSQGQVRFVESVWPHKTYPVLYGSVPQTWEDPNFDHEYTGYPGDNDPVDLFDVSGIDAGYTGQVKQVKILGALAMVDDGATDWKVMAIDIRDPVAALVDSVQDLEKYRPGLAKAMYDWFIYYKVARGKSTNTIVGGNYVNASFATDVVRESHEYWLDLMRGRTEAKKISRDQTSNPEWRETYVDKKAATKKFKIPKKSKVEPAAEKPERYENWYHLDEQFRLIELPGQKKA

SEQ ID NO: 607 - protein, 368 aa, Unknown
  Kingdom: Fungi, Phylum: Ascomycota
MSNKVFAVPIFLVVFRETLETVIIVSVLLAFLKQTLDGPKNDPKVYKALRRQVWVGMLSGFLICLIVAAALIGTFYGIGQNKWEANEYYVEGAFSLFAALIITVMGVALLRIGQMQEKWRVKLAQAIEAPLKASKGPKAWFGRAMEKYSMFLLPFVTILREGIEAILFVSAVSFSAPATAIPLPAVLGLAVGGLVGWLIYKGGATAKLQIFLVVSTCFLYIVAAGLFSRGVWYLEQQQWNKIVGGDSAELGMGPGSYDIDKSVWHVNCCSPEYNGGGGWGILNAIFGWTNSATYGSVISYNVYWIVVISGFLFLRYREAKGRGPFASIGKRSSDASDANSPAATESNVGIPDKTATTTDSGEVRRLST

SEQ ID NO: 608 - protein, 613 aa, Unknown
  Kingdom: Fungi, Phylum: Ascomycota
MQLQLLPAIAALASAVAAVKVNPLPAPQSISWGNSGPKNVGWLEFRTNGKGAGGDNARVLNDAWARAYDTMRRLAWTPAAIEKPIPEFEPFPTPGSDSHSKRTETPWLSSIHVQINDWEADLQHAVDESYTLKIEASSPTVEITAKTVWGAIHAFTTFQQIVISNGQDGLIVEQPVTIKDHPNFPYRGVMLDTARNFISPEKMKEQMIGMALAKLNVLHWHITDNQAWPIEIKAYPQMTKDAYSPRERYSVDTVAEIIAYARARAIRVIPEIDMPGHSASGWLQIDKNIITCENSWWSNDNWPLHTAVQPNPGQLDVLNPDTYDHVRKVYSELSKRFTDDFFHVGGDELQTNCFNFSKTIRDWFEEDDSRTYSDLNQYWLDHALPIFTSKNITGGKNRRLIMWEDVLLSPNSPAHDVPKDVILQAWNEGPVHVQNITARGHDVIVSSSEFFYLDCGVGGYVTNDARYNDQLNPDAETPNFNYGGGGGSWCAPYKTWQRIYSYDFTANLTAEQEKHVIGVTAPLWSEQIDDSVISSKLWPRGAALGELAWSGNKDPKTGKKRLTQLTQRILNFREYLLANGIGASPLVPKYCTQHPHHCDLWYDQDAVDKDLRL

SEQ ID NO: 609 - protein, 814 aa, Unknown
  Kingdom: Fungi, Phylum: Ascomycota
  misc_feature (670)..(675): Xaa can be any naturally occurring amino acid
MTDESSAAPAKGCMGDDCENAAGSLQCPTCLKLGLKDSFFCSQECFKKNWNTHKAIHKAVQTKSSIYNPWPTYAYTGSVRPVYPLSTMRTIPRSIKHPDWSVTGIPKGESRLNRSKIQILDAKAQEAMRKVCRLSREVLDIVAAEIKPGVTTDYLDEVCHKACIERKSYPSPLNYRGFPKSLCTSPNEVVCHGIPDQRVLLDGDILNLDISIYHEGYHADLNETYYVGSRASADPDNIRLIETTREALDLAIALVKPGTPIRDFGPVIEAHARSRGCSVVATWGGHGINTEFHPPPWIPHYAKNKAVGTCKPGMAFTIEPILTLGKPKEVYWPDNWTNTTIDGKRTAQFEHTLLVTETGVEVLTARTATSPGGPVEIPAALVLTLDEPGVLAAAHLRTHMMTFHQMRKVNGAPAPHITISNPHGFSPTPCKHQIDCPILDGNSQPQRYLLRAQLRFTEYNRPPSTLSDPEILPATMKVSTTLLPLVSVAHLTSASSAPGLPFVANVWSGPFEAATNAAFLSLLPNASTCGSPTPALDAVTIGCTVCEDEQCDGSVGFGGSPDENCETTLDAMIMDGGSFNAGAVAGLRRVKNAIGVARAVMEHTRHTLLSGDLATQFAKEMGFKEESLSTPEMEERCRAWREDDCQPNYRVDVSPDAGGSCGPYKPLEKXXXXXXDHKGRMAAGTTTNGATHKVPGRVGDGPIVGSGSYADSDVGGCGATGDGDIMMRFLPCYQAVESLRRGMSPQEAAEDAVRRMMDKFPEVSSGLVVIDKHGRHGGAASGWGGTFTYSFRGGDMADAQVVSVPNLKPRVKEL

SEQ ID NO: 610 - protein, 467 aa, Unknown
  Kingdom: Fungi, Phylum: Ascomycota
MKVSTMAVLASAGSAAALIKDCTGTAQDEGGNWFCGAVSHILYSGIQGQGSYQAVTQMTDSGECLREAKAYSGPLSPLDEDLSLHFRGPIELAEVAVYYPASSKKRNVEEPSPHVHARRHGHTHFHSERKAKRDMVVATINGQVVSWENNWFGGAAAPTDAPAPASPAPAAPAPAAPAPAAPVPAAPASVAAVPTAGAQPPVAATSSSSSSSSSEDSSTSPLANPNAAGSGKDWDRVAYYNAQDGVADGLVFLGNYGGEGSGVFDTTWGNSLSYLNADGTGGCAKPEVLKPGLIPSNKEFSIWSSEPCDETCGFARAPEVAYKGFTGANKVFLFSFKMPMDGDRSFNGDMPAIWALNGEIPRAAQYSSCSCWTSGCGEADFIEVLASGDDKCKSTLHLTNGGGSSDYFKRPTDNFVRYAVVFDEPTASMSIRELPDGTDFAEGFDSATVNSWVEGGKDELFSLFQMG

SEQ ID NO: 611 - protein, 296 aa, Unknown
  Kingdom: Fungi, Phylum: Ascomycota
MSGSSPPAKRPCIPGPSLLSHARVLALAEESPSIIRVRNLQVTLRGPKDAWGRTGKSQPALVSVEVRMRDSFGLSSEMDQVQADTVHYGLLAKEVLRIMDNNTHSESLGASVRSIWAKFTAHADLKGSAPFGDPFLKIRHVAYLRVAIKVTKASLLGEGVSLSWAATFAEGAPAAVASSLEIHGLRIPTLVGVNANERTAKQIVLAHLRVEEFTDMQEDLHMDLEAVVTRVISESSFETLEALAQVVIAKLKEKHSGLVSEKRVSGEWLFGIELQKPIAVPFAEAACVELRGRAKV

SEQ ID NO: 612 - protein, 1485 aa, Unknown
  Kingdom: Fungi, Phylum: Ascomycota
MAEEKATGAPALDTNIESGGFDEKRAHGQEHVPAAAPAKPAQAPVEDDDEDEDIDALIDDLQSQDGHELEEEEEEVNPGGGRQVPEDMLKTDSRVGLTESEVEARRRKYGLNQMKEEKENLVLKFLSYFVGPIQFVMEAAAVLAAGLEDWVDFGVICGLLLLNAAVGFVQEFQAGSIVDELKKTLALKAVVLRDGTLKEIEAPMVVPGDILQVEEGTIIPADGRIVTEDAFLQVDQSAITGESLAVDKHTGDNCFQSSAVKRGEAFIVVTATGDNTFVGRAAALVSQSSGGTGHFTEVLHGIGTILLILVIVTLLVVWVSSFYRSNGIVTILRFTLAITIVGVPVGLPAVVTTTMAVGAAYLAKKKAIVQKLSAIESLAGVEILCSDKTGTLTKNKLSLSEPFCVEGVDPDDLMLTACLAASRKKKGIDAIDKAFLKALRHYPLAKNVLSKYAVLDFQPFDPVSKKVQVTVESPQGERIICVKGAPMAVLNTVAQDHPIPEDIDQAYKNKVAEFATRGFRSLGVARKRGQGSWEILGIMPCSDPPRHDTYRTINEAKNLGLSIKMLTGDAVGIARETSRQLGLGTNVYNSERLGLGGGGDMPGSEVYDFVEAADGFAEVFPQHKYSVVEILQQRGYLVAMTGDGVNDAPSLKKADTGIAVEGASDAARSAADIVFLAPGLGAIIDALKTSRQIFHRMYAYVVYRIALSLHMEIFLGLWIAILNRSLNIELVVFIAIFADIATLAIAYDNAPYSQTPVKWNLPKLWGMSVLLGIVLAIGTWIALTTMYVGGHDGGIVQNFGNIDEVLFLEISLTENWLIFITRANGPFWSSIPSWQLSGAILVVDILATLFCIFGWFVDGPNNRTSIVAVVRIWIFSFGIFCIMGGLYYFMQGSAGFDNLMHGKSPKRNPKQRSLEDFAEMSRLEIPGYYFGKWHVSCAWVLIHQQLLLYDFAERRIGITDEEKGKYFKIVKSHLAPSTAAYSSDNVKRRKLEDEANRAADRRKRLLRNHIRRHAFLSNDSLTSSLLDHEVGAASRAKGLGARVSFEYGDKEMRGRCWAKGLEGKGEVSFAPSFVRGRMANMGCFWVDGGDEVRGMGVGYGGLDEETLVGSYIPTDENERICFSRDSTYMRPLEMPSYRTEIVRCPQMSSIKYHAPSHKILLTSRELDHSAGLYIFSPPLSEEGSGQPRWLLGEANQYQRLSTLHRLRDQWVVHGSTPAPPSLPSTLCVLGTNAGLLRVSSSEAVSWLSSPPSENSSSPSHHGRKTGPQLPREIFSQDFQLDNPNVLYAGGRQPRLWRTDLRTGGREWGFELVESSLAHVKSLNGGREVLVAGPRDLMAIYDVRMFGRGSSAADLRGSRTRGGKGVSRPVVTFPEHKNEAHIHTGLDVSHDLGIVAAGQGDGTVKLFSTMSGRMLKIGGGGGHGKASGKKNEKAGYGGLESVKTDTPIKAVMFQRMPWERWESLWVAEGPALRKFSFGAREWEDEV

SEQ ID NO: 613 - protein, 605 aa, Unknown
  Kingdom: Fungi, Phylum: Ascomycota
  misc_feature (265)..(265): Xaa can be any naturally occurring amino acid
MTEGGIAGEGWAAQPPHSASLLLSHTEMSWTFAIGSLVQQQLREVMHTSPSVVRVSSYRASPAMPDRWRTWNSVRAVSQAVAQSWGWARHGFTQVPYRDTMPPAYLNLESFTTQLRYAKVVNLDFEARVPVPFSIFPSTYRDNDAQTEQVETEQKLEVNLPQKQPAGREGQYSSGEHRYTEEEVRITREEERYRRPGFKEEHYVREEHRAHFAPWAVAMSRGTQLRQVSSEGRYAIQRSVCSKAAIERAQPRSPIPPLHNSLLPXSQPQTRGHWRLAEKRLTDLSHTTASSHTPSFLSINTFTNHLFLISPSHTEYHDTHIEIDTHRQPYASPVDIAEREYRERFRPAAPRDCANEYTVDARFNRPTYREEVRVCNDTEPARFTTADQKSNMGYYDEDGHYHSFRQGIHKLADRINHPRGREEIDVEIREERTAPMASSSRTSYRRESSGGNNCDSYLPNTVTIPCHHIRIGDFLMLQGRPCQVIKISVSAATGQYRYLGVDLFTKQLNEESSYISNPAPSVVVQTMMGPIFKQYRVLDMADGYIVAMTETGDIKQNLAVSEQSNLWARLSRAFDTGRGSVRVLVLNDNGNELAVDMKVMHGSRL

SEQ ID NO: 614 - protein, 399 aa, Unknown
  Kingdom: Fungi, Phylum: Ascomycota
MFSKVLSTAAVALAASSVVSAQTFTDCNPMEKDCKPDPAFGNTKVDCDLTKGPCQPFYELDGTKLEYTDKGAVFKIEKETNAPTIATHNYMFFGRLEVELNPAPGKGVVTSVVLQSDVLDEIDWEWVGGDVDQVQTNYFSKGDTSTYDRGAYHPVQGAVGTPHVYTIEWTAEKIDWIVNGAVIRTLKASDAKGGKAFPQTPMEVKLGTWVAGRKNAPEGTVEWAGGYTDFSQAPFNAYYKSVKIVDYAGGSGPASGPVRQYVYGDKSGDWESIVVEKGEGPADGQDDKTTATTSKTAKPTGTLIEPDQKTTTTTTSERLYTKPKTTIEPSTPVPTTLVTPDKTTSEAAEQTTGSGVESSTETSDSAATTSSPAQDAAGSLRVAFGTVALAGVVALAQLL

SEQ ID NO: 615 - protein, 629 aa, Unknown
  Kingdom: Fungi, Phylum: Ascomycota
MGFSFRSLTSSALVAQNEEAASATRKDVADVPASVLGHTSSLDQPRNVDEKLGGSHDVAANGDEESVNKVDAEAEAGVKKAQAMTLVWTKKELILAYINVDWTDHILLSLRSVWLLAFMLAFCSSCVSYLTPFVTSSFQYHSLTALTGVISNLISGIWKLPYAKIMNIWGRPFALFIGVVSITMGLIMMAACKNVQTYCAAMTFFYMGYNMIDFSITIFVADTSRLRNRAFFIGFASSPFLITTWVASPATNDMLKVGGIGFRWGFGIFAIILPVVAAPLIYLFVKNNRKARERGLIPEEPNRGSFAEAVKYYVIEFDLAGLLILATGLSLFLLAFNLYSYQTDQWKSPMIICFIIFGFLLIVAFGFWEKYGAPVSFVPWHLLKNRTVIFTYTMAFSLYTAWYIWDTYLYSMLIVVFNQPITYAGYINNTYTMGSCTCSIIYGLALRYYGKLKVYSVTLGVPLTILGVGLMIHFRQPDVNIGYIVMCLIFIAFGGGILVISEQTTLMAVSKQQDYPALLATESMVISIGSSIGSTIAGAIWTGVFPKKLMENLPADALDKFAEIYGDITTQSSYPWGSPTRDAINKSYGQAQRYMLISAVCMYSITWASTFLWQNVDVRKQKQRTVGLL

SEQ ID NO: 616 - protein, 404 aa, Unknown
  Kingdom: Fungi, Phylum: Ascomycota
MAQYGYGGGSNPYDQRDQSGGNYGYGGQQNPYAQQPNPYGQQQQNPYGGQQSNNYGYGGDDGGYGGGNSMEMAPLANNAGPPNSDPNAVLNECRDIDSGINTVEQNLEQLRMIQQRTLDDADSSASSQANRQLDALSSETMALYRTLTERVRKVKSSPDASSPRNSAQVGRVDRRLKAAIQQYQQVESQFRKRTQDQMARQYRIVRPDASEQEVREAVEDTSSGGQVFQQALMQSDRQGRARAALSAVQDRHKALVKIEQQMVELAQLFQDMDTLVVQQEAAVTQIEQKGEEVVDHLDKGNEEIGTAVKTARATRKKKWWCLGICCVIILIIVIVVLIYVFVIRGQNNGGNKKRHILLPPDMMNRINVPLNAAKRALNEGRDAPQLSEAARSIASQRFRVGVAI

SEQ ID NO: 617 - protein, 235 aa, Unknown
  Kingdom: Fungi, Phylum: Ascomycota
MATLATASRLALRSAASIKAPAVRALSSTAVRGSDASASASSYTSPFKGTEQKGNKIPDFGKYMSGGEGSNKVFQYFMVGTMGALTAAGAKSTVQEFLVNMSASADVLAMAKVEVDLNAIPEGKNVIIKWRGKPVFIRHRTQSEIDQANKVNVASLRDPQADEERVKQPEWLVMLGVCTHLGCVPIGEAGDFGGWFCPCHGSHYDISGRIRKGPAPLNLEIPEYDFPEEGKLVIG

SEQ ID NO: 618 - protein, 1075 aa, Unknown
  Kingdom: Fungi, Phylum: Ascomycota
MALPSLMSLAVAAVALLPALAAAQSNSSFSNADMLRAHYELMDGRTKDCPPCFNCLLPAHHCSQYAGCNEFNGKCDCPPGFGGDDCLNPLCGSLPKGKDRPMRGRDNCKCDEGWTGINCNVCTSNNACNAMMETGDGGVCYQNGEVVNQNHQICDVTNKKITSLLGTQRPEVTFTCDAKSETCDFQFWVDEVESFYCHLSDCDSSAEFSADKNSTSAKCSHISCECIPERMLCGKDGSVDLGEFLEVSIKGPGSFECTQKHGGAHECAFKEPEMDALILTLIGDSSIFLDCRAGECLYETQVPGFHLPVHKINTPLIAGVIAGSGLFVVAVIILVWYLSRRKLRYGAIRLDDSDDESIKLMANHKPAALYFEDVAYSLNGKTILSNIQGICHPGEVTAVMGASGAGKTTFLDILARKNKRGQVAGNFYVNGEKVSDANYKNVVGFVDQEDTMLPTLTVHETILNSALLRLPRDMGRAAKEQRVHEVEKELGIYHIRDSLIGSEEGKGRGISGGEKRRVGIACELVTSPSILFLDEPTSGLDAYNAYNVIECLVTLAKTYKRTVIFTIHQPRSNIVALFDRLILLAKGKTVYSGPFSRCQAYFDSIGYECPPGFNIADYLVDLTMHAGSVSYTDDGSIPADAASVGPSSTRAVKSVASISGGSTAEDSGAEQGSSQRPKNSRKDSVRAQQERALFTRRRTVDTAASSDAGGEDVGSYRLLANPTDSHPSQLPEDLHDLPPSAVSGTDLDTMTKAFARSSIHSSTHEEIHQAVSSAGAANGQNGGSSISDSAVGRGYARVGYTRQFIILSQRTWKNLYRNPMLMLTHYAIAIILAVFSGYLFYGLTNDIKGFQNRLGLFFFLLALFGFSTLTSLTVFAQERLLFVRERANGYYAPLTYFAAKVLFDIIPLRIIPPILMGSIVYPMTGLVPDLEHFFRFIAVLVLFNLAAAGICLFIGIICKDHGVANLIGSLVMLFSLLFAGFLLNYETTPKGAAWLQTLSIFHYGFESLIVNEALELTLIDQKYGLDITVPGAAILSSFGFNNAAMMSDIRNLGVFAAVFIVLAYGALHFVLVEKR

SEQ ID NO: 619 - protein, 400 aa, Unknown
  Kingdom: Fungi, Phylum: Ascomycota
MWLMHPATNPSPDRLTNFYQPITNRPCACTWVQTCVTSKVPRGRSRSTKKVTRTEPNITPEQNGSVELNLPPQDLNITSYDYPIESSPLAMDLVNSLEGRLLFAVPKKGRLNAAALNLLEGADVQFRRENRLDIALVKNLPIALIFLPAADIPTFVGEGQVDLGITGWDQVQEHDAGVRASHSDPESVPDSCEVVMELGFGSCKLQVQVPEKGQYAATQDLVGKSIGTSFVNLARQHFAKLEGVPAGGKLRTKIVELSGSVEAACALGVADGIVDLVESGETMRAAGLKAIDTVVDSTAVLIKSRQPSNLKTVDLIASRIRGVITAQKFVLCQYNIERSRLTEATKITPGKRAATITSLDAEGWVAVSSMVEKKKIALVMDDLESVGAQDILVLDIHNTR

SEQ ID NO: 620 - protein, 455 aa, Unknown
  Kingdom: Fungi, Phylum: Ascomycota
MASRRLALNLSQGLRNRQALSSSSSLRRGFASPASVGKTQTSTLKNGLTVATDYSPWAQTSTVGIWVDAGSRAETQETNGTAHFLEHLAFKGTARRSQQQLELEIENMGGHLNAYTSRENTVYFAKAFNSDVPQCVDIISDILQNSKLEPAAIERERDVILRESEEHQPLGRTILGPRENIRDITRTELTNYIKNNYTADRMVLVNSGGVPHEQMVELAEKHFSGLPSKGFENHASLLSKKKADFIGSDVRVRDDTMNTANIAIAVEGVSWNSDDYFTALVAQAIVGNYDKAAGNAPHQGSKLSGFVHKHDLANSFMSFSTSYSDTGLWGIFLVTDKTTRVDDLVHFAIREWMRLCTSVTPAETERAKAQLKASILLSLDGTTAVAEDIGRQLVTTGRRKEPSEIERLIDAITEKDVMDFANRKLWDRDIAISAVGQIEGLFDYQRLRNTMKPKW

SEQ ID NO: 621 - protein, 744 aa, Unknown
  Kingdom: Fungi, Phylum: Ascomycota
MRWSHAPLLAFAAVASYVAPASAERMLRSSSLNTCQEKSSFTASLFNVVYTPNNNSASVEIVATSSVQGHVKFDVTGWAYGYRFLHETVDPCDLDLAGLCPMVAGKIPFGFALDVPESAAKVIPGIAYNIPDLDAKIRVYVNLTKTGETAACVEAEISNGKTVDLIGVKWATAIIAGLALVSSAVLSGLGHTNAAAHVAANSLSLFGYFQSQAIIGLTGVRQPPIVQSWTQDFQWSMGIIRVGFMQDIFTWYQRATGGTPSTIFDSLTTTSVQVQKRGLEYAAAGVDLFKRGLAMTPVASILKRANIENGSGGYVVFGIQRVAFRAKIESTNLFLTGLTFFCIFVIATVLAVAAFKGILELAAKQKWMKSDTFLEFRNGWLTILKGILFRVALLGFPPLTILSLWEFTQVDSPALVVLAVVFFFGLLATLGWGASKVIRIARRSVAMHRNPAYILFSDPQALNKWGFLYIQFRASAYYFIVPMLAYTLVKGMFVAFAQRSGIAQAIGFLILEAAALIAASVLRPWMDKPTNSFNIAIYAVNFINAICLLIFTDVFGAPPIVSGVVGVVLFVLNAAFSLILLLMVIISTCVIFFRRNPDARYQFMADDRASFMKSQTQLNATTELDALAATARGDKSGYNKSQLDLDDDNDSLVSSSVARRNGGNDSQASFHQGGPRSPVNPNMPMFPAGRPESPFRSASPSPYNRSGSSLGQQRGMNNSSPAGGYRPPPQQGSSPWQRGAGYDH

SEQ ID NO: 622 - protein, 581 aa, Unknown
  Kingdom: Fungi, Phylum: Ascomycota
MSSTDETTNDRAAPAAAAVQKTSGGNSAFRNYNNDFAHVTDLNERRRLALAEIDKAPFGWYHVRACVVAGVGFFTDSYDIFCVSMLTIMLGIVYFNDSKGKMPTSSDSAIKLSTSAGTVVGQLGFGMLADIVGRKRMYGLELIVIIFATLAQALTSGSPACDIVGLIIFWRVIMGVGIGGDYPLSSIITSEFATTKWRGAMMGAVFAMQGIGQFTGALVMLFVTLGFKSSLEGTAKISECRGDCQLAVDKMWRTLIGFGAVPACIALYYRLTIPETPRYTFDVARDVEKANEDVKAYVHGKTEGHPDEIGRATTQKAARETLEVPKASWSDFFRHHRQYKNWSLLLGTAGSWFCLDVAFYGLSLNNGTILEVIGYSTKNADTVYKFLYNTAVGNIIIVLAGAVPGYWVSVATIDTLGRKKIQFGGFAILTVLFIIMGFAYNHISSNGLLAIYVLAQFFFNFGPNTTTFIVPGEAFPTRYRSTCHGISAASGKIGSIIGQGAIATLRTHGATAKNAAPWMDHVLQIYALFMLIGCFTTLLIPETARKTLEELSGEDDYAVSHSTKSQDESLRSEPLKHESAV

SEQ ID NO: 623 - protein, 570 aa, Unknown
  Kingdom: Fungi, Phylum: Ascomycota
MLSNRHHDHGGLPGLRQLSQSLSWLLLLVWSPFTQAAYNLDLNSTDSIKEVSKSLMEDMLTFYHGDEPGQEPGLLPQPYYWWAAGAMFGTLIDYWYYTGDDSYVNLTTTGLLAQVGEHNDYMPKAQVLNEGNDDQGFWGLAVMAAAEYNFPNPPEDEPQWLGLAQAVFNTQAARWDEAHCGGGLRWQIFEWNNGYDYKNSISNGCFFAIAARLALFTGNTSYSDWAERTWDWMIGADLIDTNGYVYDGGHIQDNCTQLTRFQWTYNAGVFINGASAMYNMTGEQKWKDRLDLLLDGVKVFFTGPDKNIMTEVACEPVNLCNLDQQSFKAYLSRWLAATTKWVPGTSDFIKPYLRATAEAAIKECTGGNNGRMCGLHWINATWDGTTGVGQQMAVAEVVMANMIDSRPDAKTLKTGGTSKADPGAGGGDIGRTIPEGRTYRPLNAGDIVGAIILTVLFGGGFVAGIFFVMLDETSDRTTKQQFLGAKSSAIAMFTGGAAAGVAALQKRSSQDNEKGAAGTIITPVVAFGHVRSSDLRTCCNAAICIKPLWIIAVQKFGRGDFTTNFSAGGV

SEQ ID NO: 624 - protein, 795 aa, Unknown
  Kingdom: Fungi, Phylum: Ascomycota
MGFSNIVNKFKDNSATNVYTTSADGSGEDIAHADTHLRRVKDQHKWDPFMDVDKIDAVDAALQTGDAEKEAAIEQSILQEDSPYLEVRSSVKPTDDPTAYVDTIRAWTIGAILCTIVGSINVLLYEHYFQVSITSSVVQLLAYPLGTGWAKLMPDVKIFGASLNPGPFNKKEHTLITMMAAAGTTISYSISILIAQEIFYGQSWGWGFQILLIMSTQVMGFGLAGVMRRFLIWPAAMVWPATLITCSVLDALHHHGSADSANGWTVGRYKFFMIVAGATFFWEWIPNCIAPFLAFFGQFPTWIAPHNIAVNQAFGGHNGLGFIPGTLDWSSIAGFFGNPLQFPSFAIWNSIFGAFLILICGYAVAYGGAEFYRYLPLSANKNFDNMGKVYNTSRILNPDLTLNIEAYEAYSPLLIGPVFTMAYALGFAALMSTVVHVALFYGKDIWRRTKDAKYEEPDVHLKLMRKYPEAPEWWFMSVFAISFTFAMIASQVWDTKLTWWAFILCVVMGVVMILPVGIIQAITSQQTGLNIITEFIVGYMLPGRPVAMMLFKSWGYMLMANGLTFVSDMKVGHYMKVPPRSMFRAQLFAAVWLSLVQIATYNFLLGNIPNFCSEDQPQGFTCPGATTFYNASVIWGVVGPKRMFGPGALFSWINWFWLVGAGVTVAHYIIARRYPKSFARYVYWPAIFSIGGMIPPATLWNLSNWLVVGAFFNIYLMKKYRPWWSRYTYVMAGALDVGNAICLVLFALGLGLSSSAFPTWWGTTVADETYDAMRLARARPMPADGSTIGPAPGSW

SEQ ID NO: 625 - protein, 379 aa, Unknown
  Kingdom: Fungi, Phylum: Ascomycota
MAAHDQKVMGMPVSFPDCTRTIPGRFYESEHPSPRIELRSRLLTYSNVPTPVGGVSAAVSKTAAAPIERIKLLVQNQVRSAQHHNWTWRERYVTTLAAGQADRLGYDEMIKAGRLDRRYGGIGDCFKRTIADEGTRSLWRGNTANVIRYFPTQALNFAFKDKFKAMFGYKKDRDGYGLWVFGNVASGAASQAHEAAGALSLLFVYSLDFARTRLANDAKSSKTGGQRQFNGILDVYRKTIATDGILGLYRGFMPSISGIIVYRGLYFGSYDSLKPLVLVGPLQGNFLASFILGWCVTTGASTLAYPFDTIRRRMMMTSGEAVKYKGTLDAARQIIAANGVKSLFNGAGANILRGVASAGVLAIYDQLQSLALGHGAKSG

SEQ ID NO: 626 - protein, 443 aa, Unknown
  Kingdom: Fungi, Phylum: Ascomycota
MRSYIFLGAAALAAASPALTGLDFAAIEHAPAPTGPAVGIAIEQSVYDPSTAASEAEEAASDDASRSVQRRSLVERTFCWFDKRYCPVSHPGHQNDYKPHPNPFPPEQGKPHHPPAATSTRCAKSTSTTSATLTTTSASSASHVVPSSCTPISWTNTFAFTSDTACPTPYEVGTYCGFINPDDPCALQPGGFGPVSSPDTVQAFLNNADLHKMAKSASDPRGYKNTFKDLSAAVNANTYLGYRILETYDVQACADWCDDTDLCTSFNVFIERDPKWNPYKCSCEQPDSITNFKCSLWGSGVDAKAAVNDGQYRGDFEVRIVGSNGYQKTDETVPKTPDECENPQKCPAAHDHSSTCIGEHFFPGPFDVAVCAKYALAYNKQVSKRKQCKFFNAFMIKENFVAKGTYCKLFTKEYSAKFATWVPGWYKNKWYSIESSWSYSLRS

SEQ ID NO: 627 - protein, 333 aa, Unknown
  Kingdom: Fungi, Phylum: Ascomycota
MSTSEPDIAKAAMATNMTFLWKLRDSVSQPVVAAFCAGGVAGAVSRTVVSPLERLKILMQVQSVGRDAYKMSVGQALKKMWVEEGWRGFMRGNGTNCIRIVPYSAVQFSSYNFYKRNIFEAYPDAPLAPLTRLVCGGIAGITSVFLTYPLDIVRTRLSIQSASFAELGDKPKKLPGMWVTMVTMYKNEGGMAALYRGIIPTVAGVAPYVGLNFMVYESVRKYLTPEGDRDPSAARKLLAGAISGAVAQTCTYPFDVLRRRFQINTMSGMGYQYKSITDAVRVIVSQEGIKGLYKGIVPNLLKVAPSMASSWLSFEMTRDYLVALKPEADEATL

SEQ ID NO: 628 - protein, 489 aa, Unknown
  Kingdom: Fungi, Phylum: Ascomycota
MRFSTWLSSTAVLLSAHSATASDAHRRLHSHNHLHELEKKHTHGHLQVRQTEEAAPAKRGGQCQFPSDDPNLVAVTPGSKNAGWALPPDQACEPGMYCPIACKPGMVMAQWQPGSTYTYPASMNGGLFCDSNGNIKKPFPDKPNCVPGTGTVQAVNKCGKKMSFCQTVLPGREDMIIPTLVSDSAVLAVPGPTYWGSTAAHFYVNPPGSEESDCVWGDESSPIGNWSPYVAGTNTDSQGLTYVKLGLNPIWIDSPLKGNKPDFGLRIECPGGGCNGLPCSIDISGSSPQIKGLTADTGAGGASFCVVTVPKGSSANIVAYSADGGAGSSDSSAPEEKPKTQPKPEPSPKPEPKPVVQETTTSEPAPAPTSTYTPPPPPKPTTTEEPKTTSTTIKITTASPQPTTSSTTTKAKTKESLPSYKPGVFRENGTDPTPTQMSKSTSASKPTQTVQEVEEKPETKDEDNQAGRKGGQAPLAGLVIAFVAAACFF

SEQ ID NO: 629 - protein, 614 aa, Unknown
  Kingdom: Fungi, Phylum: Ascomycota
MASWLTAPVQLTGSRAFTCDGFTEEQCKYYMHRWHFWYIADHVYALPTVAFFINRSSAIWRRGVASVRYLSYRGFQVKALRWNSAPLGLLLLGLAGAVYFFCMTLIPQPYYWSSLDFGGSPPLGTRSGWMALACMPFVFATASKTNWITLLIGVSHEKLQVFHRWSAYAFFLLALLHTFPFIVYHVRFHNMEMQWKMNNLFYWTGIVALLFQAWLTFASHSVFRKLGYEFFKMTHYLAVVVFVLIFFFHCDYTLTSWHYFIATAAVYVPCFGFSWLRTIFEYGLTKKAYLHVEKNGFTRITIPVQTQTWIPGQHCFLRFTSFGLQRMSSHPFTICSLPPPVHDRNAKAELIFYIRHQGGLTERLHNHALNHPNVPVPVMVDGPYGGINMPKFAKADRTMVIAGGSGAGWVLPFVELFQRREALLAQHDETGVAMQQQDDEPQNKINSESSDLETPLKAQIPLLRVIIATRETSSQVWFRQAVAKTLSKSVSSGRANTAGKFHVYVTGKADQEAEITASMPVYGLEEPKEDSVVNTRRSFPQMEPVHHGRPDLPSMIHEEATRAMEAGESLSVFVCGPDSMLQDVRNAVAAENLRIIKGRGSGEVYLHTEHFSWA

SEQ ID NO: 630 - protein, 262 aa, Unknown
  Kingdom: Fungi, Phylum: Ascomycota
MIANTLLVLATAALAAATPINKPGGARCKGANPVLPVNGDFPELPAPPAGARLKRIALGYGIQNYTCAGADAAPVATGALAGLFDITPLYPNPEDPKSLDQATFDRLTAMVVESASKNIPLHLVSTLPDRVPNAAPGADASKPFLPTKDLPVPGLAGVKLKHTGEHFFTDAGVPMFKLDDGLSIQCAKLDGFNAPKSAAVGPHGEAAVAWLRLGVKEGTEGKGTNGLKFVYRVETSGGSSHGCKDGGASDSSFYTAAYWFYG

SEQ ID NO: 631 - protein, 289 aa, Unknown
  Kingdom: Fungi, Phylum: Ascomycota
MENYDILRLNTSMIGQNVIPWDKLNLGNIVDNLKRDIGDDIKDKLNDVKDDAKDTLSDIGDDITDGANNITNQIIGDIAERLGISDWYSIHVMSACQGAWEPNSTVSSPSLNVTNCTDTTPTYRLNLTEILDQELSAGGLGISLADIKWPSQIQEKIDLINDLLLAIFIVYVVGMGFCGLAILGCVGSLIFASSRLLVLINYVLSGLGALALIIGSIIVTVVGTKGISELNNVTKEVNVYASRGKDFLIISWVAAACMIFASVFWTTRFCVLCVQKRRDKKAATPKGSY

SEQ ID NO: 632 - protein, 553 aa, Unknown
  Kingdom: Fungi, Phylum: Ascomycota
MSGQQYYGEQQQPGQYYPLQPYGQQQPQYGQQPYGQQQYGGQQQQQWQQQQPPPPPPPQDYNQSHQQQQPYAPNGGYEGGYDEKHSYDQAFKIDKPKYNDKWAGILLIITFLGFAGLSGYAIYGYYRSQSHNGGAIDGGRNNFGLNSNTLILFGIVLAVAFILSLIYLFLARTFPKIFVWVTGILNVVFAIGTAIYYLYQKQYVAGIVFMIFGLFLAFCFYTWIPRIPFAALMLTTAIDISKSYGHVYLVSLIGGIIATLFGAWFSVTLVAIYLRWEPGANNPNCAANGCSKGTVIGLVAFVTFAMYWISEFIKNVIHTVIAGVYGSWYFCVHNFPKDATRASARRALTYSFGSISFGSLIVAIIQFLRLICNAARSQAADDGGIFGMIGYVIFCIIGCLLSLLEWLVEFFNKYAYIHIALYGKPYIPAAKDTWHMMKDRGIDALVNDCLIGPVLSFGGVFVGYATTLLAYLYLHFTAPEYNRDGGFTAVIMAFAFLIGLQICNIFTTPISSGIQTIFVAAGWDPAVMIRDHPELYHKMVQVYPPVQEAIVVR

SEQ ID NO: 633 - protein, 466 aa, Unknown
  Kingdom: Fungi, Phylum: Ascomycota
MHYSPGAPVLHSKDLVNWEYVGHAVPSLDWGNKYNLNGARAYVNGIWASTMRYRKSNGLYYWLGCIDFGTTYVYTSPSPSGPWKLGGKINTCYYDAGMLIDDNDQIYVAYGNSKISVAKLSSDGFSQVSTQQVFTTPSSIGTLEGSRFYKRNGQYYIFMTKPANGQYVIKSSSPQSGYGSAFQVLLNLKSPVSGSGIPHQGSLVDTPSGEWYYMAFIDSYPGGRIPVLAPITWTGDGWPTIQTVNNAWGANYRYPTTPVNLGSTTGKDSFSGTSLGPQWEWNHNPDTTRFSVNNGITLSAATVTNDLYWARNTLTKRIHGPQGTGTLELDFSKMADGDRAGLALFRDKSAWIGVARDGSTNKVQYVTNVNLSTGNGWPTQSTGTISASQTVSGSKVWLRIKADIAPGGSKTATFYWSSDGNTFSQLGGGFTMNSDWQFFMGYRYGIFEYATKALGGSVKAVSFTTA

SEQ ID NO: 634 - protein, 442 aa, Unknown
  Kingdom: Fungi, Phylum: Ascomycota
MVFPESTEDVSKVVTILRENECPFGMRSGAHSAFTSSNAIKDGVTVDFGYMNSTTYDESTQVASIGPGSDWGMAYKTLSPYNVVAVGGRADVVGVGGFTTGGGYSFHTGVRGFACDNVVNFEVVTGDGKIVKANKDENSDLWRALKGGSGNFGFVTRIDTQVFPSSEIYASLNLVPFEQKAAVREVYFDFVHNQDEDPASQIIVASNYAKGEYGCGVILSNIEANESSSSFDGARALPIDQIIAMTGPAHEVVPIFTGPTPLGLFANWQTGMVDHKLDIMEAIDEIMVEHIEKMRAVVADDAFEMIFQWQPVTPGNVRVMNELGGNVLGLESVVVEGPVLMYNIVLTVDTAANQDIVLPIAFEMNAAIHATADQLGRNKHWQFVNYAHGSQDPLSHYGAENIAFMQEVSRKYDGEAVFQSLRQTGFKIPGPIPPHGPKPPTK

SEQ ID NO: 635 - protein, 505 aa, Unknown
  Kingdom: Fungi, Phylum: Ascomycota
MVPFSLWAVLPTFAIQTVTASSSSSITKDACSLLSQLLPEEVAIPGSETYAHSNNYWSALQAELTPECFVLPRSTEEVSTVIKTLTCTNVPFTVKGGGHSAFAGASNTDGGVTVDLSRLNDITVSDDEKTVSIGPGNRWINVSEALDRRGLAVVGGRVASVGVSGLTLGGGISYFSGRYGWACDNVRNYEVVLASGKIVNASPKENKDLYWALRGGGGSNVGVVTRFDLAAFAQGDLWSNTVVFPGAMNQTIIPTFVDIAQNRLQEDSDAHTYFIVSYQPTFGGTITAASFYHASLPDESKVPPVFESFQKFPNPLVNSTVVANVSTLSRAIDEPYGLRQTWSDTTVKVTSPELFQKIALLFDAHLEVLLEAAGNTTLLPFLVYQPISVNIIEAMQKNGGNALGLNPEDGPLMIIQLTTKWTDPQLDQLIEEESARFIAKVEKLAKEYDATKGYVYMNYAGQSQDVLRSYGDANFARLKKIAKKWDPKGQLQRDWKGYFQLSETT

SEQ ID NO: 636 - protein, 345 aa, Unknown
  Kingdom: Fungi, Phylum: Ascomycota
MAGLLKTGLVLLGSTLVAAAPLTERADTCATKGKPSGKVLQGYWENWDGSSNGVHPPFGWVPITDSRIKQHGYNVINAAFPVIRSDGTALWEDGMDTGVKVATPAEMCEAKAAGATILMSIGGAAAGIDLSSSTVADKFVSTIVPILKKYNFDGVDIDIETGLSGSGNINSLSASQANLIRIIDGILAAMPSNFGLTMAPETAYVTGGSVTYGSIWGAYLPIIKKYADNGRLWWLNMQYYNGAMYGCSGDSYSAGTVEGFVAQTDCLNKGLVIQGTTIKVPYDMQAPGLPAQSGAGGGYMSPGLVGQAWDHYNGALKGMMTWSINWDGSKGWTFADNLKGRLGTA

SEQ ID NO: 637 - protein, 702 aa, Unknown
  Kingdom: Fungi, Phylum: Ascomycota
MAHREDSRPANRHRRGDSSRNKNQHRKRKSQSSRRPVSTSDESREGDRASQALSAEALAQLNRDNNRPSRGGNGGSPAKKKTRPPERTKKVTREDYRELVREAERHRHDRHREKRRGDGKKRRVVSGAVMEEGRVKSGLRGGGHWSEESLEKDYYNTRRPKKRSKKRLWIIGGVIVILIIVIIIVAVVVSQKNKGKDTSSSSSSGSGDQSSDLSGLNRNSVPDKWKNSYLDPWSWVSTTDFNLTFTDETVGDLPIMGLFDSWDDSARANDQVPPLDEQWGSYSKRPARGVNLGGWLSLEPFITPSLFNYDVQDGIIDEWHLCEKLGSSKSKTLEQHYASFITEQTFQDIQAAGLDHVRIPFSYWAVQVYDNEPYLFRTSWRYLLRAIEWARKYGIRVNLDLHGIPGSQNGWNHSGKWGLIGWYNGTDGDQNAQRSLEIHDRLSKFFAQDRYKNVISHYGLCNEPRMTFLKTSDVVSWNEKVYSMVRGNGIKALVVFGDGFMGLNNWKGVMSGYDDMVLDVHQYVIFNENQIDFTHQKKVEYACQGWSDQAELAQDPSRGYGGPTIFAEWSQADTDCTKFLTGVGWGNRWEGTFDTGDPSTSFLEPLCPTKDSKCSCDKANADPSDWSDEYKKFLKMFAEAQMHSFEKGWGWWYWTWKTESAPQWSYEAGLKAGVLPAKPWERDFDCDTDVPDFQKLGLDEYY

SEQ ID NO: 638 - protein, 664 aa, Unknown
  Kingdom: Fungi, Phylum: Ascomycota
MARSRSSLALGFGLLCWLTLLFSPLAFVQTVKADEADSYGTVIGIDLGTTYSCVGVMQKGKVEILVNDQGNRITPSYVAFTEDERLVGDSAKNQAAANPFNTIFDVKRLIGRKYDEKDVQADLKHFPYKVVNKDGKPIVQVEVDGAKKQFTPEEISAMILGKMKEVAESYLGKKVTHAVVTVPAYFNDNQRQATKDAGIIAGLNVLRIVNEPTAAAIAYGLDKTQGERQIIVYDLGGGTFDVSLLSIDEGVFEVLATAGDTHLGGEDFDQRIINHFAKLYNKKNNVDITKDAKAMGKLKREAEKAKRTLSSQKSTRIEIEAFFEGNDFSETLTQAKFEELNMDLFKKTLKPVEQVLKDANVKKSEIDDIVLVGGSTRIPKVQSLIEEFFSGKKASKGINPDEAVAFGAAVQAGVLSGEEGTEDIVLMDVNPLTLGIETTGGVMTKLIPRNTPIPTRKSQIFSTAADNQPVVLIQVFEGERSMTRDNNILGKFELTGIPPAPRGVPQIEVSFELDANGILKVSAHDKGTGKQESITITNDKGRLTPEEIERMVAEAEKFAEEDKATRERIEARNSLENYAFSLKNQVNDEEGLGGKIDDEEKETILDAVKEATEWLDEHGAEATAEDFEEQKEKLSNVAYPITSKMYQGGPPGGEADDAEIHDEL

SEQ ID NO: 639 - protein, 839 aa, Unknown
  Kingdom: Fungi, Phylum: Ascomycota
MSTIAIFLLLTAKALAVSEFAPVALTGTDWLGVDGNWSSITFRVGEPPQEVNLLVSTALSEVWVISPGGCEPKDPTCINARGGVFDSSSSDDWKDMGTWQLGLNYPGYEANGEYGTDKLNAHGSIYDGDFSMSGVLVSAINTTNYFNGYFGLGIATGNFNDEVADPPMVQAVKKFGRIPSYTYGYTAGASYKDQPASLTLGGFDKARFVDHPTKFVLSQRDDLPHVLVRGIGLSKDDIDSVLEAQGNQTVPASSWNESFSALIDSTTPYLWLPKDVCEHLANQLNLTYDDNFDLYTMTNDKYNEYMNSDDLSLIFSLSGIDNHDDFGSPLEAPGVVNISIPLRAFVGTIQYPFMGGASIAYGDPAVPYFTLRRAPNNSTFIIGRAFLQEAYIVTQYDQRQFAIYEARFPKEPIRGAEIETIGQGANSPYPGPESAGGRSGLTTGAIVGIVVGAVAAASVLAALVWLLCRRRRKARSPTPADSIDEAKGTGSSAIPDIPTSPLSKLWTRLRGRPSTALTESEKPPPIAPAEAAHGEIYELPAPVPPVELDGIDDSELTGDTRLGLLDGEENLSPYEQTRRKLERQLQGPVPAYSPPENGQTPPAEKAMHHIPPPVREPSADNLLPVSPATGGTNSNSLPNSVPSPISPRTDLNGELTDVVSSLASEASPFPPFSAHGSNSPPVSPLNSSSQGRSNASTTRSNADVPSPISPSPTPLPPQTSKIQRTPIDPSKVVYLGEMPEHLTFPRRSSLPRINMDNLETIPRAEPPHAQQASTLGSNYTEERERPAEPARRGGAAALRQQAEDSEPSTPRSQERIDPGEELIHVPQLAARRYSWEDTL

SEQ ID NO: 640 - protein, 151 aa, Unknown
  Kingdom: Fungi, Phylum: Ascomycota
MGRLHSKGKGISASALPYSRAAPAWLKTTPDQVVEQICKLARKGATPSQIGVILRDSHGVAQVKIVTGNRILRILKAHGLAPDVPEDLYMLIKKAVSVRKHLERNRKDKDSKFRLILIESRIHRLARYYRTVGVMPPNWKYESATASTMVA

SEQ ID NO: 641 - protein, 147 aa, Unknown
  Kingdom: Fungi, Phylum: Ascomycota
MALKRINKELTDLGRDPPSSCSAGPVGEDLFHWQATIMGPGESPYSGGVFFLAIHFPTDYPFKPPKVNFTTRIYHPNINSNGSICLDILRDQWSPALTISKVLLSICSMLTDPNPDDPLVPEIAHVYKTDRPRYEATAREWTRKYAV

SEQ ID NO: 642 - protein, 386 aa, Unknown
  Kingdom: Fungi, Phylum: Ascomycota
MSGPIDFDPERVNLTEFQDITQQGLITCYFTEAGNQYGGSLGIRIGSIFVIGAVSTAVTFFPVVAARVPRLRIPLYVYLFARYFGSGVIIATAFVHLLDPAYSEIGPASCVGMTGGWSTYSWPPAIALTAAMLTFLLDFAAEYYVSTRYKIPHAKSEVEDVITTAGTNGHGHQHLHSGEVDQHPDERAAQDAEAAAKKKSDATYADIKELQHLDGDSPDVELAFKTQIAAFLILEFGVLFHSIFIGLNLGVAGPDDFATLFPVLVFHQSFEGLGIGARLSAIPFPNRLRNMPWLLCAAYGLTTPIAIAIGLGLRTTYDNSSFTANVVNGIFDSISAGILLYTGFVEMIARDFLFNPDRSNDKGRLTFMVVCMFLGAGIMALIGKWA

SEQ ID NO: 643 - protein, 683 aa, Unknown
  Kingdom: Fungi, Phylum: Ascomycota
MASLRYLVAIAASAPAVGALWTNGSVIAPCDSPIYCHGDILEEIQLAHPFDDSKTFVDMPARKSLDEIREAFDKLEKPLRNNSALNDFLDEYFYDAGGELAEVPTDELKTDPKFLEDLDDDVIKEFVEKVIDIWPDLTRSYNGSNNCTDCPSSFIPLNRTFVIPGGRFREIYYWDSFWTIEGLLRSGGSFVEIARNMIENFLDLVDDLGFVPNGARIYYKNRSQPPLLSRMVKAYVDYTNDTDILDRALPLLVKEHDFWMTNRTVDVEKGNQTYTLNRYDVENTQPRPESYSEDYYTATNESYYAESGIIYPQNEKLNDTQRQNVYRNLATGAETGLDYTVKFSMRPEDAARDVYFPLRYLNYVETIPIDLNSILYGNEIIISEFFNQTGNETAAREWADVASERSEAMHAVLWNETLYGYFDYNLTSGEQNRFWPADDDAKDWEKEYAPKGMQILFSVSQLYPFWTGSAPGYLKNNPLAVKQAYSRVSKYLEDSVGGIPVTNFKSGQQWDQPNVWPPLQHILMAGLQNTPATFGEDDQAYKDVHDTALTIAQRYLDSTFCTWYATGGSTKDTPQLEGLSDSDVGIMFEKYADNAINTAGGGGEYEVVEGFGWTNGVLIWTADEFKNELKRPDCGDIKAAETTQSEDGKRRKRSALELHPKDARRTKRFGKRARGQMKAPGIF

SEQ ID NO: 644 - protein, 172 aa, Unknown
  Kingdom: Fungi, Phylum: Ascomycota
MKYIHSQELLDIPEGVKVTIKTRQVTVEGPRGKLNKDLGHLAVTFAHPKRNVISIEIHHGVRKNVAALRTVKTIIENMIIGVTKGFKYKMRYVEIRNFIGEKIVRRVTMQPGVDVEASKTQKDELILSGNSVEAVSQSAADIQQICKVRNKDIRKFLDGLYVSEKGNIVEEL

SEQ ID NO: 645 - protein, 620 aa, Unknown
  Kingdom: Fungi, Phylum: Ascomycota
MISFHSIGWAVGGLLVATCQAKSKGLADIDHVILFMQENRAFDHYFGTMPGVRGFADPNAQVNDGVPVWKQPVTPSQSTSTNYLSPWYLNYLGGSWVDATQCITAGSNGWTANHAAWNNGLNNHWAMNNTPYSIGYYKRDDLPVHFALAEGWTVGDMYQESVIASTNPNRVMWISGSINVPGSLQTKDEGGYPYIDNNETPGCDSDGINCYPLKWSTSPEKLEAAGVSWSVYQDADNFDDNPLAWFAQFQNSKKGSSLNQKGFVGQTLDTFYAQAANGTLPEVSYIVGPAELSEHPPYSPHDGSWLQKKIAEAVVNSPKYSKSVLIISYDETGGWADHVNPYHSPEGTPGEWLNDPYGDAGYTPAGPGFRLPFYIISPFTRNGGVYTEHCDHTSQIAFIEKWQAAKGRNVTSDEVVPWRRGNMADLVNAFDFENPDYSIPNLPEVAAPHTSIVGTYDGTALCAAQYGNGRPPVPYASEAANEDTASLAEKGFKPVRGRLTEGRTLVLEHTGLALTAATHGVGLSAATSQHDDVHQGWILHAVEIGGNEFTMQSAVHGHYICGNLSLCKNSRSATVFSTDFEASSGHSFRGTNGQYLTVGKDKKLSWQKRPEFWSLFSVTY

SEQ ID NO: 646 - protein, 407 aa, Unknown
  Kingdom: Fungi, Phylum: Ascomycota
MKLLFLVLSTVVGALPPTSFTTRHVPKSLKFRKDGTFQISIFEDLHFGENAWDSWGPQQDINSVKVIEKVLDTESPNLVVLNGDLITGDNAFLQNATAVIDEIVGPIVARDLPWASTYGNHDYQYNLTGEAILQHENRYPNSLTRSMVPGHDAGVSNYYIPVMPDHCKSKHHCAPELILWFFDSRGGFEFQVKQPNGDFIGRPNWVDASVVNWFQQTHAALAHEHKKVIPSLAFVHIPTNASLALQTVAKVNPNHQPGINDDYPASVQSQGWCPDGTNNGCAYGGQDAPFMQALTQTPGLMAVFSGHDHGDTWCYRWDEGTVVPGMDIQGNGLNLCFGQHSGYGGYGSWIRGARQVLVSKEKLRNQEVDTWIRLESGSAVGRVSLNATYGHDWYPATPNDKTQCPTC

SEQ ID NO: 647 - protein, 196 aa, Unknown
  Kingdom: Fungi, Phylum: Ascomycota
MATVSLPPQLNGRDIEDICGKSINVPRSAALKLDWAKVTSSLGLRGQTVSSLQAFKKRNEDARRKVQQLSEQPTTVDFSHYRSTLKNQAIVDEIEKRFTAFKPTTYDVSRQLKAIDAFEVEAVKNAEATKQAVDLELKDLAATLKNIEEARPFEDLTVDEVAAAEKSIDEKTNALVSKGRWMVPGYKEKFGDLAIV

SEQ ID NO: 648 - protein, 183 aa, Unknown
  Kingdom: Fungi, Phylum: Ascomycota
MGLAFSKIFDKLWGKKEMRILMVGLDAAGKTTILYKLKLGEIVTTIPTIGFNVETVEYKNIQFTVWDVGGQDKIRPLWRHYFQNTQGIIFVVDSNDRDRIVEAREELQRMLNEDELRDAILLVFANKQDLPNAMNAAEITDKLGLHSLRQRAWYIQSTCATSGDGLYEGLEWLATTLRKAGHQ

SEQ ID NO: 649 - protein, 199 aa, Unknown
  Kingdom: Fungi, Phylum: Ascomycota
MAAPGVQSLKCVVTGDGAVGKTCLLISYTTNAFPGEYIPTVFDNYSASVMVDGKPISLGLWDTAGQEDYDRLRPLSYPQTDVFLICFSIVSPPSFDNVKAKWYPEIDHHAPNIPIILVGTKLDLREDSATLESLRQKRMEPVSYEQALVCAKEIRAYKYLECSALTQRNLKSVFDEAIRAVLNPRPVAQAKKKSKCSIL

SEQ ID NO: 650 - protein, 582 aa, Unknown
  Kingdom: Fungi, Phylum: Ascomycota
MATAPSSASVSSATMTARDHDVESQQGPTKVSFWRLLTDQAGVTPEVVSHPYAGHGTEESPYLVEFLPKDHWNPMTHSEGLKWTITFIQALAVLAVTFASSAYSGGVSEVMKAFGIGTEVAILGVSLFVLGFAIGPLLWAPISEMYGRQYILIINLFLITAFLAGSAGSQNIETLVILRFFAGAFGSAPLTNSAGVIADMFTAGERGIATSIFAMAPFLGPTLGPIAGGFLGHAAGFRWLEGMMAIFMGILWLACTFCCPETYAPRLLRVRAKALSKLTGKKYICKLDVGKPKLSIKQRLSIALLRPWILLFKEPIVLLTSIYMAIIYGTLYLAFAAFPIVFQKGRGWSPGIGGLAFLGMLVGMFIAVTGNILDNKRYMKMVHKHNGMPPPEARLPSAIVGSILLPVGLFWFAWTSKPSIHFIVPIIGSSFFGAGLVLVFLSIFNYLIDTYVIFAASAIAANTVLRSLFGAAFPLFTSYMYEDLGLGWAGSIPAFLALACVPVPFLFWKYGHTIRSKCKYAAEAEAFLHKIRQGQAAAAKQTESSPSESGVVATGEPTRDQAETEAETEAEEKEKEKEASSA

SEQ ID NO: 651 - protein, 490 aa, Unknown
  Kingdom: Fungi, Phylum: Ascomycota
MMIQSTLVALGALASTAIAAVKPLEIKGQEFVDADTGNKFQIVGMAYQPGGSAGYNPTTGVDPLSHPEECKRDAALMQILGVNAIRVYNLDPNINHDECASIFNDAGMYMMIDVNSPLPGEAIASVEPWTTYHVGYLNRTFAIVEAFSNYPNTLLFFSANEVIERDESVEFAPQYLRAVTRDLKNYIKNNIKRQIPVGYSAADVRKMLWDTWNYLQCSEDDDKDDMSRADLFALNSYSWCGPDATFTTSSYDKLVQGFKDSSIPIFFSEYGCNEVQPRVWNEVNSMYGSDMVGTFSGGVVYEYTMEDNNYGLVNITGDTLTILSDFNRLKEKFAGIKWKDVQSQKASSSTPKVPKCSSSLIKQSAFNSNFTLPRPPPGAQELIDDGISPKPQGKIVKISDYQVTLEVRDPEGNEIKGLKVVPVNSFNMAGENDADTGTGEHSSSENKNGTDGSDSGSSNNNNSGNDEDAAVLTKPLMWAVVLPLVAMFFA

SEQ ID NO: 652 - protein, 686 aa, Unknown
  Kingdom: Fungi, Phylum: Ascomycota
MRGLVWLPIGALLGSSLASNHVVHERRHKAIDNRWVKREQLKRDHVLPIRIGLKQSNLEHADAWLMDVSDPESPNFGKHWTAEEVLHAFKPSHETVQAVHSWLNESGIHPDRHQFSEGLGWLQFEASVEEAESLFQTKYHVFEHKKSSTAHVACDEYSVPAHISPHIDFVSPGVHFDTKVRADDTEYFAADGTRLKARNSISERKSKPGKKKPGRPWHRFPKALKHLWGKYDQNVCNTTFVTPACLRLLYDVPKDVHPVEGNSFGIVEYTPESYLGSDLDLFFKNYAPDLVGKRPVFDSIDGGFLFDTGINDTNAFNYLGEPSLDLQYAMALVDQQDVILYQVGDLAESNMTSFNTFLDAIDASYCTYDGGDDPAFDAVYPDPYPGPNSYKGKQDCGTYAPAKVISTSYGYNEVELTPAYEIRQCNEYLKLGLMGSTIVYSSGDFGVEFDGGGCLNPDGTENNGNSGIFVPTFPASCPYVLTAGATQIKNGTYNVDEAIRGNKQVEVVMELYLEDGGVSNDVPQGADVSNQVIFSSSGGFSNVFPIPSYQKHAVKDYMKKYAPNYPGQYNNTGMVRGFPDIAANGAWYSIAVFDELTLSFGTSCAAPVISALLTIINGERMKVGKGSIGFINPVLYAHPHVLKDVVEGQNPGCGTNGFSAVPGWDPTTGLGTPNFPKMLELFLSLP

SEQ ID NO: 653 - protein, 251 aa, Unknown
  Kingdom: Fungi, Phylum: Ascomycota
MAKNAPLAIAALILIAGSLVLLFFTILAGVTDTTPLNKTYFLRADTSGITGARSVTQWTYFYFCGEDNNDCSSARPAPAFGKAWAGGASNAPEDIIGSHGGGTTSTHYFYMWRFGWVFFLIALFFETFAFFGAFLACCGRLGAAISGLLSIVALLFLSAAASLMTAVFVQARNAFQDDGRDASLGRYAFGFVWGAWAALFIATILFCLGLRGDRSARTTTGGAGFMSRFRRNRSVRSRRSYDGRRVKDDYS

SEQ ID NO: 654 - protein, 896 aa, Unknown
  Kingdom: Fungi, Phylum: Ascomycota
MQRSSALDITIMQTFPGFMPFSLAMLATASLVKSQDCPGQPAAVEEWTWLGCYTEATASRALSRKTTAADDMTLEHCAAFCEDFTYFGTEYSRECYCGNSFNAGAVLRDDSECNMRCAGSECNYCGAGNRLSIYTKGGTGPGSTSIPPGPSTTSARPAPTGFPEGWESYGCWVDGVNGRILNHQAPDDPELTLESCVQLCADRGNSIAGAEYSRQCFCGDDIVNGGRKADTDSECNTPCGGNQNQICGGGGRMNIFALAEPQVVRPPAPIETVGDWVYQGCALDNVNDRKTFFWQNFFPGTMTPEICLDRCAEFGYMAAGLEYGEECYCGDPENMNTAGSEFVDEADCGVPCPGDPSSICGGGSRLSTYFWEGDPFYSWTFPTDGSAAAGSYDFLIGGVVIPLITSQTITGKVTFVEKWGTGPPNSTGAYELDLSVIDDFDAAWRTMHVKTDVFCAAGVTLPDKAGRQLVVGGWSGDSTFGVRLYAPDGSAGVKGENDWEENVDELSLQDGRWYPSAMNMANGSILVIGGQEGSNGAPVPTLEILPYTGTAPLYMDWLERTDPNNLYPFIAVLPSGGIFVAYWNEARILDEATFETIRELPQIPGAVNDPMGGRTYPLEGTAVLLPQHAPYSDPLGVLICGGSTEGPANALDNCVSIYPDAAQPEWKLERMPSKRVISCMAPLPDGTFIVLGGAQHGVAGFGLATDPNLNALLYDPSKPLGSRITVMANTTVARMYHSEAITLLDGRVLVSGSDPQDGVNPQEYRVETFTPPYLLGGDPRPTFTLSNKDWDFGEDVAFSLGAAARNGDITASLLGSVSSTHGNSMGARTIFPAVSCSATSCTVTAPPDAHVCPPGWYQFFVLDGGIPAVGIFVRIGGDPAGVGNWPQGDDFTRPGS

SEQ ID NO: 655 - protein, 211 aa, Unknown
  Kingdom: Fungi, Phylum: Ascomycota
MPALCGGNKTVNRKLVLLGDGASGKTSLLNVFTRGYFPTVYEPTVFENYVHDIFVDNVHIELSLWDTAGQEEFDRLRSLSYDDTDLIMLCYSVDSKDSLENVESKWVGEIADNCPGVKLVLVALKCDLREAENEEEGAEGSSQAQGAEQPREKRPTINYDQGLEVARRINAARYLECSAMRNRGVNEAFTEAARVALSVKKDSEESKCTVM

SEQ ID NO: 656 - protein, 809 aa, Unknown
  Kingdom: Fungi, Phylum: Ascomycota
MRVDRRGLSVHGMGRRTLDSGASPPPADLELGLVGKMDGHDYPEGGRAGDGDGERAVPLQGFEFTFDLPFTSGNSIEAEPWDMSDTASLSESVQSFPEEFGRTYHAYRAGSYAFPNDAPEQERLALQGECIKRVLGDRLYFAPLSPSRPPLRILDIATGVGDWAIDMGDLFPGSTIIATDLSPIQPENVPPNVYFYVEDSTDPWDFTHQFDYIHTRSTVGCWASFETQIAEQAFQALEPGGWFESQEVDSIVCCDDGTLTPDNPVAVLFNDLVEAAGKLDRPAILGATLKEVYERVGFVDVQQRGIKMPIGGWARDMRLKEIGLMWRANLLEGLAGFSYQLLNRAFDRTVEEINVSLIEALMEAAGLTAQADSIRNVAATIAYDAMGYYKGNVSKNEVDVGDVQKPYYWWVAGALWGAMLDYYYYTRDPTYNDVVLQALLAPVNMGANHDYTPKARELEEGNDDLFFWGSAVLSAAERNFPQPNTSLPSWLDLGANIFNALVSRWDPSTCGGGLRWQIYASNPNGLSYKNSVSNGGFFQLAARMARATNNNTYLDWANRLWNWSSDVGFIDPDRFHVYDGADSRDNCSQTNYHSFTYTSGIYLYGAAILADHTGDQLWKTRTENLLRGAGWFFSPFENATNVMYEAACEKNNACTADMTTFKGYLSRFIWQTVKLVPSLRSEAEKWLLPSAKAASVSCSGGVDGHTCGQRWYVHGFDGIAGLGEQMCALETIQGLLIDDVDPPLKGDKIKVVRDTKWVPLGAATTTSKGHDEPTSTGDPQPTETEDSANVATAHFGLVLVSIATILFIS

SEQ ID NO: 657 - protein, 349 aa, Unknown
  Kingdom: Fungi, Phylum: Ascomycota
MRMNTILALAAANLVAAQRSNNGTNPDNGGGSVNGFPGSLGSEFRLYGCVRSDNGFPTFRRVSMMPDMDLDFCAASCDTKYMGVQDTDCYCGTDIDEAQSTRVDLNSCDIDCPGNAEQKCGGVLLLGKRQNVPSNVLLTIYVREGEPDTTTTVTETSTSTGTITSCPPEVTDCPIGSKTIAIQTITSTFCPEPTPDYKKIVCYGDECFAEHTCDSCSLHRVVCRDGHCWVENCDTADHNRLVICEGDKCEYATGQHGKVVCYGETCDIQECYGDECKEKIINHEVCVGPKCPTPAPPSPTPAPPCYGPDCHIVVPNNNSTVPPVHAGADNILPAAGAVFGLVAGFAALL

SEQ ID NO: 658 - protein, 205 aa, Unknown
  Kingdom: Fungi, Phylum: Ascomycota
MSSRKKVLLKVIILGDSGVGKTSLMNQYVNKKFSASYKATIGADFLTREVLVDDRQVTMQLWDTAGQERFQSLGVAFYRGADCCVLVYDVNNAKSFEALDSWRDEFLIQASPRDPANFPFVVLGNKIDVEDSKRVISNKRAMTFCQSKGDIPYFETSAKEAINIDQAFEVIARNALAQEESEEFSGDFDDPINIRIENDRDGCAC

SEQ ID NO: 659 - protein, 218 aa, Unknown
  Kingdom: Fungi, Phylum: Ascomycota
MTDTLPPDTQTSSSSTAAAQDASRRQPPSSSAPSAELASAISTLRASLRSFQDFPIPGIEFVDIMPLFADPRAHATLLDALEMQVRQQAAATGGMPDIIVGLDARGFLFGPGLALRLGVGFAAVRKKGKLPGPCVTAEYLKEYGADFFQMQEDAIKEGQKVLVVDDIIATGGSAKAAADLVGMCKGSVLGFLFILEIPGLNGRDKLNGLPTTILLENE

SEQ ID NO: 660 - protein, 215 aa, Unknown
  Kingdom: Fungi, Phylum: Ascomycota
  misc_feature (32)..(34): Xaa can be any naturally occurring amino acid
  misc_feature (86)..(94): Xaa can be any naturally occurring amino acid
MSKITVANVRTQVEDLLTYSNETKKRNFLETXXXNYDPQRDKRFSGTIKLPSVPRPNMSICILGDQHDLDRAKHGGVDAMSADDLXXXXXXXXXKKLIKKLARKYDAFIASDSLIKQIPRLLGPGLSKAGKFPTPVSHADDLSGKITEVKSTIKFQLKKVLCMGVAVGNVGMTNEQLVGNVMLAINYLVSLLKKGWQNVGSLTIKASMSPPKRLY

SEQ ID NO: 661 - protein, 679 aa, Unknown
  Kingdom: Fungi, Phylum: Ascomycota
MFRLLPFSYLLFACSSLAQFVQQDEELRNLTTVRSPADAKITVSFKEPDGACSTAFDSQKQYTGWVNVPGDYPTNLFFWFVGARQETDSLTIWLNGGPGSSSMFGLFTGNGPCEVIEKGLNEYQTVAREWGWDRASNMLFIDQPNQVGYSYNTPTNGTVRIADSTIDQPPQGPSPDLPLWAQLNGTFSDKRGDGATQTANTTELAATAIWHMLQGFLSTVPPFANSTNSLDVHLFAESYGGRYGPIFAEMFETQNRKRLSGALDPATTKEINLVSLGIVNGCIDREVQVPLYPVFANNNTYGVKAIGDREAAYIADQFNAKDGCGDMLRRCARAAAENDPDGEGDNESVNKLCSSAAEVCSDIESPYYNSNHGAYDLAANSADPFPPLFFEEYLNQAWVQRAIGSPVNFTTSSTEVFNEFKQTGDGSRDGNIPRLAALLNSGVRVGLIYGDRDYICNWFGGEAVSLRLAQEAGAEYGNGFQAAGYAPIIVNDSYIGGAVRQFGNLSFSRVYQAGHAVATYQPETAFQIFARILAGGSVSTGSTAISLSNYSTSGTREAEEKQKLPDAPAPTCYVRSFGATCDSSARELAASGQGVVINGVLYREEQDWPLYDKEAGKSKAETSTKATQTATQTKTGGLTGAFTATNTPASGGDKSAAISVRIWKGGLVMALMTMFGVMW

SEQ ID NO: 662 - protein, 172 aa, Unknown
  Kingdom: Fungi, Phylum: Ascomycota
MSQPVLLSATSDSDVSSTCTRYELTQSQFASLRSSASSAKALAYCPYSRFRVGAALLSPDGSTVISGANVENASYPVGTCAERVAIGKAVTWEGEGGPVKTFKAISVATDISPPASPCGMCRQFIREFCSLEMPIIMFDSKDQYMVMTLGELLPMSFGPDALPPPGAPGAQG

SEQ ID NO: 663 - protein, 215 aa, Unknown
  Kingdom: Fungi, Phylum: Ascomycota
MSSLKGPTPQQHDGSGLRVAIVHARWNTSVIEPLVRGAKEKLLACGVKESNIVTQSCPGSYELPIAAQRSLREGQKKADSGRHSIISASQIQQTSTGGPSATDLLASSTTDLTSLPSSNTAPFDAVIAVGVLIKGETMHFEYIADAVTHGLMRVQLDTGVPVIFGVLTVLNDEQALARAGEGTSEKKHNHGEDWGLAAVEMGVKRREWAAGKIEG

SEQ ID NO: 664 - protein, 254 aa, Unknown
  Kingdom: Fungi, Phylum: Ascomycota
MSSETPVLDPGIFTFLKESLEEETQVRDTLTQIVQRLDRAVAVAQGHLSRVHSTPRAKYPALVQALEVAIGDEVLIVKELSEVASKHPYYKYNQKWTRSVQAAIGTVLYCGWLGGLPGSDATQPAELGRLLTLEEVGAIFKVPTNLKTQDAFHFTIEEYLLSLPDLTSDLSRLATNSVTLGDFALPLIISSFVKDLFAGFQLLNLKNDILRKRADAVKYDVKRVEDVVYDLSLRGLVKRPGEGGEGDTEMPSAA

SEQ ID NO: 665 - protein, 251 aa, Unknown
  Kingdom: Fungi, Phylum: Ascomycota
MASSTRQFLREYKLVVVGGGGVGKSCLTIQLIQSHFVDEYDPTIEGSSCSMSALRARSRPGLRALAKTYWHALTLDLPTDSYRKQCVIDDEVALLDVLDTAGQEEYSAMREQYMRTGEGFLLVYSINSRQSFEEITTFQQQILRVKDKDYFPMVVVGNKCDLENEREVTRQEGEALARSFGCKFIETSAKSRINVDKAFYDIVREIRRFNREMQGYSTGSGGAAGANGAPKPMDMDDGEKEAGCCSKCVIM

SEQ ID NO: 666 - protein, 533 aa, Unknown
  Kingdom: Fungi, Phylum: Ascomycota
MRGALALSAAAVVQAASFSIETVHNSAAPVLSSVEADTIPDSYIVKFKDHVDDASVSDHHTWIQNIHNEGEEQRLELRKRGELSDVAELFSGMKHTFSIGDAFKGYAGHFHESVIEQLRHHPDVEYIERDTVVHTMLPIEGESKVTEDKCDGETEKQAPWGLARISHRDTLNFGTFNKYLYTAEGGEGVDAYVIDTGTNIEHVDFEGRAKWGKTIPAGDADEDGNGHGTHCSGTVAGKKYGVAKKAHVYAVKVLRSNGSGSMSDVVKGVEYAATSHLENVKAAKNGKRKGFKGSVANMSLGGGKTQALDAAVNAAVRSGVHFAVAAGNDNADACKYSPAAASEPVTVGASALDDSRAYFSNYGKCTDIFAPGLSIQSTWIGSKYAINTISGTSMASPHICGLLAYYLSLQPAEDSEYSLAPITPKKLKENLIAVSTEGTLTGIPDADTPNLLAWNGGGCSNYSEILAAGGYKANRAPSTFEKVESAVEEKVDAISGEIVHGAKAFSGKAEKLANKIHHLVEEEIEQFLKEVHA

SEQ ID NO: 667 - protein, 254 aa, Unknown
  Kingdom: Fungi, Phylum: Ascomycota
MDATLTEADPELLKVPLHRPSIMHHLPIFSILALGSAVSAYDLPDNVRALYEQHQAGSCSDPLSDAFSGGAQYCGDIPGAIFLKGNGNYDNMDIDCDGANNQAGACANDPTGQGETAFKDTVSGYGISDLDANLHPYVVFGNEGDTPSFDPQQHGMQPLSVMAVVCNGQLFYGIWGDTNGGTSTGEASISLADLCFPDEGLNGDTGHDGKDVLYIGFSGDDAVPGQDGAAWDATSRDEFSSSIKDLGDMLVSNL

SEQ ID NO: 668 - protein, 949 aa, Unknown
  Kingdom: Fungi, Phylum: Ascomycota
MDEKSGLPPYSAHTHCEPNDQPRHFFRRGRIARRSRAVKVFALACLSFIVLAQWGQLWHAQSSAPVLSQQKLHENLQTCKKLRHKPEDPVGAGREKNARYLDGKPTLVKNATIWIGEPVKGTTAEEARAGKGWEWTKGDVFLQYGLIQKVAADISVNSVPDNTIIYEAHGRPLTAGIIDMHSHVGVYPLPELWGSSDGNEMSDNITPWARAIDAILPFDSQFQVIKSGGVTTSLVLPGSGNNMGGEAYLVKHAIGKAEGRKEISARDLLADPEQNWRYMKMACGENAKRVHRQQAYSRMGESYAFRHAFEQAAELVRKQDDWCDKAESVGVESMTDYLPQEIAWESLSAALRGQVHINTHCYTVPDLEAMVDHTNEFKFPVRAFHHAHQTFLVPEILKRTWGGRPPSSAIFADNMYYKTESYIGSEHAGKYLYDEGLTPIYVSDNPVLNAQHVLFEAAKGYKYGLPYHAALASVTTAPADDLGMGQRLGKVKPGFDADVVVWDSDPLSVGASPVQVWIDGTAQFEEPVELQKPYSEPIVPDESLGHIVEEPTEMTDVFFTGITKILLRNETAYDVPKEGETFNVAVSQGQVTCIGSCKSELEAATAAGIQSVHLKNGYLTRAFVGVAGTLGLSEIDAEVSTNNGENFDTFSRAIDGLALEGKKLRAGYQYGATRAISAPVFNGGGTHYGTSVGFVTTAHTSLEEGAVFESDVALHYTLDQSVLSGLSYSAAFGGLRTKLLSAASSKDPIADPFSEYAYLRKVLEGKMVLALTINSADGIATALRIKSEVDKHSRSINSDAPALRLAILGGAEAHILAKEIADAGVGVIVAPSQSIGNTWDARRTLTGAPLTNGTTLDQLLSAGVTAAIGLKEDWMVRDLGLQAGVAYHNGEGRVSEAEALDLVSTNVYKILGGEVKEDTHFVVHEGSPLDIGSRVKAVASGNGKVSVFV

SEQ ID NO: 669 - protein, 1323 aa, Unknown
  Kingdom: Fungi, Phylum: Ascomycota
MASAVESSSNSLNPKAQGASTGGIPADGTGVVKLDPYLEPFSDALRRRYAKAQSWIKSINETEGGVEKFSRGTEKFGFNVDDKNSIVYREWAPNATAAFLIGDFNNWDRTSHPMKKDDFGVFEIHIPAQNGQPAIPHNSKIKISLDLPTGERADRIPAWIKYVTQDLSVSPAYEARFWNPPAAEKYQFQHQRPKKPASARVYEAHVGISSPEQRVATYKEFTKNMLPRIKELGYNVIQLMAIMEHAYYASFGYQVNSFFAASSRYGPPEDLKELIDTAHSMGLVVLLDVVHSHASKNVLDGLNEFDGTDHQYFHSGGKGRHDQWDSRLFNYGHHEVLRFLLSNLRFWMDEYRFDGFRFDGVTSMLYTHHGMGTGFSGGYHEYFGADVDEEAVVYLMLANEMLHSLYPHSISIAEDVSGMPALCLPLSLGGVGFDYRLAMAIPDMWIKILKELKDEQWDIGNICFTLTNRRHGEKTIAYCESHDQALVGDKTLMMHLCDAEMYTNMSVLSPLTPVIDRGMALHKMIRLLTHSLGGEGYLNFEGNEFGHPEWLDFPREGNNNSFWYARRQLNLTDDHLLRYQFLNHFDALMNNCEAKYGWLHSPQAFISLKHEGDKVIVFERAGLVFVFNFHPTESFSDYRIGIEVPGTYRIVLNSDSKEVGGFNRLDENTRFFTTPMEWNGRKNWTHIYIPCRTALPQARHPRLCWARVHRAATNLPPGVDREKTEEKWGASGTKPGMSGTSTSSWLGWPGMLGVSNLRLAHHVTGEKALTDEVVRSRAKLLTLQILPCLNQPLSTPISDRSLSSGKMFKSGISSFARAARPSFAAAATRRAIKPASLRFPLNSRFASTASVGDGKIHQVIGAVVDVKFDSAKLPAILNSLETENNGQKLVLEVAQHLGENVVRCIAMDGTEGLVRGAMAKDTGAPITIPVGPATLGRIMNVTGDPIDERGPIKTDKFLPIHAEPPTFTDQSTSAEILVTGIKVVDLLAPYARGGKIGLFGGAGVGKTVFIQELINNIAKAHGGYSVFTGVGERTREGNDLYHEMQETSVIQLEGESKVALVFGQMNEPPGARARVALTGLTVAEYFRDQEGQDVLLFIDNIFRFTQAGSEVSALLGRIPSAVGYQPTLAVDMGGMQERITTTKKGSITSVQAVYVPADDLTDPAPATTFAHLDATTVLSRGISELGIYPAVDPLDSTSRMLDPRIVGQEHYDTATRVQQILQEYKGLQDIIAILGMDELSEADKLTVERARKIQRFLSQPFTVAQVFTGIEGKLVDLKDTIASFKAILAGEGDSLPEGAFYMVGDLASAKEKGEKILAELEKN

SEQ ID NO: 670 - protein, 649 aa, Unknown
  Kingdom: Fungi, Phylum: Ascomycota
MIQVSAPTDGIAQLVHAQLHSGPFHLTWLPDLIPRDPSSLALAPRAIQNAPNGYVPESVRCPSDRPTIRHGGTLSQQEKDWTLRRRNETIPHIRDLLQRIAIPDFDSAAYLKDVETNSTALPNIGLAVSGGGYRALLNGAGAFAAWDSRSAASTAKGNLGGLLQSATYLSGLSGGGWLVGSIYVNNFTTIQDSLNSAVIWQFQHSILEGPEQYSLRQYYGNIFDNVGDKVDAGYERSITDYWGRMLSYQLFNASEGGPGLTFSSIAEDNDFASGKAPLPFLVSVGRVPGEKVIALNSTVFEFTPWELGSSDPTLHGFAPLKYVGSNFTNGTIPEDGKCVEGFDNAGFVLGTSSSLFNVISQYLTNDKSQYVPSDVPSFAVDAVVGVLNALGKDNDDIADWTPNPFKEWNTGENLSDGDRLTLVDGGEDLQNVPYHPHIFNERKVDVVFSIDSSADTEYGWPNGASAVATYQRSLENISAGTSFPVVPGQQTFINLGLNTRPTFFGCNASNTSEPSPLIVYIPNYPYVFNSNTSTFQMTTNESERDAMVENGWAVATQLNATRDTDWPVCVGCAMLARSFDRTNTTVPEKCKECFESYCWNGTLAEEDNGQYDPKLFSEAIDVQDAAGTLVARGAVSVLMAVGVGALLAL

SEQ ID NO: 671 - protein, 261 aa, Unknown
  Kingdom: Fungi, Phylum: Ascomycota
MGKGLKKHQKRLSAPSHWLLDKLSGTYAPKASPGPHKLRDCMPLIVFIRNRLKYALNYRETKSILMQRLIKVDGKVRTDMTYPTGFMDVITIEKTGENFRLVYDTKGRFTVHRIQTEEAEYKLGKVKRVQLGRGGIPFLVTHDARTIRYPDPLIKVNDTVKIDLATGKITDFIKFDTGAVAMVTGGRNMGRVGVITHRERHDGGFNIVHIKDAIDNSFATRESNVFVIGQDKPWISLPKGKGVKLTISEERDRRRAYAIAN

SEQ ID NO: 672 - protein, 866 aa, Unknown
  Kingdom: Fungi, Phylum: Ascomycota
MMAALRPFGFVLASQVISIASCSPQIYFPLNSQLPPAARLDQLFSYVFSQYTFRSDTSSNLTYSLGDHPAWISLDGDERRLYGIPEDKDVPPGEVVGQTVEIVATDNTGSTTMNSTLVVSRRKGPTVEIPLSQQIEGFGNFSAPSSLLSYPSTKFAYTFNKDTFSSPNGVNYYATSGDSSPLPAWIFFDAKTLTFSGTTPPFETLVQPPQNFSFQLVASDIVGFSAEAIPFSIVVGSHKLTTDSPIISLNATRGSKFTYDQIGNSIRLDNAKVTSQDLKATVTGMPQWMSFDENSWTLSGTPGKDDRSTNFTVSFSDPFADTLDILAMVNIATGLFTSTLEDIEAEPGEEIDLDLESHLRNPEDVEIEVTTSPEQDWLKVNGLTVSGRVPKTAKGDLEITIKAQSKSSDLSETEGLKVSFLALDKTATATGTATKTDTATTSTSVAEATNTATDNDEAKGSGHVPTRTILLATLIPILAIGLILLALACFLRRRRRNRETYLNSTYRHNISKPVLETLVINGSDPSSAAKMEKMGQNGAFVTTTTLYDPKKAVGPRPARSASMLSGSSGTVDVNPHLMMAAGAAMPPSVTTLSNPSTPGEESSSRRSWITVEDGRGETSGLMTRQSVATVPDSVDNQLRYASDKTFRSGLDVAIPSLDDLSLLPDVMSPMGESSRHQHPRNFDALSMASSDVFPSSTISSPFNLGTVLKRGLSVNAPIPYYNENRPSTAPADAEDPSRDSVSELKSPSAALTRGSSLMRRASGLGNRSSTHTGSFLTETSFGSSENWRVVSNGRYGVNEMPPPIPGSPSYHDIVQNAPFNPSRPGTSRGEAGRAAGPSASGGAGPGWKRDDSVLTGGSKGSYTVFL

SEQ ID NO: 673 - protein, 401 aa, Unknown
  Kingdom: Fungi, Phylum: Ascomycota
MLIMSLKLLQLTATAVALASSVHGHLIQKGQGSAFSVDAITPDDPTQFDPAAEMQRLWAKFPTTGDVNAHQARTVKQHGSVKVNPSSNGLSYFVPTVIGNQTFNLIFDTGSADLWVYSNESSPYQSLDHPTYVPTSSAEFLPNYNWSIKYAFGQSVSGVVFRDTVKAGPLTAHKQAVQAATVIPFEFASDGILGLAFSAINTVQPVKQKTLFETLMPTLKKKLFAANFRGDGKPSTWDFGYIDRSKFKGDITYAPVVGGQKYWSVDVGSYAVGSGSFTGSNETVGQVIIDSGTSLVYLPTQVVKDYYSHIEGYVEQEGGSYTYPCNSTIPDFRFEVADTVLSIPGSTVNLTVYDSAKGLCAGAINTQLNMKYSVLGNIFMKNYYIIHSREESTPKVGFASH

SEQ ID NO: 674 - protein, 589 aa, Unknown
  Kingdom: Fungi, Phylum: Ascomycota
MNRLSKTVPKRKDDRIILQFDYDCFYAQVYENKNPSLKSLPLGIRQKNILATCNYHARRRGVRKLMLVSEARHICPDLVIVLGEDLTPFRDVSKTLFGFLRSFSWNGKAEKLGFDEVFMDVTDIIDYNLSCLNLSAMEEHFFQLSRSDPMIGFRCNLTAVAGCTIGSKTKPENNLDKPLYLPLLLASHLAFYLRQRLEEDFGYTSTCGISTNKVLSKLSGSKNKPRNQTTLMALGEDDAASFVGEHLLRQIPGLGHKTAQTLENHVKAQKSDLDSDTFESTVTAKQARDHPDVSPALIEELLAGPGSEKGIGARIWALLHGVDNTEVKEASDIPSQISIEDTYKGLESFAEITRELHKLAFSLIRRLRVDLLASELEANIQSGDEAQKWMARPKTLRLTIRSWPAAGKSENLNYNSRISRSGPLPNFVFDLKTDTESIGDRLVVEALLPLLRRLQTEKGQKWNLQLINICVANMVVGAAEDKSGAGRDIANMFRTQDEVLRPWRVETDGASGAEPSENVSGSVEEETDNAEPWPADENPTCEKCGHPVPSFAWPAHIRFHDLEDVDGAGQVSASVGTAGMALSKQPNRT

SEQ ID NO: 675 - protein, 321 aa, Unknown
  Kingdom: Fungi, Phylum: Ascomycota
MSHQRYASHDPVKEPHSISLKVLRLSRPSLVTQHPIASPLSPSNSHEPPFPASLAYEPSAADTNPSPFLLSPVLNFPVSFGSAYVGETFSCTLCANNDLPIQEPDATSAKKIRDVRIEAEMKTPGTGAVQKLEMGGAGATDGGQDLEPGQTLQGVVKFDLKEEGNHVLAVTVSYYEATETSGRTRTFRKLYQFICKSSLIVRTKVSPLPRSTTAGASGPRSWVLEAQLENCSEVAMQLEKVAMDVEDGLQYRDCNWDGEKPVLHPGEVEQVCFVVHEESKGSLKATADGKLVFGILGIGWRGEMGSRGYLSTGKLGTRAAR

SEQ ID NO: 676 - protein, 343 aa, Unknown
  Kingdom: Fungi, Phylum: Ascomycota
MSATNTNSWLRAQRKSDLVEIADDVGLKNYESYKKSELEAALDEYLAGNSAKFSSRSSLTGYFNSRSKALGSPIKKELNAAKDEGEKALKVVKRKVSKAIEEATPDADTSTSTAIVRTPGRSLSQVAARIPLPATPADVANAVDRSTLALRQRATSIYQDSGISDVTQATRDSLSTVTSVLAVVSAWELFCIRYKILPSRYAFTIPAIGFLGLSDYPVNLPDAFLLVTTAFWSPFLTWALTSLVIPGIAGYFFNLSASNNQGPRTRAKAAAQAAEYNVDPLTFSIVKALVSYVVYGQLVTLGGLLSESSILHLRGAVYGGVPGILTGTAITAVMSIYDAVLKK

SEQ ID NO: 677 - protein, 600 aa, Unknown
  Kingdom: Fungi, Phylum: Ascomycota
MPVIAGLLSPRANTTTTTTTNDDDNLNLLGWVDDPNGRGTIGLVWSCLLTLALCVWSALHLNIPPKHDTTWRHWNRVLRWVLLGILAPELVLWAAWRQWQSAKLLTVRVQEILKEQEEQQQGQDDGQDPDRKSRPRSTGKPMRKYEWSLLHSFYACMGGLVIDMADSTEDGIDHIPRYRRVTLSAHATILLARCGHLPDIDPDYIKDKSKADSLAKVIVLLQATWFLIQAIARLVVHLPVSLLEVNTIGHVLCALVIYLLWWHKPREVREPTVLQGDWIKPLCAFMFMSSRMSGVQYVSVIRRHPSAWVFPELENLTYVAPSLRDRSSPPTSEAATVSEKAVDDITEQPRPRATVAAVDQLTRTEPPEPMNHGTDSDWGGFRSEIRRQDTEHTLARKRKLGWERGDTVAELRAKRLDRHTLCARAFQTYPAVREYFTRKTPDSAEYVPRLEQFLIPIATNWPGDYLLEPNSKSIVGIVLWFVSIMYGSVHLAAWKEFFPTEAERLLWHMSAGYIAASGVWWCVAHVLFYVWPWLADWWGRFVHLKNHWLQYIVYGFLMGCAGTLYILTRAYLTIEGLVSLRSVPSSMYETVEWEDYIPHL

SEQ ID NO: 678 - protein, 374 aa, Unknown
  Kingdom: Fungi, Phylum: Ascomycota
MTMTLDSAHQQRFGPQMNFDYSAASQPPAFSNPWSSSSPSQPPVTSSSALMMASHSGSAAQQHSHHSQHPQSSALSANMLAAKAQPQPARPASTAASSSMTPYGSMPVGPASSDLMNLNRMQTSSAGYHDTTYASSASPVGAQFAPSSAPSYEALGYAPAPVRSTAYAMEADPTRRFSQSSIQDERKGFADALDASHGMLAMSQETPRNIYGGGARSDRSSVDSYGFPSTHSTSSSISSSTFSSYYGGGDSVSDYSTAGSDYESVNSRTLPRPQGLMGGAAQIPPAPQTMMGQFSSKVSSSTQKKHKCKVCDKRFTRPSSLQTHMYSHTGEKPFACEVEGCGRHFSVVSNLRRHRKVHRGDAVSEVGSEDHQSD

SEQ ID NO: 679 - protein, 287 aa, Unknown
  Kingdom: Fungi, Phylum: Ascomycota
  misc_feature (9)..(15): Xaa can be any naturally occurring amino acid
MALYNPPSXXXXXXXPPPSPPPPPPIKRSYIPFNLHPANELNAQKVAPAGNQPTGQAEQFTLSKLSISDLDRTSPIRQFHAWFSQAQQSQAVPHPEACSLSTAELPSGRVSSRMVYLKELEAEKPAAEEKSSGSSQPGFVIYTNTGHSRKAADLATNPYASLLFFWEPLQRQVRVEGPVTKLTREESQVYFDTRVRGSRIGAWASRQSHVLQPQGDGDDGREQLVGWVKEAEEKFEGEEMIPVPEFWGGLRIVPERVEFWQGRESRLHDRFVYEKEGEGWTLNRLSP

SEQ ID NO: 680 - protein, 1236 aa, Unknown
  Kingdom: Fungi, Phylum: Ascomycota
MGGKSSKPAPPNVPDKDRRVQHLREGLHTQQPPYRVASSPGLARTGTINNRRSLAVEIDPNGPGALILYDGTRDNRGLTTSNTSATNTTETSLASSSSGGKEKGIDIVLVHGAGGGRIKTWSTDDGICWPRDLLPRDLPPNTRVVTWGWKAPDPVPSGSEDSTDYDHLSNMVSDQLSIDLARIDGGAERDLIFIAHGVGGLVVKNALTTTAVSQVFGKRSELGSIYPRTVGAIFLGTPHKGHGRQTLGELAVLTARLDSVNGRGDLDEMFLQMMGEANELLETQRGEFALVSRDLPVICVREQLSTNARGAEILPKACATFDGINVTTDDFFQDHAGLARYNDRHDSGYFQLVGHISKLTKRTHFQDTEAGMIRTKEIIDALHYDMREQENKANEDLKQTSAWILSAKDNGGSGAGDNVPGAFDHWLQDPSTPIFWISGNPGSGKTTLMRHAFHDPGTRDLLQRWAESGVDASTKRRDKPQLLMAAIFLFEAGSYVQKSREGILRGVLYQILTQKPELVPVCFPSFMEGPWPPAVPFNTTVNLSQAFYQLFARMSKTLRLCMFIDGLDEYRLAEGTQAQQDDPSQRDRHSNGHDENGHRGSRHTCDSVDAMTNDTSTLAVSSEHGETDHPSEFTSVSDRGEILGNSQWISDSHTEIARLIMDLANQDHVKLCVASRELPPFERAFVGVPRLRVHTQTEKLISQYCADRLDKVAPGLSGSQRPLCDEVARKSKGDILWARLAIDMLMEGSLRRLMQTLESLPSQLGGPNGLYMRIIQSMSPQEQLEAARIFHIILRAVDPPNLVTLAFAFEGYIAPPKLQLADPTVGNLLIDHDRAHPYTREDLSRISDQMEARLTTSCGDLLETTDKGARVVFMHLTAKEFVLRSSVWRQAQLSVPSAVDVDVSLMSGTIRYLKCYSTLRLVVTSRPRLQFTPDAWLLVSHVLRYAARVDERLINGTTEECSREVYVALLDDLDKTFQEAWQTAIKEHVPARDDVSWYRDKYRPLLASHWTDFEPMELGRSPRRQGFLSLALQANLYGYVSYKISQIPDENERATIAMDLLEYAVAPEGDSRTSDGGQSLSAAGAVTGTYKDFHHDMPDGRFAPLLIDTVNECETKGIDLTAQQRFVWTQALKAGKPFFQQRGGRGAVLNLTPESKTTLARNRGRWVAAIKALLSTGWADPHMQIQDTSNDRMGGEMKSASDMIKETLEGEVEFARELVMIEALIVNVSIRSPRIM

SEQ ID NO: 681 - protein, 507 aa, Unknown
  Kingdom: Fungi, Phylum: Ascomycota
MAPHADLAKDITFIKTPPAQPSAFDVEDCGVPTTNYASINNAPLPAEGPGYLSFNNYVLLGLLTVVPWFVGRTIGGGWKTKLFLFFVFLVPVLVAYWTFTSHMSPRIDDKARLPGRPIETYITFKTEELKRKYSGRTKVALQDFSDMYINGDADFNGDCLDILEYRHDWGHFALTWSFMKFIFGTFARDVLMHSREQDMDQIRPNYDNGNDHYAWFLGPRMIYTSGVISDPTREETLEELQDNKMAVVCEKLQLKEGETMLDIGCGWGTLAKFASLNYGAKVTGVTIAEKGAAYATDALRSAGIPEEQSKILCMDYRDIPKQKFNKISQLEMGEHVGVKKLTGFFRQCYDMLEDDGAMYVQLSGLRQAWQYEDFIWGIYLNKWIFRGADASTPLWNYIRSLERAGFEVKSVDTVGVHYSATLWRWYRNWLGNKDAITAKYGQRWYRIWELFLAWSVIASRQGSATCFQMMVVKNLNATHRLDGHASQFGLTGALAAAKAAGKASLPN

SEQ ID NO: 682 - protein, 495 aa, Unknown
  Kingdom: Fungi, Phylum: Ascomycota
MSAEDEKPHVTQGPSEFFDSIGNKVQNLSPAQNGDATTDGDDEPRLVEEIESLCMNCRENGMTRLLLTSIPYFREVVIMSFACEHCGTHNNEIQPASTVQPRGTHYELRPTTLQDLNRQVIKSDTATVKFIELDLEIPAGRGQLTNVEGLLSTVLEDLEMGQEQRKEDAPEVYTKIAEIIAKGRAMLAGDAFPFRFYVDDPAGNSFIAPDLKDGVGKWEKREYPRTPEQNAALGLAASDPSAANDENGPVSIPGLTADGEIIPNEVYSFPASCPGCAHPCTTHMKMVDIPHFKQVVLMSTVCHDCGYRSNDVKTGGEIPEKGEKIILKVDDSTDLARDILKSETCAMECPELQLQVNPGTLGGRFTTVEGLLTNVRNDLHSQIFEDTSSSGGDSLQASDKTQWSNFFATLDAAIAGEKPFHVILTDPFASSFVQPLVDPPAPDPKIQREQYERTEEEEEELGLKDMKTEGYEADEKEEEEEGQGKAEEKQVNGDS

SEQ ID NO: 683 - protein, 862 aa, Unknown
  Kingdom: Fungi, Phylum: Ascomycota
MDSANTVEYKLRDLPTRSVTLFPTRAQIYREIKDVSLKPGDNKITVIGLSPTVDKDSIKVEGSGLAVITDISVTQEQNHEIFEEIYPEHDTSVTSQDFPPLSSEEVYENDLKNLQELPELKEAKTRYAALEEDIKTAEEAIANATERLRVLDSFSKNLGRREDPVDIAKFISTYQTEREKMFKDQQEAERKKRQLNDELTEAGIKMNMYNARQTHQRDMVEWEKSRERAKKDKLEERERRRKMQDLQKQAKKRKDLLEFWPKYVYNVCITLDANQYTPMSSRRNSVTSEIELAKASPTHTADDEGSAIHCDLLLSYVTSSAFWAPSYDMQLNTTSATGTLLFDAQLHNSTSETWSNCHVTLSTSQATATSIEEPIPTLVPWHIRLVGKSQYAKDSSDDISLSKEEQKRKTQLLHQNNPITSTYNRSEMFNGDSSSNHALQDYQMQLMLLEQQNKKRLTMARKDAEGQNSQGAPVNQMRQPSQMAQPNQMAQQRMAQQQAAQQQAALLAASSFARKTTFNSNNFDSAAPKPSSGGLFGSNGGGGALFGSRAAPATAPDAIPPPPPPAPCVAPASAAAMNSDPLSNFDFDTFLGTGGTDNADALSLTNTVSEPLPALDFKDSLIEETGLTTAYDLPGTKTLAPGATSSKHRVARLSLSSIAFSYTIVPKYKPVAYLKAKIRNGSKLTLLRGTLGLTLDGGFMGRTTLPRCSAGETLTLGLGIDPAVKVRYPGPDVRRATTGLFSKEDSSIYSRSITLENTRSSTGSKPCHIFVHDQVPVSEDERLKVVLQVPRNLAVNGGSVKAGKEGAAGDQGKAWGEADAIMKDTGTVTWNVKLNPGKAVKLDLEYVIAMPSGGGHTAVSLA

SEQ ID NO: 684 - protein, 298 aa, Unknown
  Kingdom: Fungi, Phylum: Ascomycota
MWAPVTVRSVSLQIIFQPTAPTSVSSAVRDSMVWPLGSSDDGKSSRPQSRPAQQPERQPISWSESFANAAYDPLGAAKEWAPVVGCSLVGLGAIQLYANYLRRIPGAAYVRPGFFRNRSIFGKVTSVGDGDGFHMFHTPGGRAVGWGWLRKVPDKRKDLKDRTISIRIAGIDAPECSHFGRPAQPFSAEALDWLSSYILNRNVRTYVYKRDQFDRIVGTVYVRKWLIRRNVGLEMIKRGLATVYEAKSGAEFGGLKDVYIKAEAKAKRKKKGMWGGKKSEFESPREYKTRMNGAEKAG

SEQ ID NO: 685 - protein, 1009 aa, Unknown
  Kingdom: Fungi, Phylum: Ascomycota
MSVLISASGVYSLKEDELDFTRSKLEDQQSACFRDSSSSHPKRWYHSASIKQSVQNNIKQKKAIICGAGEPRYKFTTDSESDTEERDEIASLRIFGLEEVSQESSISQQVPSGAMAGPVIPFFVQQGTRLRKISKKSRSKRISLAYEPETFTLVWDKSRPNKSIHVDEIREIRAGSDVQQYAIDFNIPESERHGWFSIIYSDPIKRKTKLMHLIADNMSTSAAWISFLEGMLKYRQDMMTSLMSFKPEAVAEYWQRETLKQSVGSRASEEAGELDLSSIKRVCSNLHIYSSQSALEDSFDVCDVRRKAKLNFEEFLAFVRRLNQRRDVQRIVRGVAASPEVGLTFSEFLKFLGEFQKEDISDVRSWEAVYRTHAGISSNVDLDESVFMTETSFVSFLSSARNGPLEDAPREYKLQHPVSDYFISSSHNTYLLGRQYLGESSVEGYIAALGGGCRCVEVDCWDGSDGQPIVVHGRTLTTSISFSEVMRCINKYAFVCSQEALWISLEVHCNPTQQAIMANTIRETFGSRLVTEALPGHEDTLPSPEELKGRVLIKVKKPREDVPISEPTGRRRGNSLNSMNSPLSRPSMSDTSSFLAPSQSLPQSPLLSPSQVSRRLVSKSRVNTIAEGEVPDIASISTSTSDNESGSEVGSSRRSANKTVPILGQLGVYCAGLKFRGFDHPDAKSFNHIFSFMETSFARHSQSKEKKMALEIHNMRHLMRVYPDGLRLGSTNFDPIAYWRRGVQMAAVNWQTFDLGMQLNRAMFQGGVDQSGYVLKPPELRGIQVGPYNHDVAVRGKKERSVVAFSIDVLSAQQLMRPANLPANKSMDPYIEVEVFHANDKRGKKDASNSNTHQLDSPLKFQTEVIRENGFNPTFIDGHFNFRVTTQYPELVFVRWSVKLSNDGESYNSKDRSSVATFTAKLCNLKEGYRTLPLLNHTGEQYLFSRLFCKITKQPIVKTLVDVPIATAESGKLNRLGKALGRINTSPRTTLERSFASEKTSMEKSSFES

SEQ ID NO: 686 - protein, 712 aa, Unknown
  Kingdom: Fungi, Phylum: Ascomycota
MEVVTVAAASLPSIPLDFLGNRDRILESIRIAKEKGATLRTGPELEIPGYGCLDHHLESDTELHSWEVLAEIISDPICKGMLVDLGMGVRHKNVQYNSRVLCTYRKVLGIRAKQSLANDGLYRETRHFTAWTKERQIEDCKLHAVIREVTGQSTAPIGDMIFETHDTSIAHETCEEMFVPRHPSIFTGLDGAEIFLNSSASHAQLRKLKERLDLITNSSKRMGGSCYVYSNCIGLDGDARVLFDGSSLICCNGAVVAQSSQFSLLKVEVITATIDLGRVRTNRSSSRGVQAAAQAAYPRVHCDITLSQSSSDLFLAGGTVSHEIEIQLLDPMEEIHLSTAVYLWNYLTRTMSGGFFLALSGGLDSSSVALMVYGMCKLVLKSIQNGEESTLSDLRAVVGIKDFMPKTAEEIVSKILFSAYMGTVNSGAETRSRAKRLAAQIGSNHMDTNIDKAVNAQIEILSDALDGFQPQYTVHGGSTSENIALQNIQARSRMVFSYALSQIITTAKGMPRAGASLLVLASTNVDEHLRGYLTKYDASSADLAPLGSISKADAARFQRWARDTWDMPIMNEFLEATPTAELLPLSAGVQSDEEEMGLRYDQLSEFGILRSIHRAGPWSAYLRLLPEWKARFGMGPREVAEKVFTFFRFYAINRHKATIITSAVHLSGYSPDDNRFDLRPYLYVVSWPWQFNKIRAHVEQMEKSLKERDNVD

SEQ ID NO: 687 - protein, 253 aa, Unknown
  Kingdom: Fungi, Phylum: Ascomycota
MTSTASTATPAKHAFEKRVDEVKSPKSDINALILDYLTMEGYPNAAAKFSKEANLQPQQDSASIRARQEIQASIHSGDIQAAIETLNELDPQILDDDKALHFSLLRLQLVELIRSCNASGGDIGPALKFATEQLGPRAPTNPRFLEDLERTMALLLFPQDNLEPQLASLLNPDLRRDAADSVNRAILERQSARREAAIRHLVKMRAWAENTARDRGSSLPESLDIGLRGDDPDSSQTRRLLNAENGHEPMVTN

SEQ ID NO: 688 - protein, 2560 aa, Unknown
  Kingdom: Fungi, Phylum: Ascomycota
  misc_feature (2452)..(2452): Xaa can be any naturally occurring amino acid
MGKKKVLVCYGVDIDAVAGWLGSYGGEDSTSDISRGLWAGTIGTRRLLKLFEKYNIKASWFIPGHSLETFPEECAMVRDAGHEIGLHGYSHENPVDMTLEQQRDVLHKTWKMLTEFCGKPPRGSVAPWWETSEEGTELMLSYGIEYDHSMSHHDCQAYWLRTGDSWTKIDYSKKAEEWMKPLVKGQETGLVEIPGSWYIDDLPPMMFIKNSPNSHGWVNPRDIEDIWRDHFDYFYREYDEFIFPMTIHPDVSGRPHVLLMHERIIEHINKHEGVEWVTMAEMADHFKSKNPPPPGAKMPASREEVMKKFASEPAALILHPTLDRRETPAVLTRNPLMNKQSTSNMSHGVTTTVQQNAATYRSCNRGCSTMMMAAAQDRLAYNSRIESMRRDEYPMLKDQVYLDHAGMTLPSRRLVDNFAKSMTSNIISNPHSAYAHSQRSTPCIEDIRSKALQLFDADPEHFDLIFVANATAGVKLVAEVLRAVPGGFDYLYHQSSHTSLVGLRQEAGQSVCIDDAATAEWLAGGSMFSTKATSPQLLMFSFPAQSNLDGSRLPLDWIRQSRSRDTSQTCLTLLDAAAYVSSSALSLSVPEDAPDFTVFSFYKMFGFPDLGGLIVRRESTSKLLLNRKYFGGGTVEAVTCDQEEAWHVRSSRSLHEALEDGTLPVHSICALGIAMKTHVQLFGSMAEVSLHTSYLADRLHSELRTLRHENGTPLCVLYSWKSGTTHGPIVAFNLLTDTGAWVSPSKFQELAILKGFHIRTGGVCNPGGIAAALELNAADVKDNFAQGYRCGGENDMFRGRPVGVIRVSFGAMSTLSDVARFSSFVQEFYITRSGAQRTWPWDVRGSGRILSEKTRTSVYAVKSIVVFPIKSCQGFAVPQEASWAITAKGLAWDREWCLLNRATNRVMNQKRYPRMALLQPHIDIADNTLTICYRSGSGTASDAQDRSISVPLCSGELSSAEERQIDPSPSQVTGVDGLVHRYNSETVNAFFSTVLETPCALARISHPCNKTRTSSSAIMPGTFPIGDDEATLQTRGSLSNESPILAINMSSVNHLNRQIQLAGGEPVPVEAFRANIILDLTARPAPGSAVEAPYSEDGWSQLRLAGLRLNVLGPCQRCHMASNMIATKAPEALPSPPLSDGGNSTHSAVPADLSPLIESTYRSCELRFHVNGKLTIVKNPNPEWVLLDWIRAQDGLKGTKLGCGEGGCGACTVVLQTGLANGRVRHDAVNACLFPLIGVDGKALITIEGLGNVSKPHPLQERVAKMHGSQCGFCTPGIIMSLYALIRNSYYDGQFHLTNSDVELRGHLDGNLCRCTGYKPILEAARTFVLEDLKGTIKDTPMHTEDSKESVETDMTDASHIAGQAKSQGSCGRLGGCCRDGPNAGACSSAAASSEAKLHSSNPEAQPAFVPYQPDSEPIFPPALRKHEVQPLCYGNRQKLWFRPVNLQQLLDLKSTYPAAKIVGGASETQIEVRFKKRDYRVSIYAADVAELRHYEPPQTEEAVDNLREVRIPANYPLTDVEELCTNLYKRSGPRGSVLEALRKQLRYFAGRQIRNVASLAGSLATASPISDSAPVLMAAGASVVVQSLHSGTMQLPLSRWFLGYRTTALPEDGVITEIVVPLPSKDDTEIMKAYKQAKRKDDDIAIVTSGMRVRLDKSGVVADVSLAFGGLAATTVFAEHAQRAILGRVWKEVDTLEAALDALLKDFNLPRGVPGGMAHYRRTLSLSMFFRFWHEASHELGLASFDKDLIEEIHRDISSGSHTHTPRLGTKAVGKALPHLSALKHCTGEAEYLDDMPKQHNELFGALVMSTMAHAEIISVDWERALEMPGVVSYVDKDSVPTNCNTWGPVKKDEALFADGKVTYHGQVIGMICAKSALEARAAADQVKVEYKPLPAILTISQAIQAKSFFDHGKELRKGEAIQGSLEDAFGKCEHVFSGVTKMGGQEHFYLETQAAFAIPHIEDGSMDVYASTQNLMENQVFVAQVLGVSMSKINMRVRRMGGAYGGKESRSTPFACMVALAAQKTKKPVRIMLNRDEDIAISGQRHLFQCHWKVGVDVEGRIQCLEADVYNNAGYSLDMSGAVMDRACTHLDNCYHIPNAWIRGWVCRTNTVSNTAYRGFGGPQGMYFMETMMCHIAEKLNLDVDELRLRNLYQIGQRTPFLQLITDDFHVSTMMEQLSTSADFEKRKAQVADFNARNRFRKRGIVRIPTKFGLSFATAVCLNQAGAYVKIYEDGSVLLHHGGTEMGQGLYTKMCQVAAEELGVSTDQIYNKESQTDQIANPSPTGASSGSDLNGMAVKNACDQLNERLAPYREKLGPDASLKEIAHAAYADRVNLAANGFWKMPRIGYTWGNWKDPLPMYYYWTQGVAITEVELDVLTGDHTVLRTDLMMDIGRSINPAIDYGQIEGAFVQGQGLFTMEESLWTGKGEIFTKGPGTYKIPGRLLLTHLXFSDIPQVFNVSMLERDSSGKPISWENLRSIQSSKGVGEPPLFLGSTVFFALREAVKAARSMNGHGDVLMLNAPSTAEKLRLAVGDRLVEKAKVVLGQDQPDFFTRIED

SEQ ID NO: 689 - protein, 256 aa, Unknown
  Kingdom: Fungi, Phylum: Ascomycota
MSERQEEMKIDPVRAQALISQLGAVKERIAAVAGNRTVRLVAVSKLKPANDILALHRAPTSHSHFGENYAQELKEKAEILPDSIKWHFIGGLQSGHCKTLAKIPNLFCVSSVDTSKKAHLLNSTRSSASLPPLSIHVQVNTSGEEAKSGCAPGEDTVALCRDIVENCPSLRLIGLMTIGAIARSKATTPENENEDFVALKEQRDLVSKELGLEGLELSMGMSEDFEGAIRLGSGEVRVGSTIFGQRPARADAKIKE

SEQ ID NO: 690 - protein, 413 aa, Unknown
  Kingdom: Fungi, Phylum: Ascomycota
MADQKNIVILGSSYAGFSVAHYLLRHAVPKLPNPSAYKIILVSPSTTFFCRPASPRALITDAAFPQGDLFRPIEPCFERYPSENFSFVHGKATAWDTDARTVVVDLSEGEGKATLTYHSLLVATGSGTPSPLMGVHDSDAALKKSWETFRAALPSAKHIVIAGGGPTGIETAAELGEHLNGKPGWFAGELKNPKVKITVVTSGDHILPYLRSSIADKAEPLLAKIGVSIIKDTKVEAVSPPDAGSKTNVASKATISLQGGKTIDADLYIPSTGYIPSTSFVPPRLLAADGRIKVDPSTLRVPNAGDRVYALGDCSDYARQAIHLLLEAVPCVGNNMKRDLFLAEGLEKDAPAEKKYKEDTRETHLVPIGTSTGVGSAMGHGIPSFVVTMIKGKHYWLNTLPKVWSGEQWAKEA

SEQ ID NO: 691 - protein, 489 aa, Unknown
  Kingdom: Fungi, Phylum: Ascomycota
MGFEFIDSNGPVDPASRQRIRRQAALGKNLGRKLNRPSRKQAASRPQAVAPTQASTVGHEEAQQGSRPDEEQVVRLPRPGYQLGNTLTQLRFRKIGPDGLVMNAISFILQAARSQDHGIGKAVHTGKVPVFSRFMFQDEAYFHSTIALSLRALSTRPEAGGLPSMLAIQHMARALQLINSHFARTESISDFNIAVVVVMTQYTRMSGHMDECRIHLDGLERMVQLKGGINAIRPEIAEKIFRTDLGCAYHLSAPPRFSMDEVEQFSMATVGPGGILSKAQRDITLGYVRPDLIQALSSTHLDIFLDATRLTHVLDDAYKGKREWLAISTLHQATLYIGYQIVGAPQGTPNENSDVDLLARLGLVTFCLSFFRSFDSKIIQSSPLGTAIYRIIHGVRPRGRWSEELILWTIFIGHIVQIFDDDLWPVMMQRARLCMGNLELTSWQDALRTLDNYPWSDALHGDTGKILWDALMLLPASTMSRTQFVVPLR

SEQ ID NO: 692 - protein, 379 aa, Unknown
  Kingdom: Fungi, Phylum: Ascomycota
MLTVAESWVEVSSQPSSSSLSSIGDEIVTTGLQVGSYARRRRLQASSRALPQQQTAIYNAGTSSQEEYDESESEDDQLLTSSTEHVPYEHQREADDALDRDDDSDDGDNATALGQRPPDQPVFRPQPNAFSHPQGYVPHRSHSSSSAMPPHPHSSFTRPSFSQRAQTRIHRGGPNFMSPSAREDNEAALRASLTTLLSCAAAARGLPKSTDEAQAHRPTGQGVGPSNQPVGLRLVPESELLAEGSSPTPAQAPSPPNKQRSTPRSSSRGCASERSKRSVSAGRTPRATKKKKTGAAEEALISPTLLTWVVSAGVVVLVSVVGFGAGYVIGREVGYQEGLSASVGSGLNETTSCGREVIRSSGGSLRRFKWSAVGKSIVA

SEQ ID NO: 693 - protein, 1162 aa, Unknown
  Kingdom: Fungi, Phylum: Ascomycota
MAASPETALPPMAQPHTTPARSYSTRSSRPSPPDDYYYPSNPAATHGQPAVPRSHSQSASASARAQQYQHRRSSSASTVPSPAVVASYSRHLDSHHRQQQQQTQSHHVSSTTTPAQPQRNHRRTSSSVRPLHETLPENDYEASNVATYPQRSPSRDRLNHPSSSNLPARPAANGESPRLPHRRSASTRQSNHRRRSSQVQGHQAQNSHNMAPSASNGASAPSGAPTDGTHSSSGKQTRSRTTIPTQSGKWILGKTIGAGSMGKVKLARKEDGSEQVACKIIPRGSTDDGHQSRADKERADQSKEIRTAREAAIVTLLNHPHICGLRDVVRTNYHWYMLFEFVNGGQMLDYIISHGKLKEKQARKFSRQIASALDYCHRNSIVHRDLKIENILISKTGDIKIIDFGLSNLFAPRGHLKTFCGSLYFAAPELLQARAYTGPEVDVWSFGIVLYVLVCGKVPFDDQSMPALHAKIKKGVVDYPSWLSTECKHLMSRMLVTDPKMRATMQEVMTHPWMTKGFNGPPDNYLPAREPLSPPLEPEVIHAMQGFNFGSPESIRAQLSKIIESEEYQRAVKLYQKEKELPQPSKDGEKKRGFGFDFYKRRNSGTSRDTLTGPSSEALQLGNDPLNAFSPLLSIYYLVKEKQDRERTDGPALTPTTPREKEKEKERERDRERDYREHRDYRENREYRDHRERTREEREKPVDALPEIAPPQAAVTNATTYEMPGEKPTGGRTRPRARTHGEDDAPDASKKAVQPEQRPEQQPQKKESAASGLLRRFSTRKRRDPERLEKDRSHPPVVQVHSPADSSSLTPRKSFSIRGRRDRDGSAEPRLRSGSSQPQHTELLSPPATAGGSRDSRRQGLGRSTSVNSAEMRRQKARGTTKEPPPTSGSDQSTAEEPAAGPSRGHGHSKSVAYRAKSLGHARRESIQQRRMRREAAQEANVPEETDMDQEASGVSTERLDSSDLAKPVFLKGLFSVSTTSGKSVPAIRADIRRVLRQLNVDFVEIKGGFTCKHMPSIDLNKVQDPPGSPGPTSGGGGHRRRFSFGGLMRGDDREDLRDPSDRPPTTPRTPGRSDRDRSYSNSETSVDSIPRRTNNGASRRAPGETSTQVQSDLGGSMVLEFEIFIVKVPLLSLHGIQFKRLDGNTWQYKNMADHILRELRL

SEQ ID NO: 694 - protein, 1180 aa, Unknown
  Kingdom: Fungi, Phylum: Ascomycota
  misc_feature (1045)..(1053): Xaa can be any naturally occurring amino acid
MSRPRSTENGMENDEGTPRTSPRASKLIQGFLKRTRTLKQGSSNRESVAQKRPNLNVSARASPTGHQHPVKAPPRSPPDPNKPLPPPPVNCDDDLDPAVDVFPRSGRPSLKLNKIMATLSEDDIEKLFSGAPHFFCRSESHFAGAPHPSVAFPFDEELEVRDLTDRVPINNKAWSGVSAWPHLTRDVRRESEKREVEKQRKAHFNIKARERPNMLSMQGLEKGTMGFEAALELPVGDSLNEEQFGFGSVGTKAKAIVEARHSMLSDRGWLRRLPESDVLDRLMHNGDLYRNNAFKTKSSTETYKDLFHSLLRPAHVPPIDKQDHHGVANQIDCLLKCLGMPNVWIDLSLVEWRIRLGQILWGRNDGDEVDDATDIADAKNSSERADERFWLLMQVLVATELLIRLDAVTEGHEFGIGNLRQIDVVRFERAATPAVKWSLLLARSWLENIQVVREEAAVGATLSSLTQQPHHHQAGGWLSSLVSKVSLYYHHDHGSRPPSPPYHYTIKGRHGDRQVDGLTHFARKLRWPGLDQYESRISSNAEHTMDKATPGTPTPLGTTTTMDSSQSYFGAWDITGNRGKKNERVQAQRRKMAAALHASGWLSKSYIFGLLLPGEALSHFLMSTLLENDPEALSRLGSFANLCGGFVYSGMSFWSTSCIVGRVLAAGDGASESMGWISTDIVPEGRGDGWLNICTQDVAADMAQLGRKSRIWAKKKIERESSILGDADEDSVFPADFIIPHEGSYPKQPPALTIEFRTFKLLRSYESVLPTPLRDLTPIPSPATEGSAAPELASHPASLTFSVSMNGRPAEEHTFALTYDISFVTAHPCTPSSKVRFLKSPTSPTIQQIDVSGSDMLGNTSRSVHRAGHPLHKSFNYNVVPISELLQRRHYFLEDFLPDPMPTNKPASRSNTNRVLVIDCITNILDVPPSPLFERSPASPRLERSGSFSSQNHESRRRNMGSDLEVLVRALCAQNGWNALISRRRRGCLACAVREAGALGVQPAVSSSAGSTHKQLSALATPDSPTSRHTFGGSSPQASLSLSLXXXXXXXXXLPSSTSDPSRPSPHRDRRTAATMAPQQKDMRRPDLVVPYMEPPAKEGEADMGSTISTTLPMAAMFMRNKFVGWAALVFSVQTWLGESEDSRKKSATSGLFSVGMAALALAVNYIPLFVPPTGKAQAA

SEQ ID NO: 695 - protein, 580 aa, Unknown
  Kingdom: Fungi, Phylum: Ascomycota
MSRRAPNPAADRAAQNQATLKSLLKLEPNKVCADCKRNKHPRWASWNLGVFVCIRCSGIHRGMGTHISRVKSVDLDSWTEEQMASILSWGNARANKYWEAKLAPGHAPSESKIENFIRTKYELKRWVMDGPMPDPSTLDVEGDDDVPLNIVKEKQAIERKTSTRVTGSAAAPQQQRRQPAPMGDLIGGDDPIPQRSSTAGPAPGKLPPPKAEAAPPKQTNKDSLLGLDFLGESTAPPRPSSAASATTSGGQSRPDLKQSILSLYASAPRPQVQQQQSTASTGSFGSMGSPTAPTHQQQQASFGGFNDAFSNLSMNNTTSSKPAPADPFASFGSATRNRSPPLPSNNNAFGNLGGGSFFDTKPAQPVHQKKPSNSGFGDFGGFSSQPAASTTSPPPSQSFSADLLSLDSAPPPQTVSSPRPTTTSPPASTSVFNLSSPQPKPTQISPPINPAPAPVATSSFAAPAISGADIWGGNAWGSDTVSTSSVAPAPAPAQAPAQASTTLASNDFGGGWGAPSSSSFANTPIVPGTAGGFSPAPKVQADEEFGGWSSSTGQPGTGGNKPAAGAFSAADDDLFSNVWS

SEQ ID NO: 696 - protein, 292 aa, Unknown
  Kingdom: Fungi, Phylum: Ascomycota
MAWFTALLGWVAPVFLVMSPVLSYSDQAVSMQRNKTSAGFSLDIPLIMLIASFFRIAYWPGARFDTALLIQSIIMVGMQVVLLRIALDHRPGPSTKGGEAATPFAGAQEGSWMAQRPYNFWQWRSPKPYWQFLGYVVAGLIVAEILLTPVPGIYAIYSTIIGITGLSVEATLPIPQILSNHQSRSCKGFRLSVLASWLIGDAMKIFWFFTATSEIPWAFKICGIFQASCDTYLGVQYWMYGDGVGSVTVGGSKGYEMVERGSPNSWRQSGHVPTRSLTPTRRPAPFTAGSSQ

SEQ ID NO: 697 - protein, 972 aa, Unknown
  Kingdom: Fungi, Phylum: Ascomycota
MRGLVQFIADLRNARARELEEKRINKELANIRQKFKDGSLSGYHRKKYVCKLLYIYILGWDVDFGHLEAVNLISAQKYSEKQIGYLAMTLFLHEKHELLHLVVNSIRKDLLDHNELFNSLALHAIANVGGREMGEALSGEVHRLLISPTSKSFVKKKAALTLLRLYRKHPGIVSPQWTERIIHLMDDADLGVALSVTSLVMTLAQDDLEQYKGAHTKAAARLKRIVIDGEYTTDYLYYKVPCPWLQVKLLRLLQYFPPSEDTHVRDMIRESLQKILNLAMDTSKNVQQNNAQNAVLFEAINLIIHLDTEVALMKQVSSRLGRFIQSRETNVRYLGLEAMTHLAARAETLEPIKQHQDIIIGSLKDRDISVRRKGLDLLYSMCDSSNAQVVVGELMHYLQNADFAIREEMVLKIAILTEKYATDVQWYVDVSLRLIAMAGDHVSDEVWQRVIQIVTNNEELQVYAAQNALQYVKSDHCHETLVKIGAYILGEFGHLVADQPKCSPIEQYMALQSKLSACSSSTRAMILSCFVKFVNLFPEIKPQLLHTFEVYTHTLDSEMQQRACEYLALANMPTDDLLRTVCDEMPPFPERQSALLSRLHQKHANTSDRRTWVVGGKAANSNAAELSMAKNNGSLQRTFSSGGANGKPNGANGANGHGDGASDLAGLDLNAPSAAEPKMLKPVNLASAAHLSPGWERGYHRLMLKADGVLYEDGQIQVGIRSEYRGQMACVIGYFKNKSPTAMSSFTTTIDLDEGEKGKLTWDTKTLPDNTIAIGSQGQQVIMFEAKKVFEKSPTMRISYLAGALQSITLKLPVALHKFMDPAELSAEDFFKRWKQIGGAPREAQAIFGLNPVAKNAEREITEALVSRIVDGFRWKLLDMVDPNPKNVVGASVLHTSEGGKFGCLMRLEPNYGTQMIRLTIRATDDAVAPVLLKMMQDKIAAGTTTHASTPDASEQPSRQEISDAFANVMVL

SEQ ID NO: 698 - protein, 709 aa, Unknown
  Kingdom: Fungi, Phylum: Ascomycota
MVPLSHLVSVLLGFQTATVIASSDTDLVAAGLTILTSNDLNAEPAPGSGAILIDANVDHATAEDLCNQLSESLWYTDESDSTNPLGPSLDYQAFQGNFKKDAKFWVRGQKEKDCKCRAMQANGSLYPVKCSERLPALCSQSASVSNRTWEDNSKPLQITRELGDARITGYRDFYTWRFRGIRYAPKPQRFEYSTTLRNMTGQISALKPGADCLQADAPESQDDCLFLNVWTPSLPAISNGSVVTPTKLKPVVFNIYGGALMTGSGSNPALDMGNIASRGDVVAVSFNHRMGNLGLLVFNDGIHNGNIALNDQISALTWVKENIATFGGDPDRITISGESSGAMSVRYLLSSPLAKGLYSGAYQQSDGNGGPAEPWGLWWSRKQSYEYFTKTVLREFGCDDTDDEVECLRQVPGERLTSLDNLDGERGTARYPVIDNHYLTTPHFLLDGSGPRYARDIPLVTGSTRDEGGITAELAALPWDSMGLEDWKKVLIHYVARLRVDLDPVFANLDVFGLTANSTGDDLFKATAKIVGNSMFICLDRAKAYSASKNKVVEKVYSFTVNRTYSMRGYTTKWCDAPITPQRPNGDPNMEYLKCHGGAQMPTFGTYKRLGYPDRDGFDVPFSRLLIDYLTSFVRTGDPNPDESYLKIRGYDSTVEQVRKIGKWRPVNPERPEEMMLQWDGAMAPFADRELCSILGQPLEYWEDIEGAA

SEQ ID NO: 699 - protein, 1250 aa, Unknown
  Kingdom: Fungi, Phylum: Ascomycota
MASPLPDSMSLRRDSGVISPVRQVRSRTHSISSDKPSTISHSLMSPPLSVSPEAAFIASSAASQIVTNDHDSHADTWYDQHGIEPAGETALIAPAALHLVNNFLDQLLFNFLQVSKATTLAALRPAVSEVLKPKLAKDAINNADEELREYLGGADEDDYVQPQGGDARQDWDLELVWKRTRLRCMVYSSLGDMEEEDEDLFMEQENLEIGADEQISDVISPAVAIFLTSVLEYMGELTLTVAGQAAYHRMRTKFEKDLKEGIRLQTDIADRIVVEELDMERVALDRTLGRLWRGWKKRIRTSTIDSIGGQPSIRSLNKHSRSDSQDSIALRFAADSRDEPRKSQDYRANAIAEDVQPADIALPMRDRDVDEIEVPGLVTYSDEEEDIDEPVLEEKRPRSLYLPSSVAMASPKAVQKIYLPSRTRSISHPGGRFNPFVSRYEQQQQAQESTTADADNDQATKKDSLAVSVDEDGPEARVHDGDAIGVAVTSDAVSIREPVASLADSDSADEEIEYEKAEIITSARVSMSGSSSASEPDKLERRSSVRSARIVSVPAPKGSSGSRPSSIEASHPTSFTGHNGKASPTVAEERKVPLEAHAVSPSTSKLMVERQQSTVQPTTAITESDEEADFFPPELQGIPSRSSSSARNPYAQSIRQHPSAKQEPSAVTKVTIIGSSNASSAFEPIPEIPAKSPGHGGRQRTRQDSFDKAAPRASEETISHSPQPSSNPGRPTHTSASSVSSSTGRLKAVRTSEENYAHRDNVARNFEDLIHSNQTITYTLTPENMRDNDATESSPLPKYQRMSEEARAHGRSGSPSATANAPRSPTNSYTAQSPGQAGFDSSVDRTAVSVPRSSSRQDSRSPRPGGPKAREARVPPESTADFAEFIKSTGPPGETRSMPLKTGVGASPAKKNSSESRRVSTNSNRGRYQPREAAIDKGDNSDLIDFIRQGPPVVGASNHRIPRHVAPFRNTMDSDQMTGANGGRAVDATIPEIRHSQASTNVTENSMPSMQSSINSSSALLKKNNGGGMPSKMFDEDDMMPQRKQRRVRDPYAVDFSDEEDDDELFGTTPKPPAKKEESLAEFLANYEPPPAPPIPASTQQKMPKKKMSAPSLMARFRNTYSRDSHSASPSPNPAAIPNPPPAASRTTGKGGHVPIQVTMPAGYDTYGSIANSGPPRRRSTAGASGKIPMQRFQPREPVQVSTGTSDLAAFLRDSAPPPSNTPMVASTLPHEESNGISKMFGRRKKLGLA

SEQ ID NO: 700 - protein, 424 aa, Unknown
  Kingdom: Fungi, Phylum: Ascomycota
MATATILQPTSHHPSAHSSAYPTTAAAISNMISSEPGKPAGVPAVLDAKDSTSRQSLPSISDVLKVAEPRQFQPPAPPSMQPTSSFPSPFSSGPRGSYSDGDKHASPQTLHHSSFPPRQEPPSTYADSPRSSFHGRPGLPAVPERRPSPPLRPDIPPHHMTEAQRAHDPHHPLNNGAYAHPPPTVPPLPTGPYAHGPLPPGQVPLPGYPISPHRAGPPGPHPYDPRGPPPPHPDDVDPASRARYESARHFEQWPYPGALARVAQSARTVFNFAEAYHRIASEQSGSPPMPERLPTDHEIAEMLNTTDLVKRSLEQVRELVHQSAQSERIRDSAKPKGPYDDDDVAMYTDHMKAPQYIAETKKRRGRAAPPGRCHSCNRIDTPEWRRGPDGARTLCNACGLHYAKLERKRQLEARQIRPKHDERP

SEQ ID NO: 701 - protein, 447 aa, Unknown
  Kingdom: Fungi, Phylum: Ascomycota
MASALFFLDLKGKTLLARNYRGDIPMSAVEKFPILLSEAEEESSAVPPCFSHEGINYLYIRHNNLYLLALTKRNTNAAEILLFLHKVVEVFTEYFKALEEESIRDNFVIIYELLDEMMDFGYPQTTESKILQEYITQESHKLEIARPPIAVTNAVSWRSEGIRYRKNEVFLDVVESLNLLVSSNGNVLRSEILGAVKIKCYLSGMPELRLGLNDKVMFENTGRSTRGKAIEMEDVKFHQCVRLARFENDRTISFIPPDGEFELMSYRLNTQVKPLIWVECVVESHSGSRMEYMLKAKAQFKRRSTANNVEIIVPVPEDADSPRFRTNIGSVHYAPEQSAIVWKIKQFGGGKEFLMRAELGLPSVRGDDEHGGGMTGGFGGSMGGVGGMGKGAKRPIQVKFEIPYFTTSGIQVRYLKITEPKLQYPSLPWVRYITQSGDIAVRLPDVA

SEQ ID NO: 702 - protein, 450 aa, Unknown
  Kingdom: Fungi, Phylum: Ascomycota
MQFSSLSPDETILKLPHPYGTEFALQKAASSSQAQLFKLVQKSAPGSKTTTTPFALVSPQLHFTEPADLKSSEAPPPSNNSAWARARRSPCVSAQWSAGETPSLAQAWLLLYVLFTLRPGVESLRLELQGAGAAKLGQQLCDVLLAIRHPLRPSEQRPKTEDGKAVVVAQRSTFWQGAGSPFGPRPVWCPVESPASLDSSTLASYPLTPLLNTTSIQLAGDPQDPERHMQAWHPIRPAKPAPGAVIYSRWIPHLKETFSMVSLDWEDAEHLRLFHEWQNDPRVSQGWNETGTLEQHREYLRKIHEDPHQVAVLAKWEDTYFAYFEIYWAKEDRLGAYFNAGDFDRGRHSLVGDVRFRGPHRVTAWWSSLMHYLYLDDPRTMAVVGEPKETNSVVVMYDLIHGFGIEKFVDLPHKRSALVRCPRERFFQLCPLGESEKAVGGMGIGLVPKL

SEQ ID NO: 703 - protein, 115 aa, Unknown
  Kingdom: Fungi, Phylum: Ascomycota
MSFVTRRALSTLIPPKAIGAAPDALRMQRVVGFYEKLPRGAAPEVQAKGLLGRYQAKHMGKNSTAKQVFSDYRSRSKHANPRAYAAIIQVLALLIAVGYAQNYYFHLRHHKNNAH

SEQ ID NO: 704 - protein, 450 aa, Unknown
  Kingdom: Fungi, Phylum: Ascomycota
MVAAREVFAHYMAADILASSAKFDVEAASRLGFDAFAINLNVAAINSDWAERGTGRLFDAAAETGFKCFISMDLDQANDATRDQFADFVNKYMSHSAYYQQDGRPLLSTFSVGSTSPGTWPDFLARLNDGNGVYFIPNPDNVEGYYAVGQPAGTPEFWDSWAPVVDGVFSWETAWTKDGKINVSISDWDEPHAAEAHSRDKSYMVPMSSLQFKHWVEDTRNDIWYRVGEVNMPERMTQVLSMEPQADLVEVITWNDSGESHYIGTVHEDGQLPAFLEYANEETYSHVAWQPLFHSFIDAFKRGVDARGMRPMEEGKKYTGAMWYRSVTTDATCVDLPDGASDAKDALNWAVVVAEGVTNAYVQAYSNGVKILPTGDSPPVKLEAGLNYGSVPGVVPGIQYIEVVEIDDLENGEWEYAYTKTGDVAVTDNINGGICNYNYLVYSLEEGRYN

SEQ ID NO: 705 - protein, 591 aa, Unknown
  Kingdom: Fungi, Phylum: Ascomycota
MAAINAQGVYHRLPSQAASDYQQAESTILSAAHKDWPNEAGFETPEHRGPIPLTIKGSIPDFAAGALYRTGPGRHKLDGMANGKTHYVSHWFDGFAHTHKFDILSHGEGKPTTVEYSSRRNGEEYAERVRQKGWRSAVTVGQKSDPCVGIFAKTMSVFQPLPRHDLDYNVVVNADYPALTQRKAEAEEAVTLGHQRTGTRNLFISSDQSGLQELDPDTLETVGYSGQNKLHPDLDGELSASHGQRDPKTGDLYNFNLRLGPRPTYRVFRTSASTGETDILATISGKDAPPAYIHSTFLTENYFVLALPSTHFAWNGIKIAWSRTLLDGMVPFSKDQKTQWFVVDRRNGKGVVARFTTPAGFFFHSINAFEETVTSPDSGEEQTSILADLSAYDSPDIIHSFYYDVMLDREDSFSKFWHDETRRRNALANIRRFRFSLLPHQSANPPAWTYTPSDPIQEAELILDIKNPHGGELPTINPLYATKPTRYVYSLAFRGLGTIMDCIVKTDLKTKEAIIWAGGKGSHPGEPIFVPRPGAEDEDDGVLLSVVLDGEHERSFLLCLEAKTLEELGRAELEFAVGCGFHGLHLPEVRK

SEQ ID NO: 706 - protein, 276 aa, Unknown
  Kingdom: Fungi, Phylum: Ascomycota
MYELFLTAFVEDADISAACAVLSGLCGMPAWESLSRVLYFQGVGRPSGISNQSSIERPLRKDVGIFWKDLHQSLSRQSFVLQARYEVQKDRDMGPQAQAADLDSTAGVLRFTDFPDAPNARPIVVQRKKVEIWEQKKLPSILRDNNYQFKTETVEEMLRFFRDELEFTLTRHYFTHPISAYQPLATKSQPTVPLSTLPAWEDLTPMDSQRRWVLQIKTHVLQDTRPDEVRRGQEALLAVMEDLSGVFEFKVIDRKVHDTRAVLPHARQDPAMLKKK

SEQ ID NO: 707 - protein, 302 aa, Unknown
  Kingdom: Fungi, Phylum: Ascomycota
MSAGPSVIRKPGVNRSNLELVNSLRDNFSAAQQDYAPQTNGNGNGTSIGNGVGTHKPPVEVWTERSGDALFVPRVNWQSGGLRDEQSQYEITVKLFLLPDSPVAEREQYARDALVLVRKELGIEAIDLLLISFPGISFEGTCEWEADKRNAEQGNIEEEIATWRVLEDLHDQGLAKRLGVAEFGSEKLQAFIKRTRIPPVVDQINLKDCCSVPPPLKALAAKEGVELNVHTDCTDILPCGTIRELLSHGPRGAGLLADKEHGGAGLEGDITPHWVVRYMAFIRDRGVIENKGYFAGAEIGCR

SEQ ID NO: 708 - protein, 364 aa, Unknown
  Kingdom: Fungi, Phylum: Ascomycota
MKGLILVGGFGTRLRPLTLTLPKPLVEFGNKPMIVHQIEALVAAGVKDIVLAVNYRPEIMEKFLEEYEEKYDINISFSVETEPLDTAGPLKLAEKILAKDDSPFFVLNSDVICDYPFRELLEFHKSHGNEGTIVVTKVEEPSKYGVVVHKPNHPSRIERFVEKPVEFVGNRINAGLYIFNTSILKRIELRPTSIEKETFPAMVRDNELHSFDLESFWMDVGQPKDFLSGTCLYLSSLTKKGSKELTPPTEPFVHGGNVMIDPSAKIGKNCRIGPNVTIGPNVVVGDGVRLQRCVLLRGSKVKDHAWVKSTIVGWNSTVGRWARLENVTVLGDDVTIGDEIYVNGGSVLPHKSIKANVDVPAIIM

SEQ ID NO: 709 - protein, 479 aa, Unknown
  Kingdom: Fungi, Phylum: Ascomycota
MRGPAVKRVAVIGAGPSGAIAVDALVKEQAFDLIRVFERREGPGGCWIGDSGPSPTLTDFEGLAKRTADPPVPIPSHLPALAPKIDRPRYDESSIYPYLETNVNDLSMQFSQEPIPAERSEWSIGLYGDQTPFRHWQVMRRYIASLLERDGYEDLVSYSTTVELVEKVGAEWKVVLRKDGKERDYWWVEWFDAVVVANGHYAVPYIPAIEGLEAFEKSRPGSVLHSKDFRGRDLFKGRRVIVVGASVSAADIAFDLTKTAKSPVHAVVIGHTVNGYFGDGAFHHPNITRHPSITKVVGRTVHFADDTSVDDVDHIIFGTGYSWSLPFLPSVPVRNNRVPGLYQHVVWRDDPTLTFVGAVGAGLTFKIFEWQAVYAARILAGRGTLPSVQEMARWEEDRIAAKGDGPKFSLIFPDFEDYFETLRQLAGEPTDGKGRPLPRFRREWYRAFMDGHEKRKDMWRRLIEQARQRTAHEPGSAKL

SEQ ID NO: 710 - protein, 282 aa, Unknown
  Kingdom: Fungi, Phylum: Ascomycota
MKFKSLVLAGLMAGGTVGSAVPKAPYNFGCGAPPPSDSHRAVSKELAVQEAAFNSGLQINAASIVVDTYIHVVSIDQTATGGYLSRETIDKQMQVLNDNFAPSGIAFTLKDVDWTVNTNWARDRDSLNMKKKLRKGTYASLNLYYQTEVSGNLGVCYYPTTAQPGTTAFYQDGCTILFTSVPGGSATGYNEGKTTTHEVGHWFGLIHTFEGGCNAGDEVDDTPAQASATSGCPTGRDSCPNQAGLDPIHNYMDYSYDSCYEEFTTGQVNRMKSMWTRYRSGK

SEQ ID NO: 711 - protein, 618 aa, Unknown
  Kingdom: Fungi, Phylum: Ascomycota
MSRIPVSELSSYLLLGRLSRSRCLLARRLPRTSTRGLLGAPGQQPVRCIHATNVASAAASLQTEHVPIRKQLKDASKQAKKKGKNKSKGDQQTVDGWELTVGIEIHAQLNTARKLFSPALTSFNDEPNSHVAIFDLAMPGSQPIFQKETLLPALRAALALNCDVQPISRFDRKHYFWWDQPAGYQITQFYEPFAKNGQITLLARDGISPQDGESVTVGIKQVQLEQDTAKTLAQTNGEHWIDFNRVGVPLIEIITEPQMHHPRTAAVMVRKIQLLLNAVDACVSGMETGGLRADVNVSVRRTDDPSLKLGTRTEIKNLSTIKSVEDAIIAERDRQILELESGRVILGETRGFSVGSTQTRRLRGKEGEVDYRYMPDPDIKPLIIGSDLVEHLRSTLAVLPDAELDCLISDHGLTAKDASSLLNLDSGARVQYFYKVVDHLKELMLAAGNSNPQELNRCSALVGNWTIHELGRLTTSKAGPMAAGELEFSQEGDCAQVPYDALAQLLFHLQNKNITGKVAKELLLGIYLGELEQDVATTINDHDLWFKEISSEEYEALADEVLEGEEKVLKEFVQYTTYPHGKLMYLVGKLMRTGQTERIDPATAEAVLRSKVDQLRRP

SEQ ID NO: 712 - protein, 985 aa, Unknown
  Kingdom: Fungi, Phylum: Ascomycota
MAHRFTAKDGVDLAALSPKDANAQRPHKAAELKTKTAAQLKAAKDKEHPLPPPAEVVEPASSDRPNGAVYQVGKLLGKGGFAICYGGQLLPTKHKFALKIVKSHMPPKMEQKFQTELQIHSKMRHKNIVQFFRAFAFETSTYLVLELCPNGSLMDMVKRRKGLTEPEVRFYTVQIAGAIKYMHGKGIIHRDLKMGNIFLDSRMNAKIGDFGLAALSLTGKDVQTIRRTTLCGTPNYIAPEILEKGKKGHDHMVDIWSLGIIVFAMLTSKPPFQSSTTDEIYRRARERDYEWPDVDALKRRISDEAKDLVSTMLTEADLRPEPDTVVQHPFFTSGYMPCEADMTTKLREFTPYQDEFYMEASELGHAQTVGKLRSMCRDCGVGPWNVVKVVHSQVWKEMAKEENAGLTPSIPLAKGVVYRPFDERSQEEQQLKPKLLASMAALSISSTEEPSASSTVRGATGLLRQPPQSFAAQQRAQGRPSASTTSSKPRTALPTESVPTTSGSLRGRARREVGTSKEAPESGYRSLRGTARPVLPSSRSAPVLPIPEKPIANSSAPVAVPQKVRSETLPPASLFSPSERPTQIAGSKPDDVLDRLRRLQTELERALNARSMAIISSKTTTPPHPHIVVKWVDYTNKFGLGYILNDGSVGCVLRDITTKTESGSAAQLPPAGVFIRGAERHILRRQDEKYADRHQPVPMTQPIKFFENNGESGLAQAAVSPEQFRVPINEDGTAGKLNAGKDSYQHRKRERIILWKKFANYMIAYGRDEAVPTEEDVAKAVGPGQENAQAELVTFYQRFGDVGCWVYCDGHLQFNFPDHTKIVLDATGTWCHFWHLPQEAAERLASTGTIGAAALDDRAMLSYPLQTLLNFQTKSTARSAASRRRPEIDPELQGIPAANDFRRKIDFIKNVVKEWVANGGLGNSNMSRETRLRWLGYRETVNATIPQKHVWVTIGARWGDQRLTALVDPRKPWELGEDSDAVSKK

SEQ ID NO: 713 - protein, 401 aa, Unknown
  Kingdom: Fungi, Phylum: Ascomycota
MVHPKVSKALEEAKKLVASLEAYEDNPASHQAVMKQVGRIRSELQEPMDVVTGLFENLSLGGAFHTILGIRAYHAMPEDGSPITADELAKITNVASTVIHRAYRVAVNHGLFVETAPDTYAHNDFSRALDPMGLGSFFMITLEFTRAWVHLPEYLKSHNPDDVFDLVKSPAVYSVQKEHLGKSYYQLLDEDPDPERRAIWNANMFMVDQLMPVTGMFPFASLKEEVAKDPERPYLVDIGAGRGQSVFAIQKDINGAFDGKFILQDLPSVINSLKQDDYPGIELMAYDAFTPQPVKNAHIYFMRRFLHDFYEPVCIEFVKNTASAMGPDSRLIVCDQLVPDMVEVHENYDLYWLDFALLCMTGKEKKLAAFEEIFDAAGLELVKVYPSAYGKTVMLEAKLKQ

SEQ ID NO: 714 - protein, 258 aa, Unknown
  Kingdom: Fungi, Phylum: Ascomycota
MRGQTYFQQDGVNEFLEVPWHLQPDMRVRGNSGLGLFPRLPPELRLRIWELTWPDERVIEPARRNWKEPHYLRPAGTVSSWIEEDFSLRIPTTEPLERCPNPVALQVCRESRIHTLRRYVPIRLGRLETATSYMDPRSDFLWLSHDFDLETLDDLRSVYGHDLTCVTRVLVEELGIWADEDVERVVTLLQAFGRLQLIRVILEEYSFSEEDQPVATPDEYLETAEKLLARDSPLLQQHSWRVEYTDRDGNIYGYFEPS

SEQ ID NO: 715 - protein, 683 aa, Unknown
  Kingdom: Fungi, Phylum: Ascomycota
  misc_feature (546)..(551): Xaa can be any naturally occurring amino acid
MKVFLSLFTGPLRLALLLLLSGTAHAYKTGLIGYGQLWYDPVCGYACRGVIGSAPLDCPDHDMADVSMHMHGGSPMAPCISTNYPFLSTLAYCLNEYCSADGVSASKIEAYWADQATGDKSIPPKWTYGAVLANITTAPNRTFEAGDTLNYTALISEKDYKYQSDFDVFFDWEETVQSTYVIVIISIGVASPVALSLLGYLPFMSTAIDKIKPYLIYPFSIATYNVRPLPFLIGNAPTLGQSLWIAMFIILNIILGAISYKNFYAAHPWGFTKSAEILAYVGYRTGHISFALLPLTVLFSSRNNVLLWLTNWPFSTFLVLHRWVARLCAAHAIVHSITLLAAYVSLGTYYADVHKPYWIWGIVATLCLVVMLFQSVIWFRRTAYEVFLLLHIVLAVFVIAGCWYHIYYWKPYSGIYELWIYMVCAVWFFDRLVRVLRVVKNGIKGATVVELSSDIVRLDIHGVRWSPEPGHHTYAYFPTLQPLRPWENHPFSITHTAMLRFRKHPIASGHASSHSRDVDVEMTKGAAPVSPDSATIHGTDTISLYXXXXXXLLEGPYRGNVSSEVLKCDRVLLIGGGIGITGLLTWAYSHVNVKLAWSLKESSRPLLQDLETALATIEDKVIVAGQRLDVEALLASEVEAGWGKVGVVVCGPPGLCDATREAVVKLGRQGNTVFELEVDAFGW

SEQ ID NO: 716 - protein, 374 aa, Unknown
  Kingdom: Fungi, Phylum: Ascomycota
MKTSALFLGAIAQVASAHYFFDTTVRGGVADRQWQYVREFTRPTAYNPIKFSSNPPADIRDNSFIDGEDARCNQGAFTNAGKTDVLTVKAGSEVTVKLGVGATMQHPGPSLVYLSRAPNDDVKSYDGSGKWFKIFQEGVCNKGGDFTKDAWCSWDKNTITARIPLGTPSGQYLFRAEHIGIHRSHVNQPEHFVSCVQIEVTDGGSGVPTDTVEFPGAYKDTDEYANFSIYGGFKDFPFPGPPVWSGADSSSAGTGGASTSSAPPAASTTEAAEAVQPTTPSTTEPAEPVEEPSDVSPAPPAGTPIIPPPAETPVIPTPPPSLPTPPVPVAPAPPTETGSVPQPPPCAGRPKHSLRRRSRKAHRAQHARRSQRTF

SEQ ID NO: 717 - protein, 364 aa, Unknown
  Kingdom: Fungi, Phylum: Ascomycota
MSTRDEHAVPLMSQEERDEGKPDPIDIEANASAEPTKAQNLDHEYSIPATIKFAWLGTYFIFSLALTLHNKFVLGSFHFPWLLTFLHTSFAAVGTTFMMQLGYFKMSRLGRRENLSLVAFSALFTANIAVSNLSLAMVSVPFYQTMRMLTPMFTIILYRVWYNRGYSAMTYASLLPLVVGAAMTTVGDGEMTFSDAGFLLTILGVVLAAIKTVVTNRFMTGSLALPPVEFLMRMSPLAALQALACATVTGEVSDFLKHMASDEVSLIPTTLTLGGNGFLAFLLNIASFNTNKLAGALTMTVCGNLKQIMTVALGIVMFNVNVDFLNGLGMLVTLGGAAMFSKSELDSKRRKAAAAYKPVNQGSQ

SEQ ID NO: 718 - protein, 573 aa, Unknown
  Kingdom: Fungi, Phylum: Ascomycota
MKYVLVSGGVISGVGKGIIASSVGLLLKTTGLTVTYLKIDPYLNQDAGTMNPVEHGEVYVTDDGGEMDLDIGSSSRFLATTLTRDHNITTGKIYQQVLDQERRGDFLGKTVQVVPHITNAIQDWIERVALVPTDDSGRQPDICVVELGGTVGDIESAPFIHAISQLQRRAGKGNFVQIHVSYVPMIPPGPGGEQKTKPTQRAVSDVRSAGLSPDLIACRCEQPLSSATIQKVADMCQVENNKVIAVHDVSTTYHVPMLLEKQNVLETISGLLDLSNYERPPALVEQGKEMWKQWVGLAQGSVHALDTVNVALVGKYISLKDAYMSVSKSLEHAAMHCRKQVNIIWVDAVQLEDETLQTAPVQFHKAWHDVCTADAILVPGAFGERGTEGMIKAITWARTKKVPFLGVCMGMQLSVIEYARNVAGIPDANSEEFKPQGKNHAIVYMPEIDKTKLGGTMRLGKHACVFQEGTEWSKLRKLYGDAPEIYERHRHRYEVNPELISTLESAGLNFIGKDIKGERMEIVELKDHPWFVGVQFHPEYLSRVLAPSKTFLGFFAAAAGCLDEVTKGFNEKN

SEQ ID NO: 719 - protein, 139 aa, Unknown
  Kingdom: Fungi, Phylum: Ascomycota
MAKISRGAPGGKLKMTLGLPVGAVMNCCDNSGARNLYIISVKGIGARLNRLPAGGVGDMVMATVKKGKPELRKKVHPAVIVRQSKPWKRFDGVFLYFEDNAGVIVNPKGEMKGSAITGPVGKEAAELWPRIASNSGVVM

SEQ ID NO: 720 - protein, 261 aa, Unknown
  Kingdom: Fungi, Phylum: Ascomycota
MFKIATKLAGKPFAAFQRPTELTGWNRAWRRYMTSPAGRRIQSQLTHQSFSLGRATPPRIGSAATRARSTHGATSFHPGVRAMQRRGFRFSPWSRSRKAGEAAEKPLSLTARLKQLSKEYGKAAVGVYFALSILDFPFFFLLVKAVGAERIGKIEHWVMTHVIPESVRRTWNEWVAYFKQAEKKQTGEEHIADAVDKAGWGVEEAQERHREEASLGTQLALAYAIHKSFIFVRVPLTAAVTPKVVKVLRSWGWQIGNKVPK

SEQ ID NO: 721 - protein, 834 aa, Unknown
  Kingdom: Fungi, Phylum: Ascomycota
  misc_feature (174)..(180): Xaa can be any naturally occurring amino acid
MPADDGDTPAEEVNASSGPGAAATGSQKERQRVTKACDHCNQIRTKCDGVACTFDRKSRRNGRKKRRATPPLLGRHPWPRPGAVVPSESALASAGVTASTGAVDPLEEDGDATVSRPGQPVAGDGIQGTLPTGLVNSRPLLNIPVPQTPVEPGQRGGFDASYGYEQQLFGHLDXXXXXXXRALRTRLMRHALTKAFSEGRHPLIRGFGLIMERSGAQTIRETVDVEYPVIIPLLPFCSHQISPPLACKLLEGYFSTFSDHDAYASSPFIITHVLRKQSFLSPTSFRDCKPALLSSMLLVAAQTVEMPFFGSAPTARHRLCQGLFELTVTLLSSNPSASRSPHGATTGEKTVIAQERRLVGSSQSLSVLAATRTIDDVIAYMHLAVISSAAESKSVGSHWWHTAVQLAKELKLNLELPSSAREPRSASRGDAQQADSALIGTARSRLLQDTRVHQPVASSTTGADSTSPIGMVDNTITEDDGTAHVRAGFEDQEERRRVWWCLYVLDRHLAICYNSPLAIRDTDCQDLLWPLDDASWQAGAYWSDAAPGRRVSHADLPGTAAMAGSSLVDRPKGSSAECIGPGIFGLFIPFAFILGQIIDARQLMSQPHYRTLRAKEIGHILQQEINGQLETFKATLDRLAIPSRVKDWDMTGQPQTGTPTTEPVAPTRLRYQRLMVTYGHYLYHILGVLLHRERSQMETSTAASANDSIVLSCATQAAEALQNVLSSDHELKFNPFLLGIFLVQGSYPLLVAASRDMQRASTQVLKACKITVRAHEASVATLHAEYQRKNRKLLLSAIEGIQYGQSAITREMTSLNERIIKLFRWSPGGRGLGL

SEQ ID NO: 722 - protein, 346 aa, Unknown
  Kingdom: Fungi, Phylum: Ascomycota
MVQLAHVSSFGSNASAQKPFDTSLAELGRLLQRLQESTLHSDPVRERRLRTSEYERAKLQSNLDYARRALTSLEQDALAMKAPVRRAEVQSDLNHKREVLDLLFERLEDLKQVAIDDDEDSSEGEDLFGDLAPTAHSAPEPDSQAPAPAHQVPEALPSETQAALVAATPAAPQPETTRAPSPSSQPNFEAQPTHTAQSLRSRASASSPPPDYSTSRAALFASRRKAASPLASAPTTSTATAQALLDRQREEQEALTDSMLDLAKRLKANTASIHSDLEADKELVDKAGEGLDKTERTMESATGRMGVLKKMTEGVGWWGRMMLWARIGVMVVVILLIMFVMPKLRF

SEQ ID NO: 723 - protein, 505 aa, Unknown
  Kingdom: Fungi, Phylum: Ascomycota
MKSEKTSVDIGPVPAQETQMRQESISPGTMETADITNQDPTFYRRLLKTIDWHLLPLMVFSYMIQFLDKQTLAQASIMGIVQDLNLVGMEFSWAGSIFYFGYLAASYPASMLMVRFPIGKYLTVTFLVWGVILACHAATHSFAGLLVVRFFLGAAESSVSPGFSLITGMWYRREEQPLRHGIWFSGNSFATMFGGLLAYAIAHIQTSLATWKWLFLIYAILTIVWAVVLGFFLPDSPQNARFLDDKQRVGAIERIKVNQTGAVNHTIRWDQVWEALTDYKIWLLVLFQLANNIPNGAITTFGNLVMRGFGFSTLEVYLLTMPQGLTHGFFALTSTYLAGKFPKGRCIITAVCSLISLAGCAIIYGTENKGARLFAFYIFTSFASGIPLSLSLVSSNVAGYTKKATVSALLFIAYCTGNIIGPFLFFAREAPRYTSGFLALIICFSIAMASILLLGFCWKLENKHRDRLQADAPERDEGATGKETSEQAFENDWTDRQNLSFRYVY

SEQ ID NO: 724 - protein, 764 aa, Unknown
  Kingdom: Fungi, Phylum: Ascomycota
MFSEYASKFLAQSQSRLSNFGQPDNPPRTNDWGSSRPSRQQRDGGRGLAPNRSFLSRGLAGSVNPYQQNGSGSRFGNVGFASRISAAQDAPLFHSTLDEYREDDDEEEREREAADLFALQRSRRVAAASKLAESADSDALSRGSLGESQEEHPYQDGGRRGINSSWTGTRSTHKPRPIRDTLMEEAEEVPSKGDQGSEASQGTRGHMVDVGLESQDDPDDDPPESLLGGEAPTDSSPPAFQRFKPQSERTPFMLRRESTRETEASSIPRTSLDADGPVQTTATPIIEGEIFRHDPFFAWLFLIAFAGMLSTFVLVWLHTAPKKSPVGDTVYKTLQKSFDMLAVDTVVAVFVSFIWLAALRSFVRPLVSVILIAVPIIMLSFSLYSFVSSFKGRTHGKSFQDTVMRWASLIPAASCVLWLWLVIKGRRAIQQAIEILQFSSKILAQNSALLLIGFGCLAVIVLWTWAWLAMFTRVFMGGYFSKSLARFIIRFSSWWLGAAFIFMYMWTLSVINAVHRATTAATVSQWYFHRNAGPATPSSEIVLAALQHAATAIFGSICESTLLSLLVRAPLLFLPRRMGMAITNIASFWIPTPVVAMTNPLTITYAAIHSQNLSISARGLDQMEFVSAALPTTTLTPRALRLRGQNNGLLPYRLAKLLLVATRLLMATALGFAGWVITAKQLRIQLPDGMGVRGSAYAYIVGLMASFIGYSVMGAMEGILAGIVDAVLICYGSERRMERGHGRFCLEAAYLFGERRAGDVEGYV

SEQ ID NO: 725 - protein, 628 aa, Unknown
  Kingdom: Fungi, Phylum: Ascomycota
MPVLQEVSNAARVSRILPSRAPPLPRLSRKPDGLSTQEEHREIVVIGAGPSGMFLTLLLARYGVDSSSLLCLDSKPETLKAGHADGLQPRTLEVFQSLGIASEIISEGFHIEEAAFWNPIPAPRAKDGEDSPNHQVIERTSFSPDVNVPSRFPFKVTMHQGRIERILQENLHLYAGEDIIRRSHRFLRFSTDENPEFPIVVEYEYDLPDGTTEQKSLRTKYLIGADGSRSRVRKCMGLELEGGTTSHIWGVCDFVVDTDFPDIRKRCAAPGENGQDADPGKEKKSADRERRDAVTLEYIFEQARKVFAPFKIEMKKGTVPDWWAAYQIGQRMSPRFSAKTSDGLERVFIVGDGMNVSMMDSYNLAWKLVHHLHGLTPLSSSGAADPILETFDQERVDVSRQLIEIDAEWAHMFSGKIGSADAEASGLTHEEFFRVFSEASGFTSGCGLRYKPSRLVRAPDETLSIKHSAECLPSGILVAGCRLSDVQVKRYADATTRHLHDEMPSVGRYYVLVLASSDMLNKTGDSQSAITSSISIMQMFPQDTVDLVVLHPLNQRFEWTDLPRGLKTYAEMRTYGLARKEDAYEVFGVPKNQGVIAVIRPDGYVGTLAPLLGCKEVEAYFRDCLITI

SEQ ID NO: 726 - protein, 475 aa, Unknown
  Kingdom: Fungi, Phylum: Ascomycota
MPGATVNMHDSLAVEVRLLTGCGVEAERCRTVAVSLEGLRLVVAEANHPDMFATIDEMRRCGRLLDGIAQESALYQDRVPIVLDHLNVVLPSLARSLRDITGYWEDTSRSVQERWRCIYHNLEREAGIPLPSRFFLYKSYLLSLRLLLINSRDFDFNQLEADRARIMVLREASGIPAPSTPVGELVRAAALEVTDATPSRSWALGPYLPYGRWEAPPGCCILFRRSFDDHRLTALFYVDAQDGCPYIVLRSYDDVGELSALQPVEPLAGSIAAVGDYVLLDLGSPLTRNVNPKDFSISREERLFQARILDDGFTHSLLVLRDLDTQGLRLQASVYEDELRKCPIWTAFSELLNTTTSHRLDRSARSSELSGADRIRHTAVTHQATSPTWLRRVGRRRFRLMDIHLYVFCSQYQQQNQRRGTAGEFEIEFWHEDCMHHLVLGASAPMGFCFSWGQLADIRMLETVARSFDEFFETL

SEQ ID NO: 727 - protein, 659 aa, Unknown
  Kingdom: Fungi, Phylum: Ascomycota
MKVPRGLLGSSLRSVTQRSAPSFPRNYGIQCLQSWTRGHATAAASVASHGQDGPLQTDQTTASRRERLKDAKPFSDFLTDTFHRQHDYLRISVTERCNLRCVYCMPEEGVDLSPSRDLLTTPEIALLSSVFVSQGVTKIRLTGGEPTVRRDILPLMHQIGALRSQGLKEICITTNGLSLHRKLDSMVEAGLTGVNLSLDTLDPWQFQIMTRRKGFDAVQRSIARILEMNKLGAGVKLKINCVVMRGVNDREIIPFIEMTREKDIEIRFIEYMPFDGNKWNKQKMFSYEEMLDTIREKYPSLQKVQDHKNDTSKTWQIPGFLGRIGFITSMTHNFCGTCNRLRITSDGNLKVCLFGNAEVSLRDILRKSNNGDPIDEQAYEAMKQIEMDRRQGLTSPDQALGVSPNEAELLEVIGIAVKGKKAKHAGLGTLEHMKNRPMILIDPAPTSLLHMSPGAQKLVRTAFPSVTGPFLSRRFVSSTAPRRSSKNDRASGEDEEVQPRLTHVTDSGAAHMVSIASKTPTSRTAVAACTITFSDHTALGLIRTNQNKKGDVLGVARIAGIMAAKRTSELIPLCHPLMISRVSVELQMPKEDGGERAIEVRATVECDGKTGVEMEALTAASVAALTVYDMCKAVDKRMVVGGLRVVLKDGGKSGRWEME

SEQ ID NO: 728 - protein, 608 aa, Unknown
  Kingdom: Fungi, Phylum: Ascomycota
MRPLSSGPDSDTHLGGASRSNLSVMPPSPQLSCFITTEAALDSAGSQQVNHPHRVGRWPHPKRSLDFAFQSSRTTDSSPAPAPHSPASLSSSVLDDDMLHEQLPPLTPVLLGLSGPASTISSSSSRRNSLTASSCADKDSVARSTRPSPPHSPRRRPRPSSQQGAAESPESQLIMPSLTVPPRRSFSEIGRAIGKLKILVTGPAGIGKTSLINSITRCCDHIVHVDTPRSSSTPATETFASTKPQPKWKTELELSALTRRRRSSLTPSDEVLDRNVCFVDTSGHTSAVRPMHVALQYIESQVTPLLYKSMDDSDLWSLLVSGSQPAVDVVLYMIPSTGLEATDIDAMKRLQNYTSIILLLARADEFTDAEFSTARSDLHATLKQNDIHCFSFGGPTAAPELYMVSNKTCSDPDEMDASTLMQSEYRQPLIQSELQQLVDPLKILKWCTQHRQTRALQLVAHPRAPQHVHFGGLHGMDAFAAAQWWQRVEVTDWAQSLRRSLDSQHSGMVFPTGTLEIASGEPARSVVTREKGRKHRSRPGPSPTHQDPLGLLNWLSHARQGGRLTAELLSGLGVAAVVTAWLQMSDSACHREVAQMPRGLIGWWWDIM

SEQ ID NO: 729 - protein, 297 aa, Unknown
  Kingdom: Fungi, Phylum: Ascomycota
MPQKTPANSSRRATSEQAIDALEKTNASLVADCDRYRQRNERLQDKVAKFEDKSSKQEDKISKYEDKLDAANRELRHAKDEIKRLMAEIQLTAGQKDTLEKACKQLRFEKETMDNIYTSLKASYENLMMKYDAIPEERRNPMTAAALPERSKRSATASATSGGSGASSRAQQDSDRGRSRRADKERLGARFETTATPTSSTTKRPPLTSANRSSFIEGYGSSRRRSGSAAAPLSRGVMYESVAHTGRFEDPVVSPREAVAFSTVPRRVPSNGGYHSGSSGLLDDDYEDGDYHIRSIH

SEQ ID NO: 730 - protein, 1946 aa, Unknown
  Kingdom: Fungi, Phylum: Ascomycota
MSFGGFGGFGQNNNNQQSGSAFGSGGGFGQNNNTTSAFGSSNTGGFGTNTSGGGLFGSNTNQQNTSTGFGSTGFGSNTNSAFGANKPAFGSTTASTTTGGGLFGGSSNTTTTGFGSGSGFGSTTNNTFGGGSSTGGGLFGSNTNQAKPAFGASTTTGGSLFGGGNATTTSTGFGSTGFGAAAGGNDPPGTGTTPFQAYTEKETTTNTTNSFQNITFQDPYKKWSAEELRLADYAQGRRQGNPSGAGAFGQSSGFGAFGSNNNTAQTSAFGSTAAKPAGGLFGSSTPSTTTGFGQTNNTGSAFGSTNTGGGLFGNNNANKPAGGLFGSSTTTGTTGGGLFGSSNNTTGGFGSTNTTTGFGASTTNTGGGLFGNNSNQQKPAGTGFSFGNTANNTGSAFGSTTNTGSAFGSNTATNTGGGLFGNNNQQQQNTGGGLFGNTNNQQQQSTGGFGSAFGQQNNQQQSGGLFGNKPATTGGGLFGNSTTTTNTGGGLFGNNNQQQQTTGAFGSTNTTGGGLFGNKPATTGGGLFGNNTTQQNTNTGGGLFGGLNTNQNQQQNTGGGLFGGLNNQNQQKSSLFGGSTQSSGGGLFGNSTQNQGSSLFGGNNNQQQQNQGLGNSLLGNSQQANNAPQGLTANLNDVSAYGSPSLFAGVGGNEVQNPGPLATSLNGNSKPRRGSILPMYKLNPASASRFNTPQKRGFGFSYSNYGTPGVSPASSISSTPGTANLGRSLLGAASSSSGLSKSMSTNNLRRTYNAEDTILNPGAFSSSSGARWYGSTGSKKLVINRDIRSDLFSTPQKDKSGVDSNPGSRKLAKKVSFDTANVEPEEGTPVRAALPAPEDVQDETPRQTRPSNNAPNGSRTPEVEQTKNTELGIVHEEDNSATPEGNSTTGFDNAPGRYWMSPSMEDLQNMNRMQRQKIDHFTVGRDNVGSIEFKVPVDMSSIDLDEICGGIIQLEPRSATVYPIAAKKPPVGKGLNVPARITLEQSWPRGGRDRRATTDQKRFTKHVERLKRITDTTFESYDKDTGVWIFSVEHFTTYGLDDSDDDDDLEPMDETNNSLPVIDPRQADFEESDDSNMHDDTFDFRRPRGVPGAFDGQEEMYEHEKPLHQSFLGVSSADSAPRDVRLALEVDDDQYLGEEYDMSDDEEMARSSVGQHLAAEHDDFSSEEGPVAKVGTPGGILRARMRAMKDSAGPVKLEVADGDDWTEMLRKTVSPMKRDRQQLREYNDSPSRQPRFNDVEIDEEGDRKTSIWRKSVVKPNQTGGMAASSRLAAADKGRGFATSIDLMNSLFEKPKPKPMAQSMRVSTSSKGFPKWPYERQDKTLTMDEMEQAFHDASRPTWGPRQTTRDGAGVLAFQRPHVQTDRQSIRFANFSTQPSKKYLRAQDQFTKIHTVRDIPVASLEVSRVRDIFHNEDKNDPAIAQEQRVWELASILFDSIDPDTTELDESQARRQALSEYWTDLVRESSTKNTGLAASSEEKAVACLAGHRVAEACKYLLDSKNFRLGTLVALIGSSDAIKKDMREQLKVWRDSKMLSEFSEAIRTIYELLSGNVGVCEGMKSVPAEDRIESFVISNKFGLDWKQAFGLRLWYAIAKQDDLSMAVRKFKSDVDQERESIPRPWYADQGIKPLWEDDDESSRQDLLWGLLQLYADDNTDLEAVLRPENSQLSPFDMRLSWQLGLALVSTGKVSYGSNAVEKADATTLAYASQLTSAGEWLEAIFVILHLSNPEARSRAIKEELCRHAGEIGPESGANFAALTQKLQIPSAWVWEALALYMRSVKKDASAEVECLLRAGSFDEAHRVLTNEVAPRAIVERDYAALSSLIAQFEGHHGTISGWSSGGEIYSLFLNLLQHRSKGENTQPIILDKLQAGLHAMNAEVPETDLMRYAAVSDMADETAKEILKLGKKKQDSELRSKIMSLPLTQDRRLAYSMDLGTKRHSEVMSH

SEQ ID NO: 731 - protein, 426 aa, Unknown
  Kingdom: Fungi, Phylum: Ascomycota
MHFFTLATLATTVAAQLDLYSTLVSDHELSTLSELLALVPDISNSLAAASNITIFAPTNAAFASVPRDIPEGEAIEGKNDTIAIGALLSNHVFKGYYPAEAVTDTPLFLQSLLDSSFYNYRQPFGNFTGGQYNGVVRDGDHVAVISGELTVSYVTEADIKVENSVIIHKVDKVLSFGPPLQLFTRRDGLLDFNAAVNAADLPYAFGSLDGSDATKQNISDFTVFIPNDAAFEAIGSVLEGADQKTLQEVLAYHLVDDVVFSTQLANVTVPSFQGADLTITVAEDGSAWVNGAKILFPNVLLFNGVAHIIDGVLNPSNAPFDRADIKLKADASDRVAFPDASAVSKLPFSSISYADDSATYSTPELLKTMLVIDPRATATVTTTTSNAEETGASVTGEPTSVAEAVGSKLVATGAAVAALVVALFMV

SEQ ID NO: 732 - protein, 1112 aa, Unknown
  Kingdom: Fungi, Phylum: Ascomycota
MVPRIWALLCIVLLLQHATAQSFRIVPRQDGGTVSVSATASEERAEATGTASRSVEGEESGKTEAPSSTDSRKASSTTSESEPTSTGITTNGPLDDANFINSTIPEGQLPLQPELTPGFGVAGAVLLCTGVAYTLVGIKNRWIHTFFSSAYLAALGITVLLVYIMKVPVGNALQGGYVAAVILPACLLGGASVFFKELTEGLGCALGGFCLSMWLLCLVPGGLLRPAASKAIFISCFTLVGFAFYFSRYTRDWALILMISFAGATVSVLGIDCFSRAGLKEFWTYVWDLNDDLFPLGADTYPVTKGIRVETAAIVIIFLFGIISQIKLWRIVREQKQKRAAERAAEQQDLEQQEADLGRRVEDMNARERREWERVHGDGEEAGSSLGSDAISEKKLRDSVAAQSSRDNAPGEVIEMSDMSEPDQSRGPAPLMEEQDKEGKVTIRVAEDDTLPAPSGDEEVLDEKAECRRVSMANMPVSSVPSITEAPEVVPLPFNVPQEDDAQSRGDRSSVATFADEEGTQALAAPHRQSLAKRFSQSSGKLLRSFSQRSGLSGGGIHGPHGGSSEDLVAPRNVRRHDDDVSVAATLDDSVSGDDRRLSHISDGQRKSIEITAELSDPSPKAEDASQCAGLTPELKQDAFSGAQSPALPNSPVPENEASRVDAAGTEAGESLPAPPSERPPKSAASAVSTPVSLTKDRLPRSLSKIALSYRTNEWAKHLSHAETPEPEQLDVAAPSRAVKSKKERATEEPKPVNVEELQQTAADGISPAAPVARATSKASTAAPATKRVSRQSSSGGLEAADDAGLQRKDSTLSNPKGLLRSASNNTLRKSSNFQPIAEEAPAPIRSPVIPEEAPPADIPTARSSPSNRSEPFRSAPVPGIVSYDSPQTLIGQREMFLRSRSQGNLLASPSDLNLNMSASSVTRTPSESGSLYNYPMYAAALDADDLPLSQRKEFMRQSSMMSLTGPSPSTHRMSVGSDSAPNFDSHQPKRGSAIPSQADREARLASFRSSVAQDLRSGTALLAPSGRETPFASTHSLLAGAGGREAEVQRNIEMQRTIMMGQREAEGHQREMARRQKELADRAFDERMRSGDLLEAHREAMRKMQRSAKDK

SEQ ID NO: 733 - protein, 485 aa, Unknown
  Kingdom: Fungi, Phylum: Ascomycota
MSSTSSATTSPSSAQTANFAALSPLTTPDPLRRSSRHRPMSHASKGRLSQYSTGSGPSRSRPSSHVFPMYPSTLPYALVRDFAYPVVHPMHYGAPPDPPSGMTTPASEQRRLSDPPANWEQKMPWDSWTADGFGRAHDIPPIQFGDGPPYSEDEDLQSPIVATRHRKHKSTSATMGAGRGRADDGHMLNAGHYDSERGYYVGTAGDGSERYYVSHAGDTNGPSGEFVTYPPGEARRSRAYHFSRQQHAGDDSYRSESEDSHPSSPGCANEDESRYSRDYQFTITSPDEEFHGKAVALFDFVRENENELPLAEGQIIWVSYRHGQGWLVAEDPKTQESGLVPEEYVRLLRDIEGGMNSLTGLTDGADEVGTPTQAEHSTQSGGTVAQGTAANGYHQPVVSSFSTSSKDLNPYPTEQLGLPAGQAPPQVVHYHGQKGGSQANTPTMSQHNESAMRRGSNDSNNDASNTTPTEPTKSAKESGAFGKEG

SEQ ID NO: 734 - protein, 572 aa, Unknown
  Kingdom: Fungi, Phylum: Ascomycota
MSVFFKDISPDNPVKKGDAEALLADFGVTLDPADSSDFHQLLAAVHDCAEHINSLPDYQPVPDFKRYPREDVHLPRDDEQTLGHAWAHKVLIRGNVDPSRELSLKGKTVAIKDCIAVAGVPQFFGSDAFPAWTPETDATMVTRVLDAGADIVGTATCENFCNSTSSFTSAQGTVENPHQTGYSAGGSTSGGAALVAAGLVDIALGSDQGGSIRVPAALCGCVGLKPTHGLVPCTGMTSGDAVDDHAGPLTRTVHEAAACLDAIAGYDGIDDRSLGAAKHGSYGFATSLLRPPNAEPSDTLAGFKIGVLREGFNIDIMQPEVAEMVKSAAAKFQRLGAAVQEVSVPLHLEGPAAWTIQQRISGAMGVLGQAHGHRGLYLTEFEHARLPWTTENFARLFPSTKNTVINGLYLAKKFPGLYGKTMNLARRISDAYEAIFKQFDVVIMPTTPYVAPKHGIRGTPKQCFEPSIGLTSNTAVFNVTGHPAMTIPVGFAPAREDPSVQLPVGMEIVGGLWQEKKILRAACAWEAAFDWKSCRPESVSTSRQVSEYASESSVKMNGCSSPIDVRALSVEA

SEQ ID NO: 735 - protein, 1418 aa, Unknown
  Kingdom: Fungi, Phylum: Ascomycota
MTSQRGLNAVRIGIDVGGTNTDAVVLDTSLHATPTRGVLAFHKVPTTQDPSDGIHQALEAVLFKLPVPHPKISCVAIGTTAFLNSVIQRDAQFLDRVAVLRLSKSFLRDVPPFSGWPKDLAALIHGYVGYIDGGLTIDGSEEAPVNVDQVIEQCSNIRKIGISTIVITGIYSPIDVNHHQEDTVRRIILQHLPDARVVCSHEVANIGFLERENTAILNATILRHARRTISSFQKAITELGLRSCPLYLTQNDGTLLDVNAAAKLPIRTFSSGVTNTMRGAAYLSGRGVDALARESAVVVDIGGTTTDVGVLLPSGVPRQASAYVSVAGVNVNYTMPYTHSIGLGGGSIVRQAGSHTHVGPDSVGHNIDRSLVLGGDTCSAMDIAVASGYAAIGDADHVRSLDAALVQGAREKIQSLLEKAIDAVKTSPELIRVYMTGGGSVIAPSTLKGVLEVVKLPFFDVCNAVGAACAKVGATFDAIQPAARKTHSEISAAAEAIAIARAVENGAIRDTVVTTKVEVIPIPYLENQVRVVVAAMGDLDLARLGEREVEIDTISHKEEGQRHEQSHIAPSHMTANIGESEVNHSSYRPNIIHRAAKVGREWLISRTDLNYIADGCYVLGCAGGGNPEAGKMQLQHMLAAGETIRVIEVSTLDAAASVYWGGRMGTPAAIAERLQAHETVDAMRALMNHLGETSFDAVMGLEIGGSNGLEALLCGSSRFFDRPVLDADFMGRANPMCWQITLTVHRPGEFVPCAIDSGDGQTLIMTRSKSDESVDKPLRGALVEMGSLVGLAGRPTTVGIVRQHAAKNTVSLAWRIGRAIALAEEDVSIAQAADRIIAEVGGPDSAKVLFRGKVTAVERTLHKGHSVGVLHIAHASMDESTGFETTRDVAIGGVLKIPFINENILAEHHAEDGTVKVLATVPDLIALLDTQTGRAVGVPEYKWTETPRGLEIGGPRSYGYDIEYKPIGKYTEPRSVLEDSAQHPHSLAALRAICPRSHQRATDVRCTTNSGMDGLHDDTPLAHIFHVWERFEQVVLERPWSSALTSLALMSLIRSRQYLDVLAIIALVSWLGGVSTPFAYRNGTHVLIGACVLISVVFIGLAWCSRRTKPDRTSHLVIQGHPQTPGRRATSLEIALEGVFKRYLGDLVRQSSSSIVIEYNPAGVSATQSTVFRAKPGEVDAAKMIFSVLTPEFYTRFVHYAHDSEAIFSELAESRTISVDRPELLPDVFLKKGSKALHAQTLVDFLCFELIRKLRRRPRSLARSSPANAAGTRSMYDIRGFRISSMDARLASARMVGIGFAFHKYSAAHLTPYEQRLSLWEGEVSLVPVPMELAYARRPMQDDLELFGEDTLTRIRAKKSMHPLFFEALDDFPLIRVTIGTGGIRTTAPAGQHGGASSVFWSEQGNPQRASSIMPGLA

SEQ ID NO: 736 - protein, 534 aa, Unknown
  Kingdom: Fungi, Phylum: Ascomycota
MSSTHSEPADPLAKGILPTIKQSWKDLFIWKKRVVVSNAYGETRCEWQEPDRFINPFSLFAQLSWRDWLFFLVGFLAWTADAFDFHALSIQTKKLAAYYGRSKTDITTAITLTLLLRSIGAAIFGYFGDKYGRKWPMVANMIILGLLQIATIYSETFQQFLAVRALFGLFMGGVYGSAVAMALEHCPANARGLMSGILQQGYSFGYVLAGCANYGAGGATNSWKSVFWAGAGFSIAVGLIRVLFPESKQFIEAKKAGKNNASPGAFWRETRVMLRSEWKMCIYCIILMTWFNYYSHTSQDSYTTFMLTQKEMDNSAATRASIIMKTGACVGGTIIGYCSQFIGRRRAIVLSAFVSGLMIPAWILPTSERALSATGFFMQFFVQGAWGVIPIHLNELSPPSFRSSFVGVTYQLGNMISSPSAQIVNAIAEKTFIKTRNGDSVEAYGPVMGVATAIIALGIMVTTAVGPERRGRTFENAVAGVDTEVAGKVAEAEKTVDEEKAATVGDHYEGSEHGDEPISKVHTNGTTDVAREKI

SEQ ID NO: 737 - protein, 251 aa, Unknown
  Kingdom: Fungi, Phylum: Ascomycota
MATSKVFIVTGASKGVGAAVTQHLLDLSHKVVITARTAEPLEAFKKANPGRVEVVAGDITSPELAKSLTSTAVSAFGRLDGMVINHGVLEPIRMSDETVENLKYAYDVNVFSCFAVAQAGLSELRKTKGSIVWVSSGAAVKAYAAWGAYGSSKAAVLSIANHFAVENPEITSVSVQPGRVDTDMQALIRAKGQASMDKDQYQSFQDVHQQGGLLKPSQPGNVLAKFVADPVHELSGKFLSWNGPELAKYQS

SEQ ID NO: 738 - protein, 661 aa, Unknown
  Kingdom: Fungi, Phylum: Ascomycota
MASPVGSSQSADVKNKRRRVSVACLTCRGKHIRCDGVQPICGYCELNGTSCNFAYAENKRRPPSKKFVESLQARIRHLEEQLQAATEARAPSFYEPVWASDESEHEENVSSGEQDEKDPLAELTGLVGRLNMTDDGQVHYFGSQSSYNLVKRSLSDARPALQSLRMQKQGLDAAVRLNRLVTVSKELQEHLLDLYWQWQNPWNYIVHKDSFMKSFRGEDDGRNCSPVLLSCIFALAARYSDAVELRTDPDDPTTAGDAFCEQAKVLLLFESEAPTVTTIQAACLLALRIMSDGKEALGWLYAGNATRMAHNLGLQVDISEVDGKTSMTEEEIEVRRVTWWGCYVVDKLFSIGLGRPSSTSKSTITCAKPQMNGGAEYTPYSPNKRLSIKEIEAIVTKADVELRSRYAALPSYLRIPSSMRSPMLPHVCLLHVQYHSQLILLHRPLLRNRRKRQKSTGGDVSEEAAQQDDEAKNAHMETCRQSAAEITRLLRFYKQQYTLRRIPIAAVHLCFSAAIIHLIDARPSSSNRHQAILHLQTCVEVLRDLRVAWCTWSDRATRAVQVLASEWYGVSDIAQLHARPGPGQGSCDHPQETSWTNYSLDPSHSTTTMCAVPDHFDLGLQGDTGADSFLYYASTPALFIDDMLKEWIDDGVFPFDEQKSG

SEQ ID NO: 739 - protein, 130 aa, Unknown
  Kingdom: Fungi, Phylum: Ascomycota
MLSQLSRASRARSAVAAASRAAKANGVQVRSFIAPTVSRRADFVQELYLKELKSYKIPPVSESDSVGQVQTFSTPATPKSPEEGDLAGSLKEYETMAVEIEGQDAAAQTSGAPAALPDWLETEEEEEAHH

SEQ ID NO: 740 - protein, 428 aa, Unknown
  Kingdom: Fungi, Phylum: Ascomycota
MTDTDVPDSTDWLSTPLNALAAVEASLRCQVCKDFYRTPMLTSCSHTFCSLCIRRALSNDGKCPLCRAGEQELKLRSNWSMEETVEAFMKARPDVLKEARRRETSPKRKANATDGLSREEDAPANKRVRTSARLSKSRAEARASQPVEEEEVIFEVPDDNEADETYTPENNDGLVPCPVCNNKMKEWQVFKHLESCTGPPSPNTNNNNTSSGPSTFSTPFRKPSTTTFDRLPAINYSMLKETALRRKLSELGISTTGTRALLEKRHKEWITLWNANCDAAKPKKRRELLKDLEVWEKTQGGGGGSAGRGGGVMVKDKEFDGRAWGSKHGNEFRELIESARKSRAKAATGQTKDKVDEEQQAEVEKPQDDAARTDVIQEVPSSSPLDEDDAFERQTAEEMDMQVSLRDLAAIKRKRRGSNDWENIIPIG

SEQ ID NO: 741 - protein, 580 aa, Unknown
  Kingdom: Fungi, Phylum: Ascomycota
MDVHLLVYDLSRGLAKQMSMGILGFQLDAIYHTSIQLQGREYVYDGGIVSIVPGSSHLGQPMEKLHLGTTSLPMDIIEEYLDSVRSIFTIEAYDLFRHNCNNFTDSFSNFLLGKGIPAHIRDMPQAVMNSPMGRMLLPQLTQGVNASRQNGSILGLQNTSRPAQPVSHSSTSTVKIPRDSAEAQKLLDEASSSCAAVFFTSATCGPCRPFYPVFDQAAEELGEKATLLKIDISQPQMMTIAQKYSIRATPTFVTFVKGKEEDRWSGGNPGSLRSKLQLLVHMAFPPHPHEVLRLPTFSGSDRKPVLYSKVPPMEKLMAKMAVDTAGKPEIRSLRAYLETREKDGLSDAVLPNLSQLSKLVQDSLKSLPIEGLFPIVDLFRCALADPRISAYFVEEQDHQAIRAVLQFVNDSTDCPYALRLVTIQMACNLFTTPLLPDQLLRSADLRRGVTMLISSSFLDEAHNNVRVAASSLLFNVSVTVRQSSSGSVSESALPEEDQVELAAAVVEAIGQEEKSAEALHGMLLALGHLVYGTFMDGELADLLRALDAQSTVSSKKNAFTNEKLIAEVGDELLGKGLRRP

SEQ ID NO: 742 - protein, 339 aa, Unknown
  Kingdom: Fungi, Phylum: Ascomycota
MSRYIEQLRQAYPPKPDFTEKDLPDLSDKTIRLLLTAGLQVYLVTGSNTGVGKDLARLLYSKNATVYVAARSEEKALKAIDDIKVSAPESSGKLVFLRLDLADLTTIKASATEFLSKESKLDVLFNNAGVMCPEQGSKTAQGYELQLGVNNVGTFMFTELLTPILIETAKGAPENSVRVVWVSSSAADVPICPTNGVDMDNLDYHKDKGAFHKYMVSKAGNFLHATEYARRHAGDGIVSIALNPGNLDSDLWRTRGWAVSTMLKSFFLHPVIYGAYTELFAGLSPAVTIKHPGDWVVPWGRFASIRPTLLRASKPTTDGGNGTAQKFWEWTEAQVKPYM

SEQ ID NO: 743 - protein, 288 aa, Unknown
  Kingdom: Fungi, Phylum: Ascomycota
MPRPPLAENRVLKIVNAARDGNYAVPAMCCYNIESVIATVRAAEAAKSPAIVQLFPWAIEYAGNALVLAAAEACHSASVPVALHLDHCQTPELVRRAASIPDGFDGIMCDMSHYEKEENLALTKELVQYLHDRDICAEAEPGRIEGGEDGVAETADLEGVLTTPEQAEEFVATGIELLAPAFGNVHGSYGPRGIRLEYDRLESVNKAVGDRVRLVLHGADPFDEEIFSRCIRAGVVKININKGMNNHYADVQKEMEGKPLTAVIEAGTKRMQEAIERYMKWFGSAGKA

SEQ ID NO: 744 - protein, 310 aa, Unknown
  Kingdom: Fungi, Phylum: Ascomycota
MSLTNCRFYEEKFPEIDSFVMVNVKQIAEMGAYVKLLEYDNIDGMILLSELSRRRIRSIQKLIRVGRNEVVVVLRVDKEKGYIDLSKRRVSPEDIVKCEERYNKGKLVHSIMRHVAEKTNTPIESLYESIAWPLNKKYGHAIDAFKLSITNPEVWNDITFPSTPIADELKLYISKRLTPQPTKVRADIEVTCFGYEGIDAVKTALRTAEAANTEDTQVKVKLVSPPLYVLTSTCLDKNAGITRLEEAIVDIRKSIEGAGGHLSVKMEPKAVTESDDAELQALMEKRERENAEVSGDESLSDSDDNIPETI

SEQ ID NO: 745 - protein, 501 aa, Unknown
  Kingdom: Fungi, Phylum: Ascomycota
MSLLFRYLTPKAYTTMSKLENTIIPVHTDEPSADPLGIMNNTNERSLTDSNQRTRNQFRPRVGKGGSTSAQLRHYAEVTLGGGSLRKVVALPEGEDENEWLAVNMVDFYNQINLLYGAITEFCSPQSCPEMKATDEFEYLWQDNENYKRPTKMPAPVYIEHLMTWVQSKIDNEQDLPSKIGVPFPKSFPALVRQIFKLIRELGLEPHLNTSFKQLPEKIVASILRHRPTKLPNLSHDENRASRLPGSLLPYNTIHHQFHLPPSSILLPLGPAKSTTKMFSRQAIRSVRAVAPQRALAFRAPVRSYAAAADAQPPVAVFGLDGTYASALYTAAVKSSSLDPTAKALASLGALLEKDPKLSTILTAPTLSSQDKSAIVAELAKHSGAGKEATVKNFLDTLAENNRLSILGGVCQKFGQIMSAARGEVEMTVTSAQPLDNKTLNRLETAVSKSSYVGQGKKLKVTNEVNPDIVGGLVVEVGDRTIDLSVSSRIAKMNKLLNDTL

SEQ ID NO: 746 - protein, 297 aa, Unknown
  Kingdom: Fungi, Phylum: Ascomycota
MVQVLFDPTQSQTGSLNRDDVKSQASQQSVSREEHAQLMRDLAVKRGIRAPRRGWSMTESPQSGYAERRHITHESTLGSVSETSSSSGMSTPVSEKPLDDALGQLPLPVHLPARPKLPPPRRSYSVQDYEPLPPLQPKPSSRMTILDLPSELHYTLFDFLDPIDGVCLGLAHPRLHDIAKRKYGQHVSLASRYSGPNDMEWAWRGAGPLVRSNTGGLAARGYEDSKLRPKGQVYCRKCGISRCELHRHLKEWMGEGREYCEIKKIFGKPAGKDAKTYCYMSSPKDPHRCGRHGPRRK

SEQ ID NO: 747 - protein, 495 aa, Unknown
  Kingdom: Fungi, Phylum: Ascomycota
MLRRAAGALRGGASRPMRPGSRRASARASPSSTTGLQSSFIRPGWAIGVLVAGGAGYYLGKGDAPLTATRVAARPGGGRVQAPGVPADASEHEVPVESPVEALDLAAADAKIRKQTSSFVFASDAEGGRGRVDVVRVSSNNPVEDEWAVGFGRGIGGAGALYAGVYDGHAGWATSAVLKDALIRYVSSSLTKLPASSDEPSVDAAIQSAFVRLDDRIMATARRALNADYEHGAAAAIRALAPAIAGSCALLSVYEPSSRTLRTAVTGDSRAVLGSQNPDGEYVAEALSKDQTGFNADECARLEKEHPGELADVIDLKSGRLLGIAVTRGFGDHRWKWSNEDVSSAQGRFFGFGPRPKVKTPPYMTARPEVTTRRVSSDDFVILASDGLWDVMSNDDAVACVQRWLAAKRRGRAEDVKPMESRLTIGQGGYGSWKATPDAFAIEDLDSAAVCLVKNALGGRRRTLFCGAATAGAPQSRYVRDDMTVQVIFFKDPYA

SEQ ID NO: 748 - protein, 483 aa, Unknown
  Kingdom: Fungi, Phylum: Ascomycota
  misc_feature (177)..(181): Xaa can be any naturally occurring amino acid
MTLLGSVAARARLPTSDRAVVNVWINDDIRPLEPERRTWTTWTFVSFWLVNQIAISNWQLGASLVATGLSVWQAVVATIMGKIIIALVAIFNGHVGAKWHIGFPVISRYIWGPYGSFIAIVQRIILSLTTQDQGAAASLQRIGVDNSDLDDDLGSRQGRGWRAAAVQGNIRPELVTXXXXXLTNANDYTRFARKPGDQVFGQWFSIIFFGTLFPLFGCLAASATQSFWGEAVWNPPVMCQKWLDENYSPGGRAAAFFAGVGLVLCQISINVVDNAYSAGMDLAGLFSSYLNIRRGAFIGLVLSIAMCPWELLSSAAVFISVLSAYSVFLGPIIGIQVCDYWLVRRRKVKLTDLFDPRPGSVYYFWRGFNPRAFAAWFLGFATQLPGFAAAVTPKQVHVAAAWTHLFDLAFPLGFAISFVAHYAINRFFPPVGLGQMDLSDEFGTFTPEEARNIGIETCIEGKDIGSESFGGKPPDADTIVTKF

SEQ ID NO: 749 - protein, 204 aa, Unknown
  Kingdom: Fungi, Phylum: Ascomycota
MANPRVEELPDDEVPKTNVEDAGDDSSSESEIDAGEGNLAAGSTTVVHSRNEKKARKALEKLHLTRIPGITRVTLRRPKNILFVINNPEVYKSPNSNTYIVFGEAKIEDVNASAQQAAAAQLAAAGAEGDHAGHNHGDDSKVPETTEAKKDDDEDDGEEVDAEGLEDKDIELVMTQANVSRKKAVKALKENDNDIVNSIMALSI

SEQ ID NO: 750 - protein, 352 aa, Unknown
  Kingdom: Fungi, Phylum: Ascomycota
MTAWNIFRILGDLSHASSKCILIFAIHRNRSAEGVSLITQLLYALVFCTRYLDVFVESYVWNLVFKIFYLLSSFYILGIMQWLYPRSREREIAWKLGAIVLGGSLILSPFVMMIFERSWGFMRANTHWEWLWVFSEILESVCVLPQLLLLRQTTVPTVIDSFYLLALGSYRALYCVNWFVRGLDPDDHGIDTVSVIFGIVQTALYLDFFWVYYTRQRVKLRGGGIVDADDMRHSWLLRRIFGNKRFQPEDDDDEESGPALGGNGQQRRTRPKWGARGISVSADDGVLDVDRRRGSEELDGAVDPDAKMQDPDELAKALDDDPLEGPSSSSSSAAHLDQGTPSGLRNGDEWRD

SEQ ID NO: 751 - protein, 125 aa, Unknown
  Kingdom: Fungi, Phylum: Ascomycota
MAGNFEEVAKQFIEFYYNTFDGDRKGLHSLYREQSMLTFESASVLGAAPITEKLAGLPFEKVKHQVDTLDAQPTMNEGGIIILVTGKLLVDEEQRPMNYTQTFQLARDPSGTYFVFNDIFKLVYG

SEQ ID NO: 752 - protein, 489 aa, Unknown
  Kingdom: Fungi, Phylum: Ascomycota
MQPPIPVLADYGISPVHGFLPDTLPLSRLPDPYYNKWEAIVANLQALILSRRLRGVIDRLPILSTIGLEHDAEWRRAYSLLGFMAHAYIWGADTPSDRLPPSISVPLLEISERLEVPPVATYATLVLWNFKPLFLDEEIDNLENLATLSTFTGSLDESWFYLVSVAIEARGGPIIPLMLNAIAAAQRGDVILVTKCLQAFAERLTDLTTILQRMHESCDPTVFYHRIRPFLAGSKNMAEAGLPNGVLYEDGSGTETYRQYSGGSNAQSSLIQFFDIVLGIEHRPTGEKPNPGSETEREYRAAQRHNFIRDMRRYMPGPHARFLHDVALVANIRDFVEEHTDNRQLCIAYDACLTMLSAFRDKHIGIVARYIINPSREVRARSRSRSPEVTRRRQNIAVSSRKEQDGEKKRGTGGTALIPFLKQARDETGEPAVEEWTRKFMKRKIKSEGVGDFFAGKPEEGAPVEQDVEVKGLAWSWTMDDEVGGICLY

SEQ ID NO: 753 - protein, 575 aa, Unknown
  Kingdom: Fungi, Phylum: Ascomycota
MGAAPTGSGTAVYDAVLHRRQTLMGASGARALLKNFRVFAIASFACIGGVLYGYNQGMFSGVLAMPSFKEHMGEWDPFDDNASQTKKGWLTAILELGAWLGTLLSGFVAETISRKYGILVGCVVFILGVIIQAISIHAGPAAILVGRFITGMGVGSLAMIIPIYNSEVAPPEVRGALVALQQLAICFGIMISFWIDYGTNYIGGTERGKQSEAAWLVPICLQIAPCLVLLFGMSFMPFSPRWLIHHGREDEARRNLSRLRGLPEDHELVELEFLEIKAQSLFEKRTVAEHFPQLREPTAWNTFKLQFVAIRSLFKTRSLLKRCMIAGVTMFFQQWTGINAILYYAPTIFKQLGQSSNTTQLLATGVVGIVMFIATIPAVLWIDRLGRRPVLAVGAIGMATCHIIIAIIFAKNADDWPNHQAAGWGAICMVWLFVVHFGYSWGPCAWIIVAEIWPLSSRPYGVAFGASSNWMNNFIIGQVTPDMLQKITYGTYILFGIITYLGAAFIWFIVPETKRLTLEEMDIVFGSEGTAQADFERQEEINREIGLTRLVMGSGGHTPPHEPEKDEKFETSEHV

SEQ ID NO: 754 - protein, 501 aa, Unknown
  Kingdom: Fungi, Phylum: Ascomycota
MPRRPSPVQETTSPGGGTTTTTTTTTLTSTRSRTVPGSCWPCKKRRVKCDLGKPICQRCLSLGAPCDYNTRLIRWSKPASSASPPPSTTTPSPKIRTLTPFSGSDRRLGSRERLALDYFHSRVWPLLSTAEEPCPPPIPVALEHRAVLLTTCLLAESHRFLQDGAGDLDHLNDQRMECLAAVRSDVDECCTSVARQAGGQSLLTLLFAVLFLYIDDGFMECMRRHASTWSHHAGVLAVLKSMGGMEKMLTTGPEALQMLLSEFASADLTTAVLQTKRPAVSPPTWDVIDRGAVWWGLDDMRRYSLASTFKHLSEIAFYIDDIAHGTDSLSMGRIREFEIALRPMNAPISVRDLHLAGALDEKAATDTGEPDGDSLQLLTLLRAFQHGALIYLYRALCGLSASHPLVQQHVQSCLEAILEIPPEAHALNCVIFPLCIAGAHAGTEKQREVVLHMVNKIHENMKFAAVQLVRMLFHELWTSGDAHALTWRDMFAKLGPHVLIL

SEQ ID NO: 755 - protein, 407 aa, Unknown
  Kingdom: Fungi, Phylum: Ascomycota
MFASSKILKPSAISPLITTSTRQLCKATPASLLQRTQQQTTVLRAFSRTTNIRHKMAPQIPSEQWAQVLEATGKPLHYKKIPVQQPGPDEVLVNVKYSGVCHTDLHAIKGDWPLATKLPLVGGHEGAGVVVARGELVKDVEIGDHVGIKWINGACLSCGYCMRGDEQLCQSATMSGYTVDGSFQQYAIAKAAIVARIPKECDLEAVSPILCAGITVYRGLKESGCKPGDTIAIVGAGGGLGSLALQYAKAMGLHTIAIDGGADKGEHCKKLGATSYVDFTKTQDIVADVKAATIDGQGPAAALLVAVQEKPFQQAAAYVRSKGVVVCIGLPADAKLSNPVFDTVIRMVSFKGSYVGNRADTAEALDFFRRGLIEVPYKTVGLSELQKVFDLMEEGKIAGRYVVDTSK

SEQ ID NO: 756 - protein, 1121 aa, Unknown
  Kingdom: Fungi, Phylum: Ascomycota
MGSVLEKNSEQVRKRIEKHTFEDEQGEEYEGSEFNGFGDYFRRKKIKLQNLDADVRSNSDKPQIFKGIVAHVTGYTQPPLHILHKEIVLHGGGFLQYLDSKTMATHIIASTLPPKKSVDFSRYRIVKPAWIVDSVQAGKLLPWASYRVLDEGPRQKVLAFDGPAGLSQSTPKPKQGYREQTDQSFYTSQFNAKSLSLPSQSWTQVAEKTNSPSSITPRKQFDGQGTELPGTDSSKTVHHAGIDPTLASGKSLLTSPSKAPMTEPPKNATSEEHNAWLLSDPRLRKSSTANPDFLKQYYAESRLHHLSTWKAELKSRMQRLAAEKSLVTTKLPKRPPGSRRYVMHVDFDSFFCAVSLKKHPELVDKPTVIAHSDGPGSEIASCNYPARAFGVKNGMWMKRAQEMCPALVVLPYDFPAYEDASRLFYEAILEVGGIVQSVSIDEALIDVTSVVLAASGSSGAGVDEGSIWREQEKVAEVALKLREKIRASTGCDVSVGIGGNILQAKVALRKAKPAGQFHLKPEAVLDVIGDLKVDDLPGVAYSITGKLEDIGVKFVKDMRDVSRERLSQILGPKTSEKLVGYARGIDKTEVGEQTPRKSVSAEVNWGIRFLSQEEAEEFVMNLCKELEKRLLNEQVKGSQLTMKIMRRSFDAPLDPPKHLGHGKCDVYNKSTTFGVSTNDAERIGKEAVSILRSYKFSAGDLRGLGVQMTKLEPLKATLPDGSQKRLVFETWKGTSPARANSRTETIVESDNADASSKRLSKQDMSDPIADDPLTPRKPKMHPSRSLSKFAQKDEASRTPLNVSGTQFILPSQVDASTLAELPNDIRSRLIGQGSRPATRSASPAPKSESESPMPVDVLPSQVDAEVFNSLPEDMKAEVLASYGRKPQQVTLQQSPRKNQVAQQKKASTTKRGGIRGMFGKGQRQKDAQSGLVQTNFLATKPVAAGVQPDQGIEELDPGFLAELPEDVRKEVIADHRRQRMAQRAGLDAPAPRSHHTDAQALLAGGQTTIQFPAPPPKVSFAQSGVTSTQEIKDMLDAWHTETKSQGPHSGDVEVLGKYLARVVQEERDLEKARKIVKWLDIVVEQDGLKGRGRIAWRQAVSHVKLAVQGAVKERGMAPVKF

SEQ ID NO: 757 - protein, 717 aa, Unknown
  Kingdom: Fungi, Phylum: Ascomycota
MAQLEAATKAPLASVLPALLSVTFAEQNSSLPSSWLPVSKTYKQAAKLDNGSLIRLTPPEGESKALDDQKIVEEVLSASGDATQSAAATEWVQFSRSLDTKNAPELQKSLLKLEGSLTLRTYLASRHSMTVADVAVWATIRGNHVAASLVKKLYVNVSRWYQFIETTNPWIAQAIKDFTAVESNDRAKAKAAASAAGASYDVVELPNVDGPMVTRFPPEPSGYLHIGHAKAALLNEYFARAKPGGTLICRFDDTNPTNESMEFQDAIIEDLALMGIHPDKTSFSSDYFQQMYDLAIQLIKDGKAFADDSALGKGDESRKNRLPSKRRDMGIEETLEHFKEMLTGSEEGQRWCIRARIAYDSPNGTLRDPVIYRCNLTPHHRTGTTWKVYPTYDFCAPILDSIEGVTLALRTNEYRDRNAQYEWMQDALKLRSVPIWDFSRLNFIRTVLSKRKLTRIVADGKVWGWDDPRMPTVRGIVRRGMDVPALREFILAQGPSRNVVNLEWGTFWATNKKHIDPVAPRYTAIESKDVVYCDVTLPDGSAPTPEELEVPKYVKNLSLGNRKVQTEKTIILEQFDAKALKVGEIVTLMNWGNATVKDITQSDGIVKRLALEFDPASRDFKKTTKLTWLGAVENNMLPVQIMEFDHLITKDKLEPTDVLEECLTPVTQTTIEAFADRNTQELKKGAIVQLERKGYFRLDTPYTDAKTPMVFFKIPAK

SEQ ID NO: 758 - protein, 1181 aa, Unknown
  Kingdom: Fungi, Phylum: Ascomycota
MSGHGQDDIEHARRYKTPYSAKHPIPTIAKYRREKESRQQNALDQDDVDNSNHDQSYEEGHDPNQDDGSGAQNQGDDNTLEDTSQIDPGAADVKKRRKEMKHNKQERAEREVTDPVTHLPIVVHDFTDKALKDVDLNEPPFGSTGKTATGLSGKKKSDQQLDEEKVDVQHGHNFLVNRFPPPDFDALRQELVLINKTGITFALAGSAIIIVSAILLDKIIRRDGFFYRDDGKFHLSTAATWLVVISFSVGGLAMLVISVRDWISKKVNGVFQDEVWDAQRRQIKSDAARHENETTAWLNSLLGSVWPLVNPDLFAGLADMLEDVMQASLPRFVRMVSVEDIGQGSESLRILGVRWLPTGAATKSVTEDGDLTVDNQDEADTNEQCNDKAQKDSASDKQGADGTAVAEGLEAEEGEFVNLEIAFAYRTRSTSKTLKERTKDMHLYLAFYLPGNIKVPVWVDLQGVIGTMRMRLQLTPDPPFFQLATITFLGQPKVDLSCVPLSKHAFNIMDVPMISNFVQSSVDAAMAEYVAPKSLTLDLKDMLVGDDFKKDTNAKGILVVNIRRGYDFKVADTGIPLIKEGSSDPYVSVGWAKFGKVMWSTRILTSEMEPAWDEVCYVLVTPQELNVDERLRLQLWDSDRLTADDDLGRIEVDLKQIMRSEESNGKMWHRTDGFRALKSGDNMPGKLEWSIGYFSKARLQECQFEKQTHDPQIRNRDQLQKKVTESCERKLRETMFKEGRSERDESEMEQQKHQELKDEEDAMIISAPPPENYPSGIFSLQIHNITGLEVEKLSKDENDSDNKEEEESGEGLPSAYCTIVINHKKQFKTRTKPQNAKPFYNAGCERFVGDWRDCEVMVSVRDARIDEEDPLLGMVYLPLNEIFKERSQVMGFWPLTGGVGYGRIRLSMVWRSLQLEAPPNMLGWDYGTLDIEPWATVADETKLPEDPKSAKLKFRTNLSSGKMYHNKEQVHRRYSSCLSIALKHKGKLGESVSAFCVLWLKDLVDEEAKELELPIWKGDFKRATACCLDEPGEKLGSLKLKLTFWAGLGGAHSKWISKDQNLREVAEVIDTARDNLEADQKEKEAGIVDAGDDTSDSSSDEDSSDDDDVKDGSNGNKQGPVDQFRDYKRRERGLHRKHRGIMQWKIPRTAKWAKHKVEQVGGLGKGIVQRHSEGGGIETEV

SEQ ID NO: 759 - protein, 272 aa, Unknown
  Kingdom: Fungi, Phylum: Ascomycota
MASRPQIDVSSLVKDPDSIEARIASILQPALDAAPTALTSEALAGDLDKLYPADYEPKEGDGDVVADILWSLWSFLIKVVKKIPADDVRQQLLADALAKLQKKERQEAKVWGQDCKMWGDLGLLGPNMREAWDGRPNFEKDDASAVAEWTSLNAFAALLLGNSVQTWHNFAIWELRGALEEEPRSNAERDGQLQSSSEWILHAGNVLRAKKGMEQLDEMEKRMLKGGSKFHGEPGLSDERWSFWRDRFRELGGQIEDEALKAKIDKVVQKMA

SEQ ID NO: 760 - protein, 325 aa, Unknown
  Kingdom: Fungi, Phylum: Ascomycota
MSSEDTTVAAPASAKVTTGTRADRREERKGKRREKQTAIKYPFWFGGSASSMAACVTHPLDLVKVRLQTRQGDAPKNMSGTVAHIVRNDGILGLYTGLSASLLRQLTYSTVRFGIYEDLKSRYTTPGHEPSPLLLTAMAVSSGFVGGIAGNFADVVNVRMQHDASLPVSEQRQYKHAVDGVIRMAREEGAMSWFRGWLPNSSRAAAMTASQLASYDTFKRLLLEWTPLGDTLTTHFSASLLAGLVAATVTSPIDVIKTRVMSSAHKQGIVGMIGEIYRAEGIMWMFKGWLPSFLRLGPHTICTFVFLEMHRKTYRRVTGIEDKTL

SEQ ID NO: 761 - protein, 557 aa, Unknown
  Kingdom: Fungi, Phylum: Ascomycota
  misc_feature (308)..(312): Xaa can be any naturally occurring amino acid
MSSRAPRSNEFEDQDYYPPPPRRGEDARDFRRPRSPPGGRSPSRQRLPPLERERQYEEVRLREREVDRGPPAFLREDGRRPEPGPMVLRKREVETIDRHDTRPRGSPSPPPSILRRRVSSSPPPRVRRGRSPSPRPGPPPEVEHLRARFVETERVRSPSEVRARTSPSPRGPRFDDRRPRSFSPPERQRIRTRIIDRQTDRYSSSSASPSPPPAPQVIRGPTIERDVITHYRDIDHGKGSSKHGHPAHSHCYLAHELDLKNAHAVRRLISIYLWGGIGLRLMSSAVRRGLAAVEGHLITMMMISGTIXXXXXDEAREITSRIDSRGRMGESWGGATKDWTIVDVPPGTERVRMDGKGGGSTDTTWSKYSGVRRTTFVPERDGALVPISQPEPAPVPLPLPPGRDRVSVSVQGRSTDIDIEKTTETRLVRVPQPPPEPRPMTVSTKTDMWTEITKDLVTREAIERLGYPYEESQWHFYIMDYLRSVKELTDLTDQIRRARTIATDTTTITHLSLVRIATTTITTTTTMVPGRTGIGKRRRIARGRCFGIPRGGSGTDE

SEQ ID NO: 762 - protein, 283 aa, Unknown
  Kingdom: Fungi, Phylum: Ascomycota
MFNLSQHQYAFAQAPQPARQYGAHGTSSAFSSSANPDEDWTKISDLAERRRIQNRIAQRNYRKKLKRRLEDLERRAGSSDEAETEQKPQPSNKSTKRRSPSKSQARSPPAPQQTPAPLKQTQQMQFTPPMDNEDMLFASASYNERERSFTPPLFNYSTYPAPEEQQILAPYGSTQPFHVMSAAQPYPSYLSTTTMSSSLPSLTHFSDAMKRESYSMDTSMTPYSGYGFAHGVGPHANPYDQSNPHTPPLSHSFDHSANCSEAGYEYPTTPLSMPGSPGMTQHI

SEQ ID NO: 763 - protein, 1938 aa, Unknown
  Kingdom: Fungi, Phylum: Ascomycota
MATAQVWQTRIISRPHPGDDASSVSSRSTVSDDEDQLHVHVQELSIKAEEPAVSQPRHNLNGQIHRRPVQSPVEEDPLERAIIPSEQTFVGLFIKLCLWSIAWRKEGMRERPLKQKYRTRQGLQTKAAQIGSGASFTVTKRHTFENPPKVVVMKDTNVKFDRIGRPNDRAVFVSVATEIEILGHKPLYDHANIVTLLDVRWDHPSMYKQALGPTLYLEYANMGTLSHYFEWHPTQASNMSRTSNILFDVCLGLQALHRYGITHGDLKPSNVLIFEELGAVTAKLSDFGCSVIQRRTSGPTSELTGFSPPWDAPEAGEVVPSDVLYKSDIYSFGLMYWWCRLWGAQGSKPMTGGEGAFISGTTADLKALKKAEDLGPMMHGSILAAMRNSGCYGLDELELSLVASATLNLRPEERSLETVLEAMQQSLSPPREVRSADVGEMLFPTAEWDPDKAWDIRLEHIEARHTVSRRFHDAIRLLSESSSKSKSQRQALNVLLFRCFFEGFGTEENLELAAYHLRQAAASGSASAMSLLSRFHDIAGIKVPPEVPLERYLVQAMTSGDYLAAKELAKLNPVLFTETQNKHRTREHEDLRYDSEDSFISSVKSWSPSRAISERFGSARKTVVHFAAALGWSRALAMLVHYDDFYECRRFLNGVDDSGHTPLLLALINGRLEAVSVLLDHGELPWYSHSLLSNFPESRDNLFTYLLGVVAETGGARDGLLRDVCGRLAGAGADPNAKNRLVADGGTLGEAIVTNHDGISTVGNVDRWFETVVEAAVANGNIALVQALLDVGAAPTAAAFHLAAGLHQSEVFKAMFQHPCCPFTHLSQLDVLGRTVVNTAIDSFSETPFYSPIRRYIYSGKPVAQSCRDLLHCLSTFPGFSLREVGPPVSPVLHTPPENDGSPYWIATMARAHVCQPAVLEFLLGSNLELLDDSSPTGDYNPPLYTALLLGSDKLALHLLSLHASTSIDARLGLLTAYANCFCPDNAAVCQRLIEAGCDLETTVDRTSDGIIGLETAFQTAVLYQNFNVAACLFENGANREHINFSVTSEGNVTLLGALIHIIWNESQNRIRWLFEAYPNSPAPAFIVAPMVGLSALQLCANMSPENARGESDAKHMMEYLVERYQGAYHIEYQRFDNDSDHPDTRSTNLVNRPLSEFEQGKSLGELPRKPRGIKGRTSSYTPSNLREHNGTALAMAVRAVNLEAVKVLVQAGANVSAVIGVQITSSWRATSSSYSTKELKWASTVMDFAYLTRDNIQAGVYPSSVTDPSAETQAYLRQRSVEIVDYLRSKEATSSAKFLGQLNKDSIWNARKEQGNLAALKIFGSQTRNGMSAGMKVGLETWNTEWGEYKDHRKWEKEKQRVMQPPAPPIEQKTTTSTATTTTTTTTSQPTTTPSTGTRSAHANIAASGGPDPRVLRNMQLKNRQQFSHKIENEPVLCSHNDDRVVLAWSDSGFYGNIHLMISTDGHYWIQGVSSHTEMTDAHYSPGLAFDTTTGTTFLGWMSSGRSLNIMQSSSPSLEDWAGKQSTTLTKKQKTLSGISMVFVRPYLFVAWLGNDWHVYVRSSTDGGASWVKEARLEEGFHGTPRLGASPTGRITLTYCNRDDRIVRQACLDLTNLVFGPVEAVPFGGVTSTAPCLSFGPDGREWWAFRAGTKKLQTTVSVAGQLQSRTWADEEASSGVAICPFRGEAIMAWKGRKGAKALEPSYSAPPQRLTFDGFLFDMDGTIIDSTPAIIKHWHTIGKEIGVEPEVILETSHGRRSMDVLRILCPEKANWDYVCHMEGLLPILYSADATEIPGARPLLSQLISLSAPWAIVTSGTRPLVTGWLSVLGLAIPEHLVTAESVDEGKPDPACYRLGRERLGLQDDAKDVLVFEDAPAGIKAGKAAGCKVVGLVTSHTLEQVVSAGPDWVLKDLDSIRVVEIKDGRVTIEIRDALQQ

SEQ ID NO: 764 - protein, 272 aa, Unknown
  Kingdom: Fungi, Phylum: Ascomycota
MPGTMPGTMPQFMPDSLPQHPTPYDMNAPQPYPPPPGMGLHQGPEAHIPAPPSSTFEIPRPPTQTFTGVQQSTSIASSTSPLKDLRNVRANCLFQMKEYMTLQNKSKRTDLSTSTLDMQNQLRNQAGIVVLELKRLQGDLREVAKRGEEHRWRKWLLGGAIASFIPLVRRIFRRNDDEESQLSANDTEYAWRRATNLLARIRDSILGKGSLASIAFFVFAVLYVFQNEVKLRVARTLRKRVRKLCARIEAGDEMVGDEDLKVFDGWRWRIVL

SEQ ID NO: 765 - protein, 559 aa, Unknown
  Kingdom: Fungi, Phylum: Ascomycota
MSGRQNLADSPVNLENGNREIAPDCQGAGQTIDHSPLDSEEKAATREIRGFMWLLLVLSILSAIFLYALDNTIVADITPAAVNKFGDAVKLPWLSVGFLLGGSAVVLPFGKLFGSFNTKWLFNGSVLLFNVGSAICGAAPNMNALIVGRVLAGIGGNGMYLGVQNLLSISTTPKERPGYLSFVGVVWGLGTVLGPVIGGAFTESKASWRWAFYINLCISALFAPFYIWYLPSFDPRASETMTTRLREFDVAGSIISIGAITSLIMAMNFGGTVYAWNSGQIIALFVVAVVLFILLAIQQGLPVLTDTNNRVFPAHFLRNYNAVILYCVTSAVNAASFIPIYYIPIYFQFTRGDNAILAAVRLLPLIVCLTAMILASGHLISRYNYFQPWYIGGSVLALIGGVLFSRVDENSSTGMIYGLMIPVGLGTGAFTQTGYAVIQAMTPPSDLAYAISFIMLAQLGGIAFGLTISGSVFINTAIAGLSRILPDATHDELQRAISGTSGSYFRQLDDELRAQATSVIVGSIGKVYILVYVGAAFCLVLSACFTQRKMYKGAVNIVA

SEQ ID NO: 766 - protein, 565 aa, Unknown
  Kingdom: Fungi, Phylum: Ascomycota
MLHQRTFGHLSRKLAIRASAPVHAVAATCAVTTSWRTHRSNYTAAKHAQPGSWRREHGKTVFFSTAAFGVGILLATLYQVNDEITASLESQPHYAGRSGMLEAAQKIASLLGEDMITYDTDVLEHHGHSDWSTANSEGRAVAVVFPRSTEDVCAIARVCNDYNVPMVPFGAGSSVEGNFSQPYSGICVDTSFMDKVIAFHPDDMDVVVQPGVNWMDLNAEIAASGLFAPMDPSPTATVGGMVSTNCSGTNAMRYGTMKDWVLNLTVVLPDGSIVKTRRRPRKTSAGYNLTSLFVGAEGTLGIVTEVTLKLAPLPQDTSVAAVSFPTIKAAAAAASYLIRSSGVQLAALEIMDDVQMRVLNEHGSATVRKRRWAEKPTLFLKFSGTTDAINSDLKRVRDSLTSFTSEPFQTASTKQEEHDIWAARKEALFTMLSIRPEGTQLWSTDVAVPLSRLAEIIDLSKSECGELGIFASVVGHVGDGNFHVAMFYDPNDVQQTAKVAEAVKNMTDRALKMDGTVSGEHAIGIGKKKSLRDELGPETISLMQKLKLAVDPKWLMNPGKVFSHP

SEQ ID NO: 767 - protein, 302 aa, Unknown
  Kingdom: Fungi, Phylum: Ascomycota
MSENILVLGAGELGSAVLDALAKHPMKGNAKISVLLRPSSINSTAPEKKKQMEELQALGVALQPGDVESPASELVAIFRNYDTVISCNGMGRPSGTQAKLAGAVLEAGVKRYIPWQFGMDYDVIGTGSDQDRFDEQISVRKTLRAQDKTNWTIVSTGLFMSFLFLPDFGVIDLAHRVSRGLGTWDTKITTTLPRDIGRVTADVVFDQRGIANQVVHIAGDTLTYGEIADRVDERFGQGTFRRELWDMDTLKKQLAEGQPVAKYKATFATGVGVSWDKEKTLNVARGIEMTGLREHLKDVSLP

SEQ ID NO: 768 - protein, 505 aa, Unknown
  Kingdom: Fungi, Phylum: Ascomycota
MRLTNVSGQAAVVMGMSVLFTQGAQAQQKANISQLIEVMPQCAVGCMVPLINVTDFRTSPSALCDFEDTECLCSSREFQGTAQACISEECSVVDALMARNITTTTCGYPVRNSAHKLTIVAVTFSVLSGLFVIQRFAVKIFSPDLLLGLDDWMVLLAVIIQAPLSGIAVAAGAANGLGKDIWTLTPDQISNFLYYLYVWSTIYFVNIAVCKLAFLLFFLRVFPAPKVRSILWATVGFVGVYGAFFFFINTFQCAPIRYYWQRWQKEDAGKCLNASVIAWVNGAIGIALDLWMICIPLYQLKGVNLDWRKKLGVGLMFCVGLLSTVISIVRLEGLIRHNWNSPNQSYVKLDLAIWSIIEINVAIICACLPAFRSLLVRVFPRMPLGRTHKKNTQEDFVDGNHELGFGTISRSVAEKSHNMHLPIVPGAIAMSREYKVEHTIKPSRSRGSGSTDSREIMRLPSLDEFDGETLDGRSSFDMKSLQRGESKDKKPSPAGGLLRAEDNTS

SEQ ID NO: 769 - protein, 1156 aa, Unknown
  Kingdom: Fungi, Phylum: Ascomycota
MSTTVTTVIQDPALAPTSSNNATSSGRPSEPPKSVAEAMRKLWTPKLLAFAIACLLIMNFFMNFTVYTANVYDPYATSHFQGHSLITTGAIINGLVRIVAYPLLAKLADHFGRPVGFAGAALFMALGNVMYAACRNVETYLAGGILDSFGDTWWNITQQIFIADVTSLVNRGIIFTLPESITAIPTLYAGTYLGEHMLLNSSWRWGFGMWAIILPATVVPTVLVMVWMQRRAKRMGLHIERVSILHGAKPGTGIIGKIQHVGTRLDVIGALLLVGGLAMTLLPMTIAGRNNTDRWKEPSSIVLIIVGVLTFIGFLVWDGKFASNPIIPYRTIRERNVIIACISCIIIACSDSCYRPFLSSFLQVAGYYSPGAAARVDNSQRVAYNIGALVTGLSLKYVKNTKPFIAFGVVLICLADGLPIYLTNVNGEGIASEAAFIANKAILGVGRGFTQVPLQVSLQAVLQQEHVAVATGVFLSSLGLGHNLGVTISGALWNSLLPRKLRARFDRETADKIFRSLVVARSYKKDTPERDAINEAYRQTQQSLAIASVSIACLLLAIVWLNRNVKLAEEDEKRAALASEELAWATKQQDQAVMAQQEPQGHVLVNLVIQPEFYSLDYNQAPTQLSSICPATPNIHSSPLTLTASHRHWPSIRVSHRCQKYPAAIMANHDGLEPPKDPSNVDPGARQLAESSDSEDQFTDAQSGPASPSASPPVPKTRVERVDDEPAHGEVAGTNAHEKRLQDAKPDEIAVIPESDDTSTPRAEQSSSTTNIPTTVVEESAGDLPGPHSAEFEAKREADASPDVIVTPDGTKKAGEESSPETTVTTQDGKETSPPDETEPPAVQSEHAAATASANESQADDGHDFDDDDDDDNDNEGDDFDDFEEGDEDEDFDDFEDGFQQAEPAPPMPAPLPEVELPFPIPDFDGLSPDDIVAATEPYLASLFPPEHLNFPDFPPINSKAHPIFSTDRSASLWSQLVAPPPLAPPDWIRSRTRRLFLVSLGVPVDLDEILPASKQKKLVLPSLNIPTSASPRTSSDSRSLSRIRQEGGGGNASSTSVDTQGRPSSKSKGGKKGSPPQPDLDLVSARHLCMTTSEALDGMTEEELKEHVSKLEAMQGKAKELLEYWQKKADEKIGDREAFEGVIENLVKHARKVRK

SEQ ID NO: 770 - protein, 306 aa, Unknown
  Kingdom: Fungi, Phylum: Ascomycota
MASKTELPIHQNGAPRSNNAAFNLPSSSSSSSVSDLDDANADLPLPFPAALPRSDFLSAEFQPAAYLSALPHRHQTLEDLRSDLRDRSASISTELLELVNSNYTAFLSLGDELRGGDDKVEDVRVALLGFRRAVEDVRGKVAEKKGEADKLSGELRSVRGSIEAGRQMVEVSERLAALEERLSPEGVLDANGDRAWDSDEEEDSEAEDDDTVQGWQGSSPVKLLTSAQQCAQITEMMNSLDLNHPFVLKLEERLERCRNTLLLDLGNAVVEARKAGAGGHDRLFRYTGIYGIIDAHSEAVKALRNS

SEQ ID NO: 771 - protein, 309 aa, Unknown
  Kingdom: Fungi, Phylum: Ascomycota
MADKTFKLNNGQVMPAVGFGTWKAEPGKVKEAVVHALKSGYRLIDCAYCYGNEDEVGEGLKEAFASGIKREDVFVMTKAWATYNTRMQLALEKSLKSLGLDYVDMFLVHWPVLANPEGNDDKFPTKPDGSRDMIQDWDHVEAWKQMEALVGGGKVKGIGVCNYSKPYLEKLLSQAKIVPAINQIENHPSLPQQEIVDLCKEKGIHVVAYSPLGSTGGPLMSAEPVVKIAEKKGVSASTVLLSYHYARGSTVLAKSTTPERIEANLKLVELSEEDLKALTDYSEDLTKKGQLQRYVYPPWGVNFGFPDKQ

SEQ ID NO: 772 - protein, 701 aa, Unknown
  Kingdom: Fungi, Phylum: Ascomycota
  misc_feature (223)..(223): Xaa can be any naturally occurring amino acid
MRASRRRMKEDDSSDSGRGNDVNDGSDDSQEIDGVSDALSDDDLAGSSLQPSPFRSRRPRRQRTSNPAPPQPRPKASPRKIQAPRRGRERPSASRAPKRPPPRSGPGSRTPTKKVKLEGCLPATQGRIPPWTDTRIPYEAWVAIFSYASSGAANGWLVDCATVCKTFLEPALTALYCRPFPSTTPKLRRLVELLRRNPSDTLINYRTKIESLSLDIKDTPSNXTLIVHPIALQSGSNVETSISPETVQGKASPRASEPLSIETSVHAATSANDFVKPEEKPFPTSLRSWEWSGRMLGGAVPAMQDLAKMHQEPFFQSLITLSFTNFQTPSMLHLANSSTASQPLAELADTEAAQALANAISRLPNLRHLIFEACTIVDHALLPLLPTQLRHLTLINCWEVRSDIFASFLHTHGRDLVSLTLSHCQSLNLEFLTSLSAACPNLQELSMDLSYYRLHNSINDSDPMYDYVLLPDHVPDWPSTLRILTLENIKDCSAETAKMFLNSLINNAERLKSLRHISIKMMLNIPWQERAKMRIEWRQKMEDVFLRRTDPPIDWTDIKASVSLEKESDTRRRKLSRRASPARRSGRLETKGRGLRNTSKRLRHQEGRLDYRDPDTDHDDVSIADEEDRSAGSGSGSGDGDDSRPDQYIQGMCNTVSILFDNQKPMEMQYGMEDFRDEETDSEEEWNGDDDDEDETVFVWR

SEQ ID NO: 773 - protein, 709 aa, Unknown
  Kingdom: Fungi, Phylum: Ascomycota
  misc_feature (84)..(84): Xaa can be any naturally occurring amino acid
MYSLLTVNNQVSLVSITIAPSTWIATFTLCCVFLALYLPHLIPLFPRFRVPAFLRPTAILSALAADPADSQALGKPLPEVPYEXTPVVTTSQRRRLSFKKMADEDPLDASLRDFEHHPNSPTLLRRRRPSRQPPSEPATTDPDSENDASHHHHLHHLGEDPEEGEDSEIGSGGGYSPPAWRRLGNGDRSSGFWRAPRDAFGGMMPLHQQSPFAVLQDPMLMAKMNTHAYSRETSPETGISEQQQEEMVLEQAMRTRLPMGSQSPGKRRSPSPAAHDDDDPTLRLRQGGVLNNKDEPSPSENCAPDIRFAVRAEVQHRTAPIESLILSLRHHYNRVTSSYTSLLTSLFTLFLAVTTLKSLLQPASPLPAGDLVKVAGVARSFEPLIYYSEHAVTQVHDLQATSVAVWDLAESVRSSDLEGGAGIVRDLDELSETMKTLAVEMTKFFARVDGDIDGILNVMDWAKMHLTRLSSSPPPSTLASLYDNLHNALSTANILASPSGSPTALGHLTTYLLGPSNPQREQRLVQLLFTEFLTILEDSIAAELQHSVTLFALFEAVDFHFLNLARAVVRESSAQEEIHADLLSGLWARILGPRAASVRKFEQNRALLRNVREKTVRNKGVLVEHNGKLLTLKASLESLRAKLVSPLVRGANATTLSLEDQIRGLSHVSDYLSDVRRKQKGKVMESLFASVPGKKYMIEQDQGVIGEIN

SEQ ID NO: 774 - protein, 486 aa, Unknown
  Kingdom: Fungi, Phylum: Ascomycota
MAPLSKPESPLPLPARFSQIKNDLIRGRHAEVQASWSRLLIALRDEIDEIAATGSSVIPSIDYCDLKNRALMDEFTAQLRRRGAAVIRAVVDPEEARQWKVDAKAYLADITSSLGSPASRDHHLHAVYWSPAQIKGRVHPSVLATQRQLMDSLWHNNSEPASNRNGISAYLGRSSSDSTLLSTNYPISYADRLRIRIPGDAAFYRNAHVDGGSVERWEPDGYGLANTYARIWEGRWEEYDPWDSGARLKVTSDLYNGTGTCSTFRMFQGWLSLSDIPPDDGTLLLCPSIKLSTAYFLLRPFFSPIHDCPSHADYLLPSNWILDDPPTSIIHGARPSYTQELNDILHPHLDLSRSLVQVPRLSPGDYVVWHCDAVYAIDGHQRDELDGATVMYIPACPLTQTNALYLARQRKAFLLGQPSPDFGAGRGESTHLSRPGVQEVHAAGGEDGLKAMGLMPWEEDEAVTESEAEVVEMANRILFPDRYEMP

SEQ ID NO: 775 - protein, 481 aa, Unknown
  Kingdom: Fungi, Phylum: Ascomycota
MAETRQNGQPKRRFLLNAFVMMCSGHQAPGLWQHPDDRSSEFQKLEHWVELAKLLEKYKFHGVFIADVLGGYDVYKKSLAPAIATGAQWPVTEPLSVVPAMAAVTKNLGFGVTVSTTYEQPYHLARRLSTVDHLTNGRLGWNIVTSYLDSAARNLGRDEQLGHDERYAQAEEYMKVVYKLLQSSWRDDAVKLDRKTGIYTDPDLVRQIDHQGKYFNVAGPHIVDPSPQRTPLLLQAGASKAGKVFAAQHAEGIFTSAHAPEVCAKNLREIRQIATEQFGRDGSLIKALALVTPILGRTEEEAKAKYDDYKQYASLEGASTLFGGWTGIDLDQYGDDEELRHVESNAVRSTVEGYARFSPANSKWTKQTVAEHVSLGGNGPVLVGTPAQVADGLEAWFDEAGVDGFNFAYAIFPQSFIDIGELLIPELQKRGLVSDDYAVPGGTYRENFYETKGQAHPRDDHVASQYHWRSGVPSGEHKIPE

SEQ ID NO: 776 - protein, 628 aa, Unknown
  Kingdom: Fungi, Phylum: Ascomycota
MKHDELETLASKLSGDFRSIEPHLRDLDKHLTLRTYLEGYSLTDLEKQVWQTLKANKAALGFIRRNGLPNVTRWFTFVEQSHPEIQEDTKGGEAKKAGANYNLALQDTDKGVVTRFLPEPSGYLHIGHAKAALLSDYFGHVAYKGQMRLRLDDTNPAKESEEFQDAIVEDLALMGIKADTLTYTSDYFDYLYDMCKKLISMGKAYADDTDQETMRAQRMDGIPSKRRDRSVEENLRIFEEMKKGSPEGLTHCIRAKISFDDPNKAMRDPVIYRCNINDAHHRTGRKWNMYPMYDFACPVVDSHEGVTHALRSTEYTDRNPQYQWFLDTLGLRQVHMWDFARMNFIRTFLSKRKLAKLVDTGKVWGWDDPRMPTVRGVRRRGMSVAALRDFIIRQGPSRNVVVMDWTSFWNANKKEIDPVVPRHTALLQKDLVKAKLIGAEAPTGVVVEQRAKHPKNPSVGMKDVVFSPEIYIDQADAKSFKVNEEVTLMGWGNGFVRELPAEDPIKSMTVELNLKGDFKATDKKITWLSAQGFDLVPAELWDFDYLITKDKLEEDDNVEDFLNPNTSSVEDAWCDASVGKLKADDIIQLERRGFYRVDKGLNDWKQGEAGLKGPRVVLFNIPTGKASK

SEQ ID NO: 777 - protein, 127 aa, Unknown
  Kingdom: Fungi, Phylum: Ascomycota
MSFLTERMLRPMAMAIPRASIALNAPRAAAFSISMAARKGPIEAAKDAAKTVDRKVSDGIVVGIDAAINAKDKAKEAIDNSDVTGKAQELKGEAKGKAQELKGEASGAAAEVKGKAKGAAAEAKSKL

SEQ ID NO: 778 - protein, 367 aa, Unknown
  Kingdom: Fungi, Phylum: Ascomycota
MHVRPERTEELRSRPRPHVDRPDAPPQISHFLSQLLLIYARSASFSLTSSSSLPSSFSRPISASRFHPRRVLSLSLTSTLTTFQPLQYSPDPNKPPLCLKPLLAVIFLFLVKAHAHNAYPQITTLLFDCDNTLVLSEELAFEACADLINEICVSRNLTVRFTGETLIKEFVGQNFRGMLTSLQKLHGIEISPEDMESYVTREEDAVIAKLKASLRPCEGVDAQLEQLAASKKYLMAVVSSSALRRVQASVDKVGQDKYFKTAEGKNLIYSAATSLPKPTSKPDPAIYLHALKDLGKTAEESVAIEDSKSGTLSGTRAGIKVIGYVGPYADDKKSEMEQVLRDAGAVVIMRNWSEFPAALQKIEAGEV

SEQ ID NO: 779 - protein, 238 aa, Unknown
  Kingdom: Fungi, Phylum: Ascomycota
MKFSLSMLAAFAATAFAQTADFDPITVPLKSQEVPAGKTFEIVWEAPAKYAAGTVSLHLIGGATQDTQVPLMDIAAGIPNSAEKYAWNVDASLGADKFYGLVIKYESNPAIFQYSNPFRITKAEGSDAKKADTTTTISKSYGEKTVTLSSCETTSTTSIVTPPPVSTPTTTPVANITTTYVKPPTTIKTLPVATTTSIQVVPSAQPTTPTVPVTGAGVRVGASSVALVGAFVVAIFAL

SEQ ID NO: 780 - protein, 591 aa, Unknown
  Kingdom: Fungi, Phylum: Ascomycota
MSSKQQSSAAAEPAHVEQGTIPNTTNAEAIVVHMEDPEPEAKVAWSTILAVFFMGLTYVPAIATGFVMPTQILQQIGTALGDTENIAWIPGGWSIGAAVSFSVAGGLSDVFGRRWVLLSGQTIILVGGIVCACAQSTLNVVAGTTLIGFGAGVIMVAYPGISELLPNKYRGIGLGWTEFCITIPWGSLSGLIGTQLYLKATWRWCYYITIIYAVICLVGTFVCYFPPSRPQHDYEKTRWQQVKELDYVGLFLFATGLTVFLVGITFLGAAHRSMTLVAATVSIGACVVIGAFIYDFTIPKRPLFPLKLFRMYREFTVYLIILFISGMIWQAMITLGNQGTLFMFTNDIVEIGYISIPANVSAVLGGWIMPTLVHKIKHIRYQFLFALLMQTAFTASYAAVIPHNKTGWMILPMFGQSCFTWVTVLSYLASGLLVPQEELGVSAGLMGSFRSAGGSLGNAMFSTIMTSVVNRELANRIANAAIGAGYSPKDLPLLIPAVIKNAVGVPFAMADVPGVTDSVLSATASAFKNTYAKAFRTVFLSTIPLGVVAMIAAAFIRDPSHLLNNHVAVHQEKYVLGKRDEIENAGKVVEE

SEQ ID NO: 781 - protein, 308 aa, Unknown
  Kingdom: Fungi, Phylum: Ascomycota
MNPDEIQEFLQSIADGLRPPFTPILHNPSEAGLEYDDVFFPAEDGVPLEAWYIPCKGSHRIIIVNHPLRFNRSGYPSHLQPWDDFCGGTACGNDFEINFIPDLKILHDAGYNVLAYDMRNLGLSGTAHAGFCTSGWGESRDVIGSLNYIRCHEATKHMEIGLFSRCLGANATFFAMARRPEAFKDVRCVVAPQPLTTETFIVKAMRGSGIDLNYLEDLDEKMKRTTSIGLADRAVIPKMKHVRTPTFIYQVRDDALTTQDDVQSIYDAIPIKEKELMWIEGTISRWKGYSYFQEHPEPILEWFAKYMP

SEQ ID NO: 782 - protein, 387 aa, Unknown
  Kingdom: Fungi, Phylum: Ascomycota
MSTTDSEGEIQLTASCLCKIHVFTTLVPSSSLPLEASTCHCTSCRRVSGALYTHDAAWPGPLDAVTGDGLSLYQMTKNVALLFCGRCSSPMFWWERYEGRPEVLDVLIGALEGPEDVQLIKTVRHAFIGDTIDGGAAPWLRTMESVQEDIPMWMGKAGQSERLGSTWHTSHSKVSELGPDEIPVACHCRGVDLVLRRGDEEFASRKREELPFFVDPKDHKLLASFDACNSCRKSFGIIVMNWTFTLLKHIAFADASAGTPFPTTTLELKAALSRQDRDERFGTLAYYASSPDVQRYFCSRCSASVFYAVDDRPQMVDLGVGLLDSPDGARAESRLTWALGPPVTWKGDAAGTWREDFVGKLEENTEAWRVATGREKLWLRADKERSA

SEQ ID NO: 783 - protein, 85 aa, Unknown
  Kingdom: Fungi, Phylum: Ascomycota
MMWSQLSLAAGAFSLLFASVDGKCKSVDVSAPASAPHDASKPVDHAFASFSLPAHFFADFTGNKSHPNLFSRDIFDLLHKKTGAH

SEQ ID NO: 784 - protein, 272 aa, Unknown
  Kingdom: Fungi, Phylum: Ascomycota
MAVNTFARTLKSLHVPSSPVVFANVWDISSINALTSLNSSPGTGPVKAIATASWAVAAALGIKDEELSKDQNLDAISRIAPFATKAKLPLSVDIQDGYGNEIEDTIRRVVRMGAVGANIEDSIPSAGFDKGILGSLYSLEDQVVRLRSAMRAAADEGCPDFVLNARCDAFVLAPSPALTDEVRMETALARGRAFLELGATTVFYWGPALGKSQIETLVKELQGRVAIQASAVQGLSVKDLAQLGVARISVGPSIYRAAMNTIKEEALKILQG

SEQ ID NO: 785 - protein, 705 aa, Unknown
  Kingdom: Fungi, Phylum: Ascomycota
MSPAQQHAGDTAGPRPQKRRRTDRGRTRSVSPPDVPLNGAADEDDEDATGRRRRAPIACRVCRARKVKCSNERPTCAGCARLGCECVYPKPPRYGADSPGQVSPQVTQLLQEILKRLPSTVPSDLDQQAITPQASLGRSAGIAEPITYDTSGRSFSTQRCPSPNPGDSVVGVSPAFTSLDHMFQWPLLSVSGGDQFMPGNILAADHLQAPPQAGSPSAGVPLLDGEEITALLTRFLRLVHVMNPVLDCTTLMTYGRAVAELGPQWDAKTCLVASFLVVLPGLMQANRLDQLLAAALGAIARPFGPGAETPSSLGSSASQQEDTQARKKAESYYQYAKRRFGVLGRSLTACQCHFLSGTYLLYTLRPVEAWQSFFQASSLYTVYLKSRAAAQMIGDGHCYEDEMVGDAHCSDEELRCCLEQRLFWSCIKSESEICAEVELPRSGLHNIDYPYQFPSPPTPKSVDGLNDTDQASMPGSSSATANSSPAGVAETQDFKELHEHSWFYYLSEISLLRLSSRVNHAFYVEPPPSWGKMNLLNMMNAAWDFEAQLRQWQASLPHAICCFDVPRGDTLASVTRLQLATWSRCASIKLHLYRPFLYRFALMQEQDWPLRDALRQLAERAVLLSLDPLFSVGLRHRHAGAWFKCRETAARALVVLCARRIGLLEEMGCAERAGEVLDLCMAHLRYWEGEAGDVRLARRTLEAMC

SEQ ID NO: 786 - protein, 1015 aa, Unknown
  Kingdom: Fungi, Phylum: Ascomycota
MSGFRPPFGLLVGFIILFAFAGKAHAFGAGNIASLSKVEGQNWRHGDIEDTLLTLAMAQGIGGKKFNKIMVSRVYFGNWLRDYSQVVDVGTVKSVSAEAIRLLLCILGFLSFGYGSGEFEVTAERLGCYRPEDHIDNPRDYAENQDARRYDRRLRGPVDERRELSIDPRTGMKNYIANEEAGITTSAAHVRNLFGRCIELGRRYKDNNRKEDLYESLRLMGTGLHCLEDFFAHSNYIELALIELGERDVFPHTGRRTQMQIEGVRNPVYPIVTGTFGGVDFLHSVVGEVSDKMTQNEIQELEGTLQESQKADTSMLRDLLDKIPDGIIGGNSSKKGQRIDEIQQDAQASQLQNMQVSPREPEEFTRYVQDIFKQIMPVIEFHDEVMQGISAAFEKIPILPKIIEQLEDQLTQFVFSIMAPFIVPLIRQLRAELQTGSDEIIQSSQNEQHIVFEKDNWTDPTHSMLSKDHFSNILNEPAGQSSAKMLHWVVPQLMDAIDDDRADINSVLNDIIYGVLHHPAQRDQGSRGQREGRERIFTAIKEWWNEMPDRQRDSYREALSTNGVEQGRNHKEGVHDTGHGHGCTGKLKMQKLYGQPETLEDKIAGKAADAIFTGATSAISGIIKSETGYDMSSPSGNSGRKDDLGGFGGLIGAASSLLGGAFGDNEKERQSSRQEYSDGSVSRTETEYGHSGDRYGQAEYRETRHPDGSRQSQYSRYEQSDSGGRNTSGRGYEEETETRRTSGGGYETHTERREYSGQSQGYGSSSGYGGSSGGYDSGRREESSGYAGSNARYDSGRREESRGYGRSTGGYGGDQREESSYGSGGYGSNDRETSSYSGGRQDEPSYASSGYGRQDDDYGRSRGGSGGYGSRQDDEYSRASGGGSYSREDDSYGRSGGGGYGREEEHHGRSEQKKKKKKNRSRSRGGDSDSTDSDDEKKRRGGRHGGGDYSGSSGGYGGSGGDYSGGSGGGYGGSSGGYGRSGGGYGESGGYGESGGYGGSGGGYGEDNRYGSGRY

SEQ ID NO: 787 - protein, 274 aa, Unknown
  Kingdom: Fungi, Phylum: Ascomycota
MHEPFGDPFYFGPEFMSERFKDDIEHRNKSGYGGQTYKDVLDEFAHAEKEGKRLFIKDMAQYLFAPDEKPTPIAKSLGGGEEPGNPTVLPLSVLKQFTYTFLIRHPRRSVPSYWRCCVPPQNEITGFTHFMPNEAGYLELRRLFDYLLEQGIIERDQVVVVDADDMLDNPEPTIRDYCERVGIDFSPEMLVWNDDDKEHAVDRFEKWAGWHDDAIESSRLRARTHAQKSSTVESEDKEWIEKYGEEAQKIIRATVDENIPHYEYLKQFCRPVKV

SEQ ID NO: 788 - protein, 618 aa, Unknown
  Kingdom: Fungi, Phylum: Ascomycota
MGFFTRSKIATGTSDHRHRTHHQTAQHPHQQARRKYSFTDPPNVYLPPAPPGPPPSHPYQQHNYSQPAFKPVGYLPAPPALDWTAPPGMLMNSGANTMQQMACSTSTMWTDAIGGIAKTVSTYDDISKCLNDVMTMIDCECLKGNETKLFSCAPTSTQSRRETSPDRSRDRHRQARRQPRRSKSVDDAEERALFRPAKKDRDGEVKKDHSREKKSSSKASKEKLADKNKVQPANVAASVVAGTYFSKVECYANSRLPADLPPLSVYTTTWRLLCLAAQFSQSVYERPRGSEREAHVPSDWRTGTKAMRIKSVPMDSMDTIVFAIRGTASFMDWAVNLNSSPVSPQGFLDDPGNLCHQGFLSTARSMVAPVAKRLADLLEENPDRSRYSLMITGHSAGGAVAALLYSHMLSRTAEARSELNAMTDRFKRVHCVTFGSPPVSLLPLLKPNRPSLKKSIFMSFVNEGDPVVRAEKPYVKSLLELLASPVPTVPEPRSRSSDEKHKERRKTPTTESKGRSKTDDNRLVTSRPSLPSKPTWRVPEATLSNAGRLIILRSGTPNARPKDRKTVGERLDEGVVAVTCEEEQLRGCVFGDPVAHMMALYAGRIEVLAVGAVTGKFG

SEQ ID NO: 789 - protein, 225 aa, Unknown
  Kingdom: Fungi, Phylum: Ascomycota
MAATTQPFRLRPGTWADIPRTSMLYTLAFGNDMLLQILFPEREKHPEEYVESIERLLQMRFWTLGWRFTVAVDENDVPQAFSWWNRGKGNESFWRRWLSPTWWFAPVVRLWLRLRNRLFPFRLKMNNAFAQVVHHESEKFLNTPRRRSAHYLSLLGVHPDLQGTGLGSLLLRDGLRDVDACGAAAYLIRLKGLRDYYERFGFKDDGTVAVGELAIWDGGDVMFRE

SEQ ID NO: 790 - protein, 417 aa, Unknown
  Kingdom: Fungi, Phylum: Ascomycota
MLAAHRDQENLVHSHQVPTKQNPKTPGARYPKTPSRFNDENAPTGFAAKTGGKSILKGAPGCQAMMTPMGNANRAVLGDKTTNAKARAGQTGGVKGLVKELEKTTIKATTVHRPQQRGPEVAPIKFDTKQDKEGSQEEEEPEYAPPPVEPQPYESDVLPRGLTFEGLKDENLLRGFYDYYHNPVDANGVSRKDKQLEDEIERLVDRAAERNERDLQDLDWTIQKDEGVLAPPKMTKPSAPNPTTASRVVRRGPGTITSRRAAASLSQPPEQKGRPTMKPTAGKPAVRRPLSSLIQGTRTTKRPIPVARDPPTAQPGAMASRTTLGYNKGRTASSVLHPQRKMTLTSSKAPGDGSLEETITPARARMAMRQAATPASPPRPGFLSIFEGLDDDEDLPVQAVPQHLLEEDEEFELRLEI

SEQ ID NO: 791 - protein, 166 aa, Unknown
  Kingdom: Fungi, Phylum: Ascomycota
MTSLPSQHPTLSLHLTDQTLHPIITSSSSNAHLNSLTILTNSALTAQTAVQRAGLGRPQRIMVEYPDRGPVVLQSYLESPPSGAPTTSTGAASTSTTATTTTGEAEDGATAGKIEEPAPMLVGVVVAGSADEVREARRAAGRLESLGREFQKEWAAERDSPHLTTD

SEQ ID NO: 792 - protein, 272 aa, Unknown
  Kingdom: Fungi, Phylum: Ascomycota
MSSPWIFISPSSRGIGHALTRHLLRTTSLPILASTRSSDPASTKSSILKDLAQAEDLAPRLSIVQLDVTDEASVAAASDRARELFPAKTHHLRLACAIPGILTPEKNPKQVDVEKALQTFQVNTLGPLVLMKHFAEMLPRQATELAPSPKDDELRLPDSHAIWLSMAARVGSTSDNRAGGWYSYRASKAGVISLSKSLDRYLAARSGDKALAMAYHPGTVKTALSEGFWNSVEEGKLFSTEYAAEKMANVLAGLEVGQRGKCWDWKNEEVPP

SEQ ID NO: 793 - protein, 89 aa, Unknown
  Kingdom: Fungi, Phylum: Ascomycota
MLDKLVGLAMLVAATVVFLYYTIWTLLMPFVDDDHPLQNFFLPRVWAIRIPVILILLGSAVVGSFLGMVMIRSNRKKAAKAKAAGKKKA

SEQ ID NO: 794 - protein, 675 aa, Unknown
  Kingdom: Fungi, Phylum: Ascomycota
MVQTSKARDGTQVARSSAPFGTPGGSVFHLARHTDLTAAQRSLARPSSKEPSASANAATPMVSTPASFTEDAENSGISELCQRGNNEASLQTHRALFSNITSNDPDLEPSQLHSREQRAKDLFAKHGLKNVATEFPHLWEQARWLPIDQQSKRIKEIAMQLKRQRDSGEPSQTTVSPKEKRKRPSMTGEEKARSHPASTPGQIASLNLRQESSIIRAQPHLQSPREPGNKHGNSPGGLRGITDPHHNRAFEISNVSSEAREGFQGLLRNPVHTKHGLSSCSAQGTAPSQRSSLTFCSRPGSKNTWEYQEEIQKIASPIKDHSRSGDTASPRKRRLTSPFGIGSRQQTRSPKNARRPHFIPPPPQSSSSGSSPDSTFGQSPINPLQSRTTVPLRRAPSPAISSVAGPATSLNLARDPHVGAQNAAKDNSAITPSCGETRHSSSTVDSAGDEPLQGLLGMNQPELANITATDHESPLSHEVPAEAPSSDNDGADGSPDSDVNLGYRVVSLAESLRQERLRGFSSAALDLAIYAQPDTHYPRGLTFHLEVLHTVISLPSWARNDLNANPVIHGMHPPLEPALQAAKDAEIAGRGKRKFWFGKVGARQRYRLEKERNTPSYLRTRSVCRRRDIGFLEEHELPPMIVGNEQYVKYWRWFRDERKKALIAEVKKGRQRRRD

SEQ ID NO: 795 - protein, 708 aa, Unknown
  Kingdom: Fungi, Phylum: Ascomycota
MVQVDNMVGIGIVAPKPESLVNLTLPEGQEDCDPHAVLALEPDRDIGGRGVIASFVGSGCLALIIVTIYYLFVFDPKVTQFPDRKRTFSKRRTTSLSRQETIQWAAQDYVPPNPVDEYMYELQVRLYRFVGWKPRWLPGKPKIEEAFRRCILGLSDIQILTGLCVLIAGFSAIETIPAYYWQLIVYVAWFSNLTHQCGLIFLRRYLHRKPWERTWRIILITVLMILLIIAMIPSMYFNWHDNGIYDLLSTPASAAQPATPIRCFYNHETRNYMHQKIFGHPNKVPKFAATRAFQNVLISLVFLVTSYVTRVIKLFNSSSTFFRYQVRGRAGYAVRRFFAWILWKIDTVTRHKIAAEPWYLFLENPLLTFYFFFRVLLDIYASVISDVGWLYAGTLLGLWRLVAEKQAEVDFVEDERAFEEEDRVMDFGQLLPLMLLASPVFATIGTFSHRSVSDATVPSERIRVVEGLDGEDQQAKAISDTTRNPDHTGNVHKLQPPLAKDKINRWNRIHFVLEDEQYWAAPWFSSALFTVSMAELSIFLVVYINLVISRGARTVFFQGLLAIVSIMPLSTLPIQLGVALRGCDGKIVARLCWALTAPIAGTYIWVCYRYAVAGDFLTMYVSVAVAVGGYYVTSLIVCLLPKKWTWGRPILKEEESVVSSAELGQAQHDGPSPAVQETRSGPGGLSRSTTFRHEGAPVFRLESHPARD

SEQ ID NO: 796 - protein, 589 aa, Unknown
  Kingdom: Fungi, Phylum: Ascomycota
MSRKAVFTKNAPPPSPHLSQAIVCNGMVYSSGALGVKPETGKLNGNAYEQTKQALNNLKAILEEAGSQAENVVKANIFLSSMDHYASVNKAYLEFFSRDPKPSRTCVAVAQLPLKGADVEIEVIASLKQGPKARLPNFVTPKVERERTPHPSNCPLRELPNAMELPPRCRHMHLQGPASTSIPHPFDVCATRPAAMDLAFNHLEDSYVREQPSNDPSKPGQHASTLSEDIQETYKAFSASPWGAKIGGFLGTGESVYTQASKELAEVGEDATKGFNEIRDSLVSHTRNLSISTVTPQSSGTDGDDSQATPTKSRAAGADGGAAAENENMLSRLRAEAAKRIKDLQKAEDAADEALLKFGSNVRDFLKDAITIAPPSDDAQSSTVLFESKDAQGKRVVHQSRFDAQLHVIHTSTESFTKDPGPAEYEQWTKDFDVEKKTDDIGTDLEKYPELRTTMEKLVPDTIPYADFWKRYYFLRHSIETAEARRRDLLKAAAEEDDVGWDDDSDDDEAGAKSNKDAKPSSGNSSTTIQPPTQGPLKPNESRKSNDEKSQADSEASYDVVGATSGKTSQAPSSPKDPKKNDDSDDDWE

SEQ ID NO: 797 - protein, 579 aa, Unknown
  Kingdom: Fungi, Phylum: Ascomycota
MADVAAKFKELNPFRSRSEDDDDQGEEIDFQTIGGAGHGHKQEIHKHGLQVSQALREYLADNDILSKKDAGFGEETLTPALDRMLTASHIHVPQEYLDRSHPLPEYWISSSHNTYLLAHQLYGSSSAEAYETAIKTGSRCVEIDAWDNDENPEEPKVTHGYTLVSHVPFRAVCETIRDCLDEELAIAELDPTYSPTAIMISLENHCSPTGQMRLVDIMREVWGDRMISKAVREAGHREQAGSGEHVTLEQLGPRIAVIVEYHFDGEEEDSDTDSDDEEDQEEEKNARKQYKEKKKTSGGAVIIPELAELGVYAQSVKPVDNSWYDPGQLINGPHHHLINVSESGLSSHLPEHALPISAHNAEHLMRVFPKGTRISSTNLKPTQYWGIGAQICALNWQHFGASNQLNHALFAGSDGYVLKPPGLRRGGNGRVTTGRKKKLILHVAGATDIPLHEDREADSIKPYLTCTLSHPGLLDRDPPKRKTSYYKPHKIGFLHKGENPGPTNPVWDEKLEWEYDDTELSFLRMLIKSDDSWARNPMFAVAAVRLQYVTSGWTFVPMLDMKGHETKCTLLVKFEITDA

SEQ ID NO: 798 - protein, 338 aa, Unknown
  Kingdom: Fungi, Phylum: Ascomycota
MTIEVTWPFSADIVTEPPVVRIELHRFEPAGQYLAEEWTSSDGSSIRMVELPPLACRNTDAASVHIEAFLDECQPLLEKQLSGMLGDTIMKETWLEVLRVRDQYQNDALCKVVRMYTAVLMNTRFPKSVRANIFDVAEEPEPPFFFEGNLLPPQLTYQIQMLIAMGQTKLQKDVIRSLKQLIFSKQRQENWYTVFLITFVLLSSIELMHYNQTTYLHYKRQNSDTNRENVSFVTNHMLTEWEKSADNLSAHYRFVMNGHLLFSRSDHNFHDNMIKQKDCLDGTAIAHVLRMRAEVISRTAELLEARQTRLRGTERREMWAICELFLADDLDLARQRTS

SEQ ID NO: 799 - protein, 1151 aa, Unknown
  Kingdom: Fungi, Phylum: Ascomycota
MDFEHSQEPPNKKRRFFRDPDEPANEVDLPLHTQHAQAVNQEKRFFKEEDEEDTKPVHLEPTPNGDESVRSASGRAAEPPADLSRESSHVAFDKETFESFIGDTVKVDVLEIIRDNCGDSLERAVNMYFDGTYKTLKKKSASRTPGRRSEASSSRSTPVANTASPFEPPVQRTIADSRYLGALGVEGWATRSGTNILRHGDIVKIERQKIQPLQPPKVKGKLGMISQSVRKNSPASNRVDVIVRFTNRDGMEIGRLSKGTASWVSTLLDQQVCEFQGTCVYAPERLRTNDTVFLQLKCFLLKSAFHKRGFQLADDRSTAFYEQSETADEKTLRLRQVALVRLMQEVNLQPTLANSASADSRAGLLQAAERDEQKQREAKKSAAETKEPGSSTPSDAEDGDGEELEQDQLDALYKKAQSFDFSTPQAEPAETFALQLRPYQKQALHWMMSKEKDEKNNREPSMHPLWEQYEWPTRDVDDKELLQIEDQKYFYVNPYSGDLSLDFPAQEQHCLGGILADEMGLGKTIQMLSLVHSHRSEVARAAKAANGGLSNVNQLPRLGMNGSSVLNAPCTTLVIAPMSLLAQWRSEAEKASKAGTMKTELYYGNEKSANLQALCCSANAASAPDLVITSYGIVLSEFSSISAKNGDRSFHNGIFSLNFFRIIIDEGHHIKNRASKTARACYEIAAEHRWVLTGTPIVNKLEDLFSLVRFLGVEPWNNFSFWKTFVTVPFEAGEFVRALDVVQTVLEPLVMRRTKDMKTPDGQPLVPLPPKTVDIVNIELSRTERDVYDYIYSKVRKSFQQQVEAGTVMKAYTTIFAQILRLRQTCCHPVLVRNRDVVADELEAGAAADAATGLADDMDLDSLLAHFTAETDEASKDNKAYGAHVLEGIRDEAEKECPLCFDEPMNDQLVTGCWHSACKKCLLDFMQHESDRGVIPRCFNCREPLNKRDLFEVVRHDDEPDAFAQKPRISLQRLGVNSSSAKIVALLSQLRELRREHPKMKSVVFSQFTSFLSLIEPALAKANIKFVRLDGTMAQKARAAVLQKFTEATDFTILLISLRAGGVGLNLTTAGRVFMMDPWWSFAVEAQAIDRVHRMGQEEEVIVKRFVVKESVEERMLKIQERKKFLATSLGMMSDEEKKLQRIEDIKELLS

SEQ ID NO: 800 - protein, 150 aa, Unknown
  Kingdom: Fungi, Phylum: Ascomycota
MYFSVSLPLGQLRLYTISSHPATKAMPSDEYAPLGGGGGALKIKGVKVEKKKKKKKSKSDLVKNLAGPDGVESTTKSPEPENREDETFVPQKTEAERRHEEIRRKRLLQLAEASGSRPELLKTHKERVEELNTYLSKLSEHHDMPKIGPG

SEQ ID NO: 801 - protein, 200 aa, Unknown
  Kingdom: Fungi, Phylum: Ascomycota
MLLSEDPDKLISHTVDNFNIEPDKLAVARITESLSTLQQARDLRVNEAHSALKKLSRQLHTLTSQHDDLVAASNHGADHASRIARLDTEKFRTAKAASDAEVEAERLALKLADLQARLQELELQGVEGDEAGRRRDPVDDEVLLRLKVYRSLGIDLERDERDGEWTKAVVRNDRKGDVHVVNMDKKFSRYFYANYFWQTL

SEQ ID NO: 802 - protein, 422 aa, Unknown
  Kingdom: Fungi, Phylum: Ascomycota
MHPPTVAVSAPGKVLLAGGYLVLDRAYTGLVFGLSARINVIAGEIHSSPGVQVSEIVVDSPQFLDAQWRYGYHRAGEGGGISVTQLQVYALTYIDRITGQQDHHKLTSARLIILADNDYYSNPGTGNSRFAKFGVPLSGANKTGLGSSAALVTSLTASLLVHYLPSEKFDLASALGQRTLHNLAQAAHCAAQGKVGSGFDVAAAVYGSCLYRRFSPSTLSSIPEPGAPGFSEALAAVVDSDWDVDVRSEGLAVPAGVTLRMCDVDCGSQTVGMVKKVLAWRSRDADKSKQLWDDLQQRNEALAAALSSSDTDALPGKITAIRDLIREMSSLSDVPIEPPSQTELLDAVSRIEGVFGGVVPGAGGFDAAALLMRDDAETKQWVDEFLAKWTEQNNGSRVKLLEVKGEMEGVRRENLDVYKGWL

SEQ ID NO: 803 - protein, 2222 aa, Unknown
  Kingdom: Fungi, Phylum: Ascomycota
MSDQQRDVSQYKYSAMSNLVLQVDRRFVTRRNNEATGDPESLAGRLSIRDMGGRVAREEAPRPKRQPGMPDIQRGSMQEGEDILLREQKRRKAEAPQMRGTGVLGVSEPLVEGIQYRPRTQATRATLDLIMSIVRTAMGDAPHDAIRSAADVALEYLKDDDMKDLDKKKEIDDALDVNLTPKQFNELLNLSKKITDYDAQDDDEDAEMGGADGDDAELDERQGVAVAFDEDEDEDERDIVTEVRDESSENEDDEDEEDKEGADGDNDLAMDQDEMILEAGDSTENADEKDKLAIPARDIDAFWLQRQIGTLYPDVHEQTDKTKRALEILSGEPAEPGGEPKTLGDIENEIMELFDYDHNKLANQLVHNKDKVYWLTRLARAEADDERATIEREMASEGLQWILNELRGTGSGEKRKADIKMDIDVPASFTEGAKTEQRAEGQLVGGLQPKRTINIENLVFDQGNHLMTNPKVRLPEGSTKRSFKGYEEIHVPPPKKRNDPSDALIPITEMPEWARGPFGTTKSLNRIQSKCYPTAFQDDGNMLICAPTGSGKTNVAMLTILRELGKHRNPETGDIDLDSFKIVYIAPLKALVQEQVGNFGKRLEPYGVQVSELTGDRQLTKQQIAETQIIVTTPEKWDVITRKATDLTYTNLVRLIIIDEIHLLHDDRGPVLESIVSRTIRKTEQTGEPVRLVGLSATLPNYRDVASFLRVDPATGLHHFDGSFRPCPLRQEFVGVTDRKPIKQLKTMNDVCYNKVIEHVGKNRNQMLIFVHSRKETAKTAKFIRDKALENETINQILRHDAGSREVLNEAAGQASDKDLKDILPYGFGIHHAGMSRIDRTDVEDLFARGAIQVLVCTATLAWGVNLPAHTVIIKGTQVYSPEKGSWVELSPQDVLQMLGRAGRPQYDTYGEGIIITTQSEIQYYLSLLNQQLPIESQFVSKLVDNLNAEIVLGNVRTRDEGVEWLGYTYLFVRMLRSPGLYQVGAEYEDDEALEQKRVDLIHSAAMVLRKSNLIKYDEKTGRLQSTELGRIASHYYITHGSMETYNNLIQPQITTIELFRVFSLSAEFKYIPVRQDEKLELAKLLGRVPIPVKESIEEPHAKINVLLQAYISRLQLDGLALMADMVYVTQSAGRILRAIFEIALKKGWSSVTKTALDLCKMAEKRMWPTMTPLRQFPTCPRDIVQKAERIDVSWSSYFDLDPPRMGEVLGLPRAGRTVCGLVAKFPRLEVQAQVQPMTRSMIRVELSITPNFEWDDSIHGTAESFWILVEDCDGEDILYHDTFLLRKDYVESESNEHVVDFTVPITDPMPPNYFVSVVSDRWMHAETRLAIPFHKLILPEKFPPHTELLDLQPLPTSALKVESYVNLYPDWKHFNRIQTQTFNSLFKTDQNVFVGAPTGSGKTVCAEFAILRHWMQDDPGRAVYIAPFEELVDARLQDWQKRLASLRGGKEIVKLTGETAIDLKLLEKGDLILATPTQWDVLSRQWKRRKNVHSVELFIADDIHLLGGTMGYVYEIIVSRMHYIRTQLESSMRIVALSVSLANARDIGEWIDAKKHDIYSFSPHVRPVPLELHIQSYSIPHFPSLMLAMAKPTYLAITQMSPNQPAMVFTPSRKQTRMAARDILAACAADDDEDRFLHLDQQQMKPFLDRVNEEALAESLSHGVGYYHEALSLSDRRIVKYLYDQGAIQVLIASRDVCWELTSTAHLVILMNTQFFEGREHRYVDYPLSEVLHMFGKALRPSKDGRGRGVLMLPQVKRDYYKKFLNEALPVESHLHSYVHDAFVTEISTKMIESGDDAINWTTFTYFYRRLLANPSYYGLTSTTHEGLSTYVSDLVEDTLKELSESQIIDYDQEEGTVAPQNAAMIAAYYNISYITMQTFLLSLSERTKLKGILEIVTSATEFENIQIRRHEEGLLRRIYDRLPVKMKEPSYDSPHFKAFVLLQAHFSRMQLPIDMSKDQEVVLARVLSLLSAMVDIQSSEGRLNTMNAMEMSQMVVQAMWDRDSPLKQIPHFTPERVKTANDFGYVTRLLLINDDANSFDRIKDIFDFMEAMNPDENPEYKNLIKGLAMSQKELAEAANFTNDKYPDLELEHEVLDEDEIVAGEPAYLAIKITRNLDEEDGDFDATVHAPFYPSKKTENWWLVVGDEKNKNLLAIKRVTIGRELSIKLEYTVPKEGEHDLKLFLMSDSYIGVDQEREFSVKVAEGMDVDEDEDEEDDDDE

SEQ ID NO: 804 - protein, 345 aa, Unknown
  Kingdom: Fungi, Phylum: Ascomycota
MPRRRFEDAARDGNKEKASDRAEYVSKRAALQQAGQRGSCKPRRRTNVIGRVARHRGVERANRQERRATGGAGATRGGAATWEVVRRRSSGVELEGSLDGLLVVGGQAEADCTVLVLLWPAAEEEEAAEGGEGGEGAGRELAGEATASAVAGLHCVLLSGEAAPQAHDVTPRGRAGAGAVAAQSLLPPPVLVLAASGCRPPALARLLAGWLETSGSELCLVKKARFEDFVPATSTPRHINPIATRAIPTNSPIMSWLGVAPFKKFPAPFRACSPGPRDAVPPPEPTRQRPRWLTIATVKPMAPFFAAGLIIAYGANSAQNAMMASDEWKNDPRNPNAKTAGTGGH

SEQ ID NO: 805 - protein, 462 aa, Unknown
  Kingdom: Fungi, Phylum: Ascomycota
MAYNPRMSIIPTSQQQSRSRKKEEEADAFMRLPDREIVGCITDIGINFTLADLQKPNAAHIQQIFEWFAELLLNATRETVEPAMRAAAEDVCGEFSDVIPNDTRNLMGFYVSLRRLLFECGITDFSFNDLYKPTYDRLAKIFSYLINFVRFRESQTSVIDEHFNKAESTKTRIEQLYSENQENEGRLEDMQHKRKAMEAQVREKTMRNEDLKKRLLELRRNQEKVAARLEEAKQKKGDYTALLEQKTQEKVTLKQESNKLRPYMLQSPSALSENLNDLQKILSNDRSHIDSLDRRARALQTSSDTFGTVSTEVAASIKLLDEIAAELAKEEEEMARKTKQRDALSDRHSNAKEVERAKTLLNRQLDKWSDRTAKLREQAATKAQEAKERMMELKAMHESLHKERAEKDQEMEVRKVRIQQTELKMADLRTKTKNEVDKAKEEYLKMEAHIKLYITEMEQNIS

SEQ ID NO: 806 - protein, 430 aa, Unknown
  Kingdom: Fungi, Phylum: Ascomycota
MPRTATHLPIMSILPRGVKNVLAKSPSDVVILSALRTPITRSYKGGLKDAYPEELLATVLKATLEANPNLPPAVIEDVAVGVVLSELGGSKAARMAMNHAGYDNKTSLYTVNRACSSSLQAINNIAAQIRTGMISVGVGAGMESMTRNYGSRAIPVDLWPALKEDPNKDVRDCIMPMGLTSENVAERYGVSRADQDAFAVKSHAAASKARSSGAFAQEIVPVTTRFQEVDKQGNKVGEEKTITVSQDDGIRDNASLEGMAKLKPAFKPDGASTAGNSSQVSDGAAALLLMRRSTATELGLTSSIKGKFVSAVTAGCAPDEMGIGPALAIPKLLQQHGLVNEDIARWEINEAFASQAIYCLRELGLEGAWEQGKVNPDGGAIALGHPLGATGARMASTLLHGLARDGGEMGVMSMCVGTGMGMAGLFVREA

SEQ ID NO: 807 - protein, 687 aa, Unknown
  Kingdom: Fungi, Phylum: Ascomycota
MDDSANYGSPSHGATPDGNSLLAQPPLQQDENTTGEGEDVQMSEGVASDANVKQDSTTPAPVGSAGDVLDAQDGPAAQTTAGGDEEMGDTAEESKAEGDVENRATTSEAQGAKSKEALESAAREHLISQTHAIVLPSYSTWFDMNSIHDVERKAMAEFFNSRNRSKTPAVYKDYRDFMINTYRLNPVEYLTVTACRRNLAGDVCAIMRVHAFLEQWGLINYQVDAEARPSHVGPPFTGHFKIICDTPRGLQPWQPAADPVVLEGKKNADTDAKAAAAAGGKSDMNLEIGRNIYEANTKGTPINKMEPKANGDTPSTNGVTGGEAANKAPTVKVNCHQCGNDCTRIYYHNAQTDATTKSSYDLCPSCYTEGRLPANHSSSAYSKIENPAYTATPDRDAPWSDAEILRLLEGLERFDEDWGQIAEHVGTRTREECVLQFLQLDIEEKYLDSEAAVNAPTGLSMLGSQQGQLPFSQADNPVMSVVGFLASLADPASTAAAASKSADELKKNLRKQLESGSDGSLQVNGKDKEKTESMEIETTTTTTTTTTTTKTSLASIPLASMGARAAGFASHEEREMTRLVSAAANITLEKLELKLKYFNEMEAILRAERRELERGRQQLFLDRLAFKQRVRAVQEGLKAAATVGGEPGARMAHEIMDEGERLGFQPATGMPSVQPLSAEGQIKSFEA

SEQ ID NO: 808 - protein, 570 aa, Unknown
  Kingdom: Fungi, Phylum: Ascomycota
MRFFSKKGSESEVTAEIAVDALNESGNRDDDKDTTTETNEPGATSIEAAQALWGQTGRWLVIAGLAMMMITYELDNTTVYVYNNYSTSSFNALSKLATLSTASTIVFAVVKAPIAKISNVIGRGQTYVFTVSCYVLAYVLMASARSIDMYAAGVVFYSVGQSGTNTMNDIIISDMTTARWRGFGIGVSFFPFLVTPWVAAFIVESVVGGIDWRWGIGMFAILMPFGASFLITTLLYYQARSRKMGLVVSKRPTVYEFCSQIDLGGIVLFSGGLAMLLLPLTLAATSPSRWETPYIIALIVAGGLCLIALPIYEGYVASNPIVPPSYFESVTISLCVLLIALDAAGFSCTHTYLYTWATVARDFGTRDATFFTYTNGVTQTLMGIVAGLVMAWTRKYKYLAIAGAVIRLVGYGVMLRLRGAENPKAELFVVQLIQGIGSGILQMTMLVPAQISVTHAQMPQMTALLITSLIMGSSIGACISGGIYTNTLKLALRRHLGHNASDLMVDSLFNSTTGVVPAWGTPERTAVNLAFSDVLGYMTYAAVGTSTPGVLLAWFLPDHMLPERNNLVES

SEQ ID NO: 809 - protein, 401 aa, Unknown
  Kingdom: Fungi, Phylum: Ascomycota
MGLNEQQVRAQFPALTQDQVFLDNAGGSQTLGPVIDSITAYLSRTNVQLGASYATGKEATARYSDAFAAAARYINANVDDIVFGSSTTQLFRNLSWSLEFQPGDEILISALDHEANIAPWVDLARRQDLRLYWWKPREDRVSPELTAEALRREMSHLTRLRLVTFTHASNVLGTIHDVKAISKVAHEYGALVCVDGVAYAPHRPIDVEDLDVDFYSFSWYKVYGPHVAMLYSSWPARQKVRSLGHFFNPQQSLTDRLGLAGASYELLQSIPQVVEYLGTHASERWQDVVAHEEKLQEELLSYLRERSDVTIYGRSESDPSRRVPTVSFVIKGWDSKEVVETVETHTKYGFRWGAFYSERLVRDVLSLGPQGVVRVSMVHYNTLEEVQGLVKAFQEHLPSRT

SEQ ID NO: 810 - protein, 313 aa, Unknown
  Kingdom: Fungi, Phylum: Ascomycota
MALSTHSTPKRKRGESESVTRSPLKFSFDGSLAQDSRDGSNSPRSKVAHRFRGLELHEPDVGDGSGGGVAVTPAGLASYDEEPDNTAKRQRHDEVIPDAGEPPRVVSDLIDAHVGDAVGITDGDGKTVPQPDPVKDEQLEMRAAQDAEQAPELVPDTSPPKSLGKKRAGTPPLRVKKLLSKTGDSSKDVVDPVRAALTWHEDEITIYDPDDEDDDGTGINGVGFKPTAAIAHARVMKRRQQMAEYKRREESDARARRNQRRKSAFTSRHTSAGSSSSPPGSHGDGAPPEDVDRSPRKVRFTDVEAPQVAITTK

SEQ ID NO: 811 - protein, 407 aa, Unknown
  Kingdom: Fungi, Phylum: Ascomycota
MGFTKPPSSALKAANKLKRRELYVQHKKASDKERHEARHRRRKEEALDPELKKARLAKNRPKTLDEKRVWDDVDDDRLGAVVDLEQLRRRRMEQAEEEQEAALEEDEADDDDDSMLDSDEDEEAIQAAMERKREKRAQRQNSAAPSTTSTNMDLTPSSLALKFPTLFTDVPPPEPKILVTTSLNSTLHEEAHLICTLFPNSSYIPRSAHRYGHKYSLREICKFATNREYTTVVLLNEDMKKPKGLSIVHLPSGPTFHFSISNWIEAQKLPGHGNPTNHYPELLLNNFKTPLGLLTAKLFQTLFPPRPEFQGRQVVTLHNQRDYIFVRRHRYVFRNKRETEKSIVGADGKEVKGVESIRAGLQELGPRFTLKLRRVDKGIGRAGSEGDDALQWEWKAKMEKDRKRFNL

SEQ ID NO: 812 - protein, 931 aa, Unknown
  Kingdom: Fungi, Phylum: Ascomycota
  misc_feature (736)..(736): Xaa can be any naturally occurring amino acid
MNPVASHPTGSSDAAAALKGASLAFQNKKPPSPTTPKSKRDNGALTAATASSSAASRSASPPKRPTPQTEVESSGLRHGAAGGGNGSGGHLQARVDSKSPSFIAATLAASRSASPSPMHRTPRRRGSVGGHSSASGSDAVESLSIPPTTSLISMFERGKEGDPVKRISPRRVPTESSEDSLPETWRAPVKLPGIAKAQSIPAKQAMSLGESTDELFRTPVNTPSAKATPKAGAKTFIAEVAEAKEPVSSPRSIRLSPASPPQKLKPFTRPTPAPAKVSQEYIRAQQTATPAQPGASSAAKPEPKPKPPLGTPSKPPSEAPATPEMQAKAPRTGQSSEASPVTPKPAKPRPAPLNPVPRVVSHSTPEVLSPKPTRPVKPVLQLSHPSPVKSTASSAEPQRSATEKQRPPTPPKPRATQPKAIPVVTSTRFVKSANDMGTGQSHKPKDMAMVHARTRSDTVSTDDSFVSASSYQSVDRLSPPSLPVRRGSVTPSIASAPISPSRGITRPHNSSSTSLGLSNLTNAIMAGSLASARLTPHNTGSSLPPPSLPKRQRSPHLRETMRKPTTLEPEDPDVYKPHKHKLSRGKHKHQEGSRKRWRDQITARERKRYEALWASNRGALLPITISLAGTSTSNGAGYRDTTDLVANVVVRELWRRSRLPEDELAEVWDLVDREKKGWLGRQEFVVGMWLIDQRLKGRKIPSKVSDSVWGSANGVRVITPKSKSSNGPSPSANSTXTRVKLEKQEKTLIQQIKTSAKNGQMGACKIQAKDLVRTRRYIEKFYSMRSQLQKISLRLQTYRTNEQMMQAMKGATMALGSMNKQMNLPQLQRIAMEFERENDIMEQRQEMMDDAVDDAMDVGVEEEGDEVVDQVLEEIGIDFNQALGETPTALGNPTQTEGRIAQAVGGDGGSGGRGADSIDDDLAARFDNLKK

SEQ ID NO: 813 - protein, 479 aa, Unknown
  Kingdom: Fungi, Phylum: Ascomycota
MAPEKNITAEDLPSLLENDNKVKLAGLDVDGILRGKLVSKKKFLSIASAGFGFCSVIFGWDMHDQTYLQELKISNAENGYHDLLAIPDLSSFRRIPWENNTPFFLVTFHDPDTKKPISPCPRGLLKMQLAKLQEKGYGAMAGAEYEFYTFRNPDPTNSSPATFLQQNPPHQLPSLTEGMFGYSITRPVHNQDYYYDVYDTCAAFKCDIEGWHTESGPGVFEAALEFGEIAQMADRASMFKYVVKSVGVKYGITPCFMAKPKSGLPGNSGHMHVSLVDKDGKNLLARDTPDENAEWDDIKHLSDIGRHFLAGLLEGISDVMPILAPNINSYKRLVENFWAPVTVSWGLEHRAASIRLIGPPTAKGGATRFEVRVPGADTNPHYVMAAILGCGWRGVEKKLKIPCPPLAAGQNVGGDADKGERLAKSLKEAVAKFKAEGSIAREVFGDEFVDHYAGTRENEVRLFDEAVTDWEMKRYIETV

SEQ ID NO: 814 - protein, 288 aa, Unknown
  Kingdom: Fungi, Phylum: Ascomycota
MRFLLQLTAVAVVMSTVSAQTQTVSTAEVTQSLETDAESTVGAQEQQTVTTDDGTYSLDNTKGDTVNENTGTNEGARTNVTETGGSGSGQDIGGHGNIVSGGQTNSDGSYNGYGNLNHDINSSYNGNTIINNNYGNAPKVVCIGDWCTEDPPCDEAAAGTGCTHQRVVSQDGIFHAEESKDAAWNRLVRCEGSRCHFNRCSDDECEQKIVCADGQCTQEPCRGEDEYDFDDESDEYRISPTCKGAKCPRPALPGSALLAKVQDDLQRQVQVQAHQAQQIVVVYMGSGN

SEQ ID NO: 815 - protein, 294 aa, Unknown
  Kingdom: Fungi, Phylum: Ascomycota
MAQKFSIKSAVKLNSGYELPRLGFGVYQISKEDTAGAVKEAIKQGYAHIDTASAYYNQAEAADGLRESGVPRSDVFFTTKVFTREKPLGYQNTIDSLNAALEQTKLSYLDLVLIHAPYGGSQARKETWRALVEYVEAGKVRSIGVSNYGLHHLQELEGHIKELEEERGGKGKGGVISVGQWEVHPWLTRPDIVGWCRERNIAVEAYCPIVRGTRFDEPKVKALAEKHGKTPAQILLRWSLQNDLVPLVKSVTPSRIAENAGIFDFELSDEEVEDLRTDEYAVCAWDPTKEPLDK

SEQ ID NO: 816 - protein, 440 aa, Unknown
  Kingdom: Fungi, Phylum: Ascomycota
MYSKFWPKGGLPGILHHYTETLVTFEYTTSAVSQPHSILFVGGLGDGPATTSYLADVVKGLQPTQWSLFTLALTSSYQSWGLGHLDRDTDEIAQCVRYIQDYKTSKYGAAGKIVLMGHSSGSQCVLHYLSRPNPHTSKPSFDADLEHVERPVLDGAIMQAPVSDREALLWVLKTGFGDKSPEDMRVVYDNMLAAANEAVKGGSELDAILPLSLTACIYGYNTPLSARRFLSLASPDSPQSPSEDDLFSSDLGPAQLQRTFGQVRDVGLLRNKLMALISGADQSMPDWVDKEGQLAKWKSATNGAGGPEIWDSEHSAVIPGASHALSDDYQEEPRRFLVVLFFTTVGRLTSDKTHHSSERDIPGELKKEIEFRLDSSSSRWIAHSPTLPGPRPGGELPFSSAPLGSSQDGFAITHRAQSPSVAAHPSLSANPREANVILTS

SEQ ID NO: 817 - protein, 707 aa, Unknown
  Kingdom: Fungi, Phylum: Ascomycota
MNPAELVHFLADEPPSVVRLEIEKHFEGLNDQQKRYAHFISKAAFAGTRIVLRQLSPESEPIYDLLMTLHKQCAGDWNALAKKAGIEESELAYFLQYAAMFLGNNGNYKSFGDSKFIPRCSEKTVAALAATSPEASKYYEATNGAIFSSNEPSKMHLGYPDAGHMTTYYPDSPNITKDEIDAVSAWMEKKRLLPENNRLRKHDDGNFEILIASATADPSPEARDIGQETEFTVEDGLLKGKTIKITYGDYAKEMASITEYIKQAAANAENATQKSMHEAYAKSFETGSLEAFKDSQRFWIKDKGPTVESNIGFIETYRDPAGIRGEWEGLCSMVNQERTRAFGELVSSAPKLIPLLPWSSDFEKDKFLSPDFTSLEVLTFAGSGIPAGINIPNYDDIRQNEGFKNVSLGNVLSAKAPNEKIPFIRDEDQEVFRKHRDAAFEVQVGLHELTGHGCGKLLQETEPGKFNFNKENPPVSPVTGKPVTTWYKPGQTWGSVFGSIAASYEECRAELVAMHLSCEFPVLKIFGFGDGSEDINGEAGEVLYSSYLSMARAGLASLEMWDPKSRKWGQAHSQARFSILKCFLEAEDGFCKLDYTKDDLSDLTIKLDRSKILTAGRKAVGDYLQKLHIYKSTADVDTGRQFYVDMTTVDPEFWGKKVRDVVLNNKQPRKVFIQANTILDEASGRVSIKHYEPTLIGMLESWADRDL

SEQ ID NO: 818 - protein, 427 aa, Unknown
  Kingdom: Fungi, Phylum: Ascomycota
MRSSRLSRDTAKLFDRTSPAISTSTSTSSTSRRTTRASLSRFYATSHSTTTTATPDIEDAISTPSPKRRKLSSISPIKAELVEDALQAIPSPPRRQRKPARKATNPNTGSTTILPPSDWEEIYTTVKKMRQPGGAAYPAAVDTMGCERLADVDASPRDQRFQTLVALMLSSQTKDTVNAVAMAKLKKDLPAYEEGKPKGLNLENMLAVEPALLNEMIWAVGFHNNKTKYLKQTAVILRDEWDGDIPSTIEGLTSLPGVGPKMAYLTMTVAWNRTEGIGVDVHVHRITNMWGWHKTKNPEETRLALQSWLPRDCWRDINHMLVGLGQSVCLPVGRKCGECDLGLEGLCKAAERKKVIEGRRHVKKEEVVEEDGTVLKMEQVKSEVVIKEEVVNEAPDLGDAAHSPRLDAASGETAASGRKRRVKRQAT

SEQ ID NO: 819 - protein, 543 aa, Unknown
  Kingdom: Fungi, Phylum: Ascomycota
MASDQTNPDLESFRQQWLSDLRSRDAPLPSQTAIHSTSRPAHRTRSPISRRHKASVSTSKAQVDDDDEPDYVPTLTFDGAPSQSDQTAADNVETPEPRQLVSALDHYEEAMEKEAQGNMGDSLHLYRRAYRMDQGVDRRYREKHFPAGFQNKAKPQATPEAQAKIAPSTALPIATQTQAHTESTPQVLSFGDLIASFASLQIEPVAPDVEGTEPPPCPIAHLPDELLVHILEDVAVFDVADFVRLSLVCKRFAYLVSQEQCVWRTICMSDRFGFPGMHHHWQQSIEWTPLEGELVQVSDQPSLSGEDPTSPRFISRSEMNRLQHADKLSLTLLLVPSQYQSWRAMFRSRPRIRFNGCYISTVNYIRTGVTSTNQATWGGAPIHIVTYYRYLRFFRDGTCISLTTTSEPVDVVHQVTKDLLQQHRDAPASSHLPSAVMKHALRGRWRLSSTLADDGEDQGPPISGTAPAGAEGELFIETEGVGPKYIYRMDLALRSAGKAARNNKLVWKGFYSYNKLTDDWGEFQLKNDKPFFFSRVKSYGFGI

SEQ ID NO: 820 - protein, 145 aa, Unknown
  Kingdom: Fungi, Phylum: Ascomycota
MEARCQCGSTGSAFGTSAIFPRFPVPNTESLSCYARPTASGHTLYCYFCKICGTRLFHIEPTKDVISIKGGCISGLDWTTAIHIWTRSAMVPIPEGSETHSEESSGSTTYGSTQELLDQPSDPPSSGDEAPPERKPVVGACELSG

SEQ ID NO: 821 - protein, 384 aa, Unknown
  Kingdom: Fungi, Phylum: Ascomycota
MAALYAAAPAASAMVRNCPSGDSGACYQWGVPSTSSSSDNVYFQIEAPSSYSWVGLGLGSRMAGAEMFLVYKDGSGNVTLSTRTTSGEVEPHFVQRGGVELLAGSGIKDGKMVANVKCSGDCSKNMDRSGSNNWIAAWLSGGQLESSSTSADITEHTDHFNFGIDMSKASISADSNPFVGTLADSPSSGGGGNSNSNSGGSGVTAGSSVSPKILTAHGVVMAVTFAILYPIGAILMPMLGQWLVHGVVQLIAFLLMWAGFGLGYHYSNKRGIFFDDTHMRLGTIVVALLGIQPILGWLHHTAYQRHQRRTFISHIHIWYGRILMALGIINGGLGMKKQNTDSAYKIAYAVVAGVLGGLYIGAAIWGIIKNRRAPRATSKGSGSS

SEQ ID NO: 822 - protein, 813 aa, Unknown
  Kingdom: Fungi, Phylum: Ascomycota
MAPDLNSMPPSALNVPAKAPEALASKPNILYIMADQLAAPQLKMYNPESQIKTPNLDRLAQSSVQFDSAYCPSPLCAPSRMSMISGLLPMKIGAYDNASQINSEIPTYAHYLRSKGYHTALAGKMHFVGDQLHGYEQRLTSDIYPGDFGWAVNWDEPDNRLEWYHNASSILQAGPCGRSNQLDYDEEVMFKSTQYLWDHVREGPNKGPFALTVSLTHPHDPYTITKQYWNRYEDVDIALPKVRMAKEDLDTHSQRLLKVCDLWDQDFTDEQIKRAKRAYYGSVSYVDDCIGKLLETLEDAGLAENTIVIFSGDHGDMLGERGLWYKMSYFESSVRVPLLVNYPKWFKPHRVSQNVSTLDLLPTICDLIGTKPAPYLPMDGVSMMPHLKGEEGNDTVFAEYTGEGTVRPMMMIRRGPWKYITCPADAPQLYNLDRDPLELDNLARFRKIEPETEEQREAKELFAKFDAEAMEKWDFDAITAKVFQSQRSRRVVWDALKLGQFTSWDFDPIDDGRQKSSKRDHQHPSLGHEGVELAAGISTSNAPRLYKMATLGLDDDELKSVEQTLSRLVQLSSSIQSLKTDVLRSNPLPHPSSMQNSAQILQRNLQVVLDSVTDNADLFSRIAVHPSPNYPGRTQENVLGQLLRKKLEPDVADLVEEGREAAALATPEGVAALQDVWNELREWTVDRIATYVREEAGDVYTKEEREAGVENVRTGLRRDLEESDEEDEDEEDEDEDDESGEKMATDATAGQGGAKTKQENVTRGPEPETILWFAARGDFDVPPQVEFQRKDGPYRGLQGVSVPPDRMEGVGQS

SEQ ID NO: 823 - protein, 460 aa, Unknown
  Kingdom: Fungi, Phylum: Ascomycota
MRRSGAVRIPLAVVALASSACAFVVPPAQLPLVAEPHQSASGAWWDSLRDLASESSLNPHLPNADELVAALEGKVDRISAGFEDVAKSLKNLQSSIVDFVSNDDEDVTAYGSEHGHREYPDYTIYELIKKSNYTKKFAAAIDDYPSVVKILNGTDAGNHTLFVPLDEAFEHLPEHGDKPSKEFMESALLYHIGLGDLPAIKLLKANTIPTAYNESWLGDEPQRLRPSVGLGGLKLNFYSKVVAADFKAKNGIVHGIREILIPPPMVGRELTLFPGEFSTLLLAYEKTNFVDFIHNVKMVGSTVFAPSNKAFQKLGPRANAFLFNTETGLKYLKAILKYHIVANATLYTDAFYDKTDSTDEGDSLFAGAEKREHFDLVTLLHNLHVSVDILEWASLKFVTVNGFAGIQVRDGVAKNGVIHVLDRVLIPPHKHEHEHAEVDNGLWEGEMDVDTLKSRLEDYV

SEQ ID NO: 824 - protein, 223 aa, Unknown
  Kingdom: Fungi, Phylum: Ascomycota
MAAPFHHPFQESQFNLFVWYPKYLDCQRFFLERAQYSVPVQTVAAFINIQLPFQKGETPASPASGSTASSSPANEYDHVHVSGSSHSSSRAAGKAPARHPSPPTTSLIPFIRRLVATGFDNPGTMHGFFGDEWREGVGEMHEMERRNFLFAAKSDTWLKVKAHYDMPDGQVVPFLRPLARVMEKEIQSAERDWSNWLAMQDWMLGPRSLADDSDGPRVKMEED

SEQ ID NO: 825 - protein, 1138 aa, Unknown
  Kingdom: Fungi, Phylum: Ascomycota
MVRIIPHRLLSFSSVSSSSPPRSPSPSISNLRDGYVARPPMRTKSDPSPSRDASNGLTLKVLILKARNLAAKDRGGTSDPYLVLTLGDARGVTQSIPKTLNPEWNTIEEFPVTSTNSLVLDVICWDKDRFGKDYLGEFDLALEEIFQNEQTAQAPRWYPLRSKRPGKKTSIVSGEVQLQFTLYDTTNPSATPQQVLDKLSALSSCVPVASNTPSMTPTTSPGGAIPRSVPGSTPPIDEEDEDLIDELDEDSSDETEDPSKPETAEKRRRRLRIKGLKRKKRENPYAFTNGESDLVGIIYLEVVKITDLPPEHNFTRTSFDMDPFVVISLGKKTYRTRHVRHDLNPVYNEKMIFHVQGSEQKYSFAFTVIDRDKYSGNDFIASCSLPVQQLIERAPRANHETGLYDLREPPEYIKVASRGRFKKLGMSRTSSSQSLSKMIRPGLSKNPSTMSTASAKEGAVVDPSQGVKSALLAPADSLANTGIEVSTEQAQADADDADFSDFVIPLKMKNLEKWEDKHNPQLYLKAKYMPYAALRQQFWRAMLKQYDADESGNINRIEMTTMLDSLGSTLKETTIDSFFQRFPHKAADNEEIWELTMDEAVICLEDQLEAKSRTPNLGDKVKNLVPGVKNLLNAATRPNDQDSESGSGTSTPHIVLDTEHSEAPTLNPSELTTTGDESDSADKDDSNEEHVVEIRECPICHQPRLNKRKDTDIITHIATCASSDWRQVNNVMMSGFVTASQAQRKWYSKVITKISYGGYKLGANSANILIQDRLTGQINEEKMSVYVRLGIRMLYKGLKSREMETKRIRRMLKNLSIKQGKKFDDPTSRDEIEKFIEFHGLDMSEVLLPIEEFKNFNEFFYRALKPGARPCSAPDNPRIIVSPADCRSVVFNQITQATQIWVKGREFSIKRLLGNAYPEDVARYEGGSLGIFRLAPQDYHRFHIPVDGIMGEPKTIEGEYYTVNPMAIRSALDVYGENVRVCVPIDSKEHGRVMVICVGAMMVGSTVITRKQGEHVSRAEELGYFKFGGSTLLVLFEPGRMVFDDDLVDNSNRPLETLIRVGMSIGHSPSEPQWTPDMRKKESEITEAEKKDAKRRIQGNLPLQDSPDGSGAEVEDVPSSPKRLSNRPTMDTFAASAM

SEQ ID NO: 826 - protein, 1543 aa, Unknown
  Kingdom: Fungi, Phylum: Ascomycota
MAEVVKSNTKHEEKPRVARAVVENRHNFAFALVAVISAAAMYSLAPYLMLGLDWVGQVLSKPTSASPQVKVLNGTYAGVCSREFKQDFFLGMPYAKPPERFTLSEGLDQTWNGVHDAKKYPPHCVGYGDDMIGYEQSEDCLYINVVRPAGIDETAELPVAVWIHGGGLVMGGSADRRYNLSFIVDQSVKMGTPMIGVSFNYRLSAFGFLNGKEALQAGVTNIGFRDQRLALRWVQENIAAFGGSSNKVTIWGESSGAESVSAQVLAYNGRDDGLFRAAIGQSGFGGMLPRLPGGFNATDLAQTIFDSFLSSTSCADTVGTAESIDCLRKAPFEEINATLASSGASYAWPPVLDGDFFQDYTEHQLNLGHFAQVPLLVGTNTDEGTGFGMGRGPGGQPVNTDKEFKNALLPGLGGENTDETPEELAAELMKLYPNDQSVGVPSLETWPHVIRPGDSFAQQLGAQFRRVSSVFGDHFMHYARRRANLVWTDKNLPSYAYRFNVIPNGIPEFLGSLHFQEVAFVFLNLNGDGYAVNPFGQGNETYTTQAKELSRAMGSAWVNFITGLDPNGADGLPNGVIWPAYSASGKIGQDLVWDLGEKSVAESDDWRQEAMAWFIDHALSLIHPVHITVTYCIWELINEAQLAYMSSSGLPDADASRPRSGILTPTSDGSSHRRHAAREVFSEPSRCDRPGDGAMDQLMHAPIAVKPHPHDLHVKPRTLHPILLLPRDQFALANIDLGNPCGDLPLSRLFECRVKILELEGRMGMATSVVIARSEVKANLYALERQPSGLYVICKLGSWVDIHELAQHATVVSHRELRPADSTRKPSMHDTALTKPPVYKEHRQKRAAIEAIQSLVRKRPRSATTASIDVPIKSEPSDPARPEEVTPGQVSNSVEIPPTEMAELQLPNTAPVQCDNEPNLSGPPTSDVILETIRTQYFEALYKSMGSLAYFAKGPLSRARSTFHLDLDTNLDMAELIDFLKSMVLTTVQIDKKYRETVPDILAKPVSTADSSDEGKRKRKRAKKMKLGKNGLYPCEDDMIRKWWSLHKPEERDGDATTSGSDTRSHIAMLRTRETQLQMILILEILALEPLKAVDDTMDSLLPDLPGAAQTQDLMAPPATKKRSKHNLPVLLDVHADRLTIWQSTAFDDHVWSAESQSSAAADSPPDKQASSEPLRDFCVDVIVPFFSARLPKQCDAINKKLGGPVIVSPPKPKSSKQTSGSKSQRPGSSAKRQMSAKKPRTLQRALSTDLQHRRSVSRGPSNALALLRSASSTTVTGVKREGSEPVTGDPELSRQGHGILSRSSSMVIAKNPRAEKMALVEAELKDAISALRKPNRDVVGKAMEEAAQHKLLSARKLKKPNRSSMSAVQVEATPANNRFRDVLAARSDNIVDLPVARTEDAIPPSSVGPLVPSTGRKAMRDAAFGVSPFGTAIGSTPVKTSTASSFLRRADGEIAIPPSSPLVGRKQESIQQRLSASSSTSHKGGFGLSQSRDISVFMTPVKKAAAPMDIAAAENIGPSPVLEVKTTSIYDKLGWDDDFDDL

SEQ ID NO: 827 - protein, 681 aa, Unknown
  Kingdom: Fungi, Phylum: Ascomycota
MLVAADQILTRGPVPHPLYLPYPCLRIHSLLKYSTIIQQPAKFDRRLFLSSSAHPKATQDEEKKGLVDHLNFILCTPPVLIHIPRTLSPPAPLVSYNKSAPLFSARAFLDACGSPALHLLYSSTVLALPPRRAIYSGEASQKDKHCYIFVCLLRIRHFGSPFASISSFRGPDYRLLCTKCDRVITASPQTNPQPRTQHSLTKRAAARHFVARVQLGLVFDRAWPTTAIGKTITRTRNSLRHPNHQLQAIRDGTASAHPQAWLLLLPFHLSTTPDPPGMARHHPPQRAKGVVTDQILVMSHPANLQTAIRRLAINLLPNQPATSHLHSTIKGILVHPPIHLRTREVTTQIRGTLPPIPMIPTAQMHTTIPALLRLATPHTAQMHAWPMALQAKGSHRQLLVSEPALRVGTAASGRCSGYQSAPGGKCQNCARMGQECIFQPVSSSSSAAFIPVSAVPGGVPPGTPLYGAYGQPLAPAHHQAYQAGPPPPNGPHGPPPQHHAPSGPYYQPAAHSPTESYSSYGDPRAEEAAAAGRRRRRTSEENDEGYRLPPPRTSGEDDPRRRSPAEFSNNSSPSGFGHSQHSIGARQSPRGPPLPQPPAGPAQAPPNAGARSPGIANGSSGASTPAASGQGGQNSQQGGGSSVMSLSNLVDKNDIDQGMINRLNRPKAPGAPPSNASNASR

SEQ ID NO: 828 - protein, 350 aa, Unknown
  Kingdom: Fungi, Phylum: Ascomycota
MNALAKVLAFAAMVAAAPSAENRGPSPFEVKLEMLGNSEIKATFTNKGNNRLKILRTGSILDTSSVEKAKVFSGETPLPFQGARLRLATNVLDDSDFQRISPGETVEVTFDIAETHDLSSGGKFDVLADGSFAFADEKSNILIGSIPYVSKHIGAEVDGAIAAAVHSAFHEKRTRVQSDCQGQQLQVTQTALRNCASIARKAQQAAASGPAAKLQEYFKSSSQQVRNTVSTVFGRVASECGSTNSGVSTYHCRDPYGNCGGRVLAYTIPSYSVMVYCPLYFNNLPDLSNTCHAQDKANTNLHESTHLTQIKGTDDYGGYGYDFVRSLTPAQNLNHADTYTLYAQAINVGC

SEQ ID NO: 829 - protein, 521 aa, Unknown
  Kingdom: Fungi, Phylum: Ascomycota
MSRVLNEDSSSPSGLEKNDTRKRRGSLSNTAAADDLLENLGYKPELSRNRSTLQVAFMSFVLASIPYGLATTLGFPIVGGGPVDIIWGWVAVSLIIVCVAVSLGEITSVYPTAGGVYYQAFMLAPAKWRRIASWICGWLLLVGQITITLAVNFGTTLFFVACVNVFTDADGNGVFEGTNWQVFLIFLAITLLCNAVSSLGNRWLPLLDTAAIFWTFAGVIAMVITILVMAKGGRRSAKYVFTSFEPTSGWPDGWSFMVGLLHAGYATSSTGMIIGMCEEVQEPSVQVPKAMVATIFINTFAGLLFLVPIVFVLPDISTLNTVQPVPQIFLEAVGSPGGAIGLLIPLMVLALMCGIACTTAASRCTWAFARDGAIPGSKWWVKVNKKLDVPLNAMMLSMVVQILLGLINFGSAAAFAAFSGVGVISLTAAYACPIAISMFSGRKQIKNGSFYMGKFGLFCNIVAIAWSALAMPLFCMPGAIPVTVDTVNYAPVVFVGATVISGVWYIAWGHKNYAGPPTHED

SEQ ID NO: 830 - protein, 388 aa, Unknown
  Kingdom: Fungi, Phylum: Ascomycota
MKLTQGLTAALAGLASAATTQQSAQVYLLSSSSAPSSQSPASLPASLARLVFLQRLSPFGKGPSVLDGTADAKLDDVVDALNRFGKAPPPMHPDGAELSPQQLVLILEDMTPTQMAELGKQVEGAYKGMKPAFEIPNPPPTRAHDDLIDIDFYNAGLTSHTKCEIDLIIDPKNDKCWDDDAKSNVARYNLDKIMDKSGAALKTIGELTKNGAIEVLVVALPAVESSSVKSWRPDELRRRQAEEVMSIIDSEDEPAETSKAQEHDFFISTKARKNIPACFSSEDSCVTSTGNCSGHGMCQNRYAKPDGSEGKEVCYTCHCLSTVSDSGSLTHWAGGACTKKDVSTPFWLFFGFTVLLLGILTLSIGLLFNVGEETLPGVIGAGVSRPSK

SEQ ID NO: 831 - protein, 323 aa, Unknown
  Kingdom: Fungi, Phylum: Ascomycota
MSRHVLGMGLLAVTVAAQATLASSGFQYVGCVEADPKLFGLNIDFSTPFTPQQCQAACAGKATYTAIGGGCHCDVPSQQPDVTFKILDEAACAVLCIPGSPDAGRCGGSGEGETAGHKLYSLYKKATEARHAAAAAHKDEDCDKEEDAVAAAANMIGTVSVVIQTVYSCPPQKEDCPLRAATQLPVPASCPPGGCQPSAAAATISAAVCPPGGCQPAPAPAPAPAPTSTTAPAPCPPEGCASVIINNKVPQACPAVLACLPFRLRGATTTRDICDSYPYAVRLSLIRMLWMQRPNDLGSRPIFVLNQIDRGTHVSDKAPASAF

SEQ ID NO: 832 - protein, 588 aa, Unknown
  Kingdom: Fungi, Phylum: Ascomycota
MKDEAARRYPSPSPTSTTTSGSQSPSKQLSDPIGMPSDGSTTAGRDGPPPAKKRKTAAPKERTTEYLDLMKEDPQFNEEDRRQLERLKAALHKKKKIVVIAGAGISVSAGIPDFRSSNGLFATARSQHKVKASGKHLFDASVYKHNSSTQSFHTMVREMAQMSQEAKPTPFHHMLASLAQQGRLLRLYSQNIDCLDTSLEPLATNIPLNPKGPWPATVQLHGGLQKMVCTKCSELSPFDGAVFDGPEAPLCPSCIEQDQVRTAHAGKRSHGIGRLRPRFVLYNEFNPDEEAIGNVSSADLKARPDAVIVVGTTLKVPGTRRLVKELCQVTRGRRDGFTAWINIESEPKGIDFKDCWDLVVKAKCDDVAREVNLDRWDFTLGEDYLVSKEQDVEIQERCTKFTIKVDIPTVKSEDESADPKQKVLQDVQQHMPTPGASPTISAVKPATKIKQSKLSFGKHTGTSAEGGPKALAKRGRKPNSKKATKEASKQTVTNHFKIEKVADRPLSGKPGMDDVKSANLPELRPERKRPLSPSFMWTPEKADKITETLVVSDIPTTPQQQQLSLPPSQHTISPKSVPKGMGTLIDVE

SEQ ID NO: 833 - protein, 1200 aa, Unknown
  Kingdom: Fungi, Phylum: Ascomycota
MIAFCFYPNTVTVAATDRSRSWAKHCAKLLFASLHRSGPFALHRPPPRHPFIPRPGYSSTATLSQFLRILLEHHILDFVDSPPLVDLDVPAAKHVRERYGSATRMPYTKLRGGRVSSRPFYTIIFLITLFIAFSYLAKTTDKQPFSDDEVRLLRRSEKLECADVHRAVDQCAFVKEFCADDDAGLIPYLRFYYCGVGSARPVALVAFTIWLGLLFTTIGIAASDFFSVNLSTIATVLGLSESLAGVTFLAFGNGSPDVFSTFAAMSSNSASMAMGELIGAACFITGVVAGSMALVREFRVDKRTYARDIGFFIVAVAFTMVFLADGNLRFWECWLMIGYYIVYVITVVCWHWYTTSRRRRRRREGEARSHFYGAVSQQSDELAGEPYRDDPDDIDGDHAEHRNPADLDIASAEAGPRIEIESPGTTRVDTDQDSEEHERMVAAEVASSMRVLRSRGKRSSTITPIRPSLVGALEFRSALAQLQRESNHRLADMHGRSLSEARLDRSPRGRAKSVAPGLTHDDADIWQSNGATTGRARAWSSGAASERVTTGPAIAITEQDNSSLVQPFSDVNASSHEPTAPYTVGGSLAPPPSGTAGNTASCPSTPTAGASGDGLPQLLLRIPSRRSSYSDRSTPASPFPAFIESPMVTTPQAPSGDADLSLPAPARRGDPFVGLQGSVEEPRPVAWWPYAMLPPPHVLSATLFPTLQGWKEKSIWDKLMSTISVPSIFLLVITLPVVDSETTSGSSLLDTIQDASSAAALGHLAPEISTEEDAIEPHSEWARYRRHTLSRNHSFQSYRDRSPSVSPRMVSLSTEDTAVAQPSIEVSDSLIYHTVAKPTSDIATASIANEESPGWNRWLVCVQLFTGPLFAVFILWANLLEDFENPNTALVRMILYTLLGSLIALALLLLLTSEHRRPQAHYLLCFLGFVISIAWISTIAGEVVGVLKTFGVVFGISEALLGLTIFAAGNSIGDLIADITVARLGYPVMALSACFGGPMLNILLGIGIGGVLVMVRKANHKHHKHPDRKYTYGPYPVQVGGTLMISAITLLVILAGMLIAVPMNKWILSRKIGWTLIAAWTLSTIINVVVELTGIWGEAAHAGPDVGSESWRRYASMSVPVVFSSYKDATSADIARSTCCTVHAGRGIYLMASEASEVLFHKRGVQRRSSHIVGGANAKDSFGGVQELCPTILIPLTPFI

SEQ ID NO: 834 - protein, 540 aa, Unknown
  Kingdom: Fungi, Phylum: Ascomycota
MLAHYLFALVLAAWTPLAAGKPTSTGPPDATASAEWFLCDLLGCASETTVTRTRWRTTTTTATASITLTVSRTCELGSTTTPVVSSTAVTTSSKATLTTTTSSEIASGSTTTALNTTLISTSISSEVPTSIATSFPFTNTTTAPATTMITSAPFTNSTTAPTTSIATYSLSLNSTSTSGTTVTLTSAFTSSSVISSVPASSKTSWIPITNSTSKPSTTAVSSTRWLNTTRTSAATTTPTSNITLSSVSSSFLNSSTTVSRIANGTVTITPSTTLTPTSGFPSSSVVVTTTAGRSVPSPSKLQPFECLTDGYLIQSKTLLQVNLRTGARRVLATGVGGHGVPGINSLGYNPLDNYLYGTQGQALVRIGRDGRTEPVLALPSAANLGDVDIAGQYFFSDSGAAWGQVDLAPGSPRYGQLVAAGNATHGGLRRLSDWAFTPAHPGYAYSVAIDNRRVPTLARWSTETHEWETVRWYDDTKLRATLFGAVMATSDGVVYASDNASGQIFRFPLRDPASASKAGVGPRARSSDGARCALVPDASE

SEQ ID NO: 835 - protein, 495 aa, Unknown
  Kingdom: Fungi, Phylum: Ascomycota
MPALAVWTMRITALLSVVTVAVAQREIPAAELVSKKSNIVPGPLRVTELTFEVPLDYDDPEGETITIFGRSVVNHEVPLVPSDDEDEDEIPSLPYLVYLEGGPGFGNREPQDHPLTSTALERGYQVLYLDHRGTGYSTPVSTRMLSQLDGGEDAQVDYLRLMRQDNTVRDCESIRKALMEGKSDNQAKWSIFGQSYGGFVSLSYLSLHPEGLREVFLTGGLAPVKRTAEEVYRSLYPRVMKRNEAFYRKFPQDIETVHQIVDHIEGEGGAIDLPAGGSLTVPRLMHIGIDFGGAGGFDYVHTTLKNMKMSLDQFGFLSRASLTPIESFTSFDNNIIYAILHEAIYCNGPNDASNWASDRVAREMDLFPWLSSSSNSSSSRNTSEPLRFAGENIFPHFFDTYPELIPLKGVANKLAEVDDWTYIYDKEQLAKNEVPVYAATYVDDLYVDYEYAKETAELVKGVKTWETNAISHSGLRTNTAEVLGALFNLRDNVMD

SEQ ID NO: 836 - protein, 639 aa, Unknown
  Kingdom: Fungi, Phylum: Ascomycota
MAAQKRACDACYKRKIQCDWEAKHPRCDWCEHQDLSCTFDRVRGRRKGRKARVVEAAAARDSHPSPSSLGKHTEEEPAQVPFLVSGQPNPHKLFLQAHDSRSPSSTHSPSSRDHVSYAHINYDGCHFGHLSHQNGMPILTEEGRRWISSRAGEDVSFRKLQPQPRRYMKHQFLADALCKDSPSIYALPEKSLTAKIFDVFIHSAFSVVFPLVDKDLFPETLALAYESQFEPLSIECVSAKACVLAFVSSARLFSERDTPLPNLDSERCAAQARHLLSCTADEATLTSLQACVMLTLYETSTGRLQSGTTFHAVACRMVFGLGGHTRLPPKHITTRSDRERRHIRILFWLCYIIDKDTALRTGQPPLMSGEYCDLTLPDGYDECYTTFLPRLHEKVPLSDDEAFTPHLPEDPRLGHLKEKVSRRLYSAEAVKKTNAELLRDIRELDEELEAWRLSIPAIFRPALSISNKSRVDVGDCLPRSMTHIIMHLGYHHVMTAIHRASSRCISGADAAADAEEWLPGVKSSMALALEASRSTLVYLRAAIRGVAGEAFWMIIFYPTHAMMALFCHILMDPLNPDVEQDVALLASTAELINILPIQRLTSHELAHIELVTEFVAELCHLSRKAIAKATAEYEHRQAL

SEQ ID NO: 837 - protein, 93 aa, Unknown
  Kingdom: Fungi, Phylum: Ascomycota
MASTGVNVIRWSALAFGVFFGFSHQRTITANQKAAHDQHEWEHKQKLIDQAKAEYAKLKNPAPASKGDDVITDPQNPNFDLEKLLLKVAKENP

SEQ ID NO: 838 - protein, 574 aa, Unknown
  Kingdom: Fungi, Phylum: Ascomycota
MDSPQLKTARVSPAKSNTLLYVVGVVLGVHVFIMFMSAPLLRVVVTLVSWGIRKKTEGRKQQLIQLMTEEEEKSGDDKRSSSSEEWEKIQATEEETPKKKGGKITKEWNRSWDGIVGFFHPFCNAGGGGERVLWAAIRTTQNEWPKAKCVVYTGDHDANKDAILARVKTRFNIELNAKRVTFLYLSKRKWVLASTWPRFTLLGQSLGSMLLLWDAYSLVVPDIFVDTMGYAYALGFSKLLFTEIPTGAYVHYPTISTDMLSSLDSQSKSEGVNAGQGAGTRGLLKKLYWNLFGYGYSWVGGTVNVVMTNSSWTYGHIRRIWGPFRGARKNALSPIAVVYPPVAVEEVEGEVEVSQVSEKSREPILLYIAQFRPEKNHELIVKSFAKFVKTGTEAARKARLVLIGSVRDDHDSKLVYQLRLLVNELHVKEQVEFELDAPWADVLGWLKKASVGVNGMWNEHFGIGVVEYQAAGLISVVHNSGGPKLDIVTPIEGEPTGKPPGSRGNDRMYSQDLGYLATTEEEFAESFEKALTVPNPLAMRQRARASAHRFSEEAFATKWVTQFERLVYMTKTGF

SEQ ID NO: 839 - protein, 327 aa, Unknown
  Kingdom: Fungi, Phylum: Ascomycota
MFARSAFRAAQPLRMQARRYATEAPKSGGSNTVLLVAGGAGLAGAGYYFLSGSPTGNKVAAAAGVEPKKAFTGGDQGFLSLKLAEVENVNHNTKRLRFELPEEDMVSGLHVASAILTKYKGPNDEKATLRPYTPISDEGEKGFVDLLVKQYPNGPMSTHMHNMTPGQRLDIKGPLPKYPWTENKHNHIALIAGGTGITPMYQLCRAIFNNPNDKTKVTLIFGNLTEEDILLRKEFAELENTYPQRFRAFYTLDKAPKEWKGNSGHITKELLKQVLPEPKSENVKLFVCGPPGLMNAISGNKVSPKDQGELTGLLKELGYEKDQVYKF

SEQ ID NO: 840 - protein, 660 aa, Unknown
  Kingdom: Fungi, Phylum: Ascomycota
MDSLEGVMLIPPDRGQLLGRAVWKARYVVAGRKGITREQQNSPSYAKLTGSSRASQSVAKISTEDYCLSIYKTKVNPPQRSSSQRHAKPDHVQPPVDRQDNWEPTHQWPLSSVVDCSVQTVAHRKQGPVLPTLIVTISDQQRKRRSSRAAGLITSNKESSSTTVLWFRSPNDEPHVSLHEWVRFIMSRRGAPMSPDSPMSPVLTNPFAPKPREGSDYFPRPSSHGRGLQHKASTATYSTNGAPRERPLTFSSESPSLRSKRSDVSSPSSFNYPVQQSPFSIPGQHYTTVLPTDIPSPTTAGPADYQGEFIEGWTSAQGRSSTVSSPTRGRDSISSHAHQPSVTESSSPPAPRETILDRAFQLRCIPGSDADVPGEEKLSSLARFDALMKEADEKRKQRESAQRAEQAAMRSTFEADDSSDEEDVVPESDTDTENSDAYSNEGEGRSQPSLIPPTTKRALKFIASRHDLTEEPDDQVPTRRPMSRNPVSFHGGIMSSLTQAPPSRPHTAHAKSRPNQVGGVSGPASPPLPASATEKSGLSSATTVVGGRPSEEGTVRPSIEKRQSSSSAKRLSFTEFTKRLSSTSSLLLVQTNASSGSSRESGEVQSFHQQAHQPVAGGPVPRSLQAHRSSMIYTRDRDRDEQDNKCGWRGSVIGTEGGFL

SEQ ID NO: 841 - protein, 239 aa, Unknown
  Kingdom: Fungi, Phylum: Ascomycota
MAPPKRALIAVTSAHAPLYPDNKETGYFITEVLHPYKVFKEAGFEVDLASETGTGQPDWLSQTDDWLPAEDRKIYEDKSGEFRQKLDNMLKASEVDPSKYGIFFASAGHASLIDYPDAKGLQSIGSKIWADNGIVSAVCHGGAIFRGIVDNKTGKSVINGRTVTGFTTKGEEEEGVLDTIKSWNRPTIEATAASLGAHYVSPPGPWDAFTKTDGNLVTGANPASGHVTAEAAVEAYNKL

SEQ ID NO: 842 - protein, 868 aa, Unknown
  Kingdom: Fungi, Phylum: Ascomycota
MATQTMYAHDGNLKHVAADAMGYPPQPGSPTLTNPDMILPDYPDYDRVGSPEDHIQQKDMLMWNNQPSATLRNHMLPPESFVAGPMTPTTPIIYGNGTMLSDIGEVTEVESNAGASGVRRASSRFSMQSLEDVAVRASSTTGSALAQRLPQKTTRERRSSMESTSTIRSSGNAPFADFDDAVSVDDSNFQGDDEESMASSWVDENPAQVHVAVQQPIVQRSADERYSTSLLSQRAEQILANAKRRLTTMEGNLTRARSSLSYSSMSNGSTPSPPLTRPRTALHETISPPAPAGHVRNKSDDGLHAAVDSTSFPQRSASALGAAGGYRKPSVARSGDVSGAGVFRGNHLESHYPLDTALEPLSEDDDGSVPDSSRASGQYSSSATPTLGTFSEKHLTRSASAAQMREIQDQMQGLKGKISSLKEQARADSLRRRSLQSLRTPSPFTHARWDQGYAGARGANDSEPPSPALVEAEDEDSTPTETIAPKLPLPVHKQVLEPEAGDVGEQTIASHGATSPVPGEVGQALSPELEEARPSHEREGPETTAQSEVLDEDDTQDDSGDAISGRADSQTIPDEPEADSDGSEPKGEGSFSDYESDTGESLYHDSFQHLVSHEDREDAFDYEHFFLHSAMGNLRHTRRGSSSSTESYESIETARGPDRRSSIDTTASAESCAESFRTADDGRASRSSVSQDEASRTSNFGPRSVSHRAQHSMYSGFKFGGDVADQQDNRPRTNSVIYRPTSAGFGISMHRPSVSSFESTGTTRSFPLVNKTKLSSGVLTPGASPNQSGKQTSESLPLSETPSLRSSVFPSAVSMLAKEDRMLVESLIRGLGQCVFKLSENSRASTEGRLSLRRLEAARRILQGFDEV

SEQ ID NO: 843 - protein, 417 aa, Unknown
  Kingdom: Fungi, Phylum: Ascomycota
MPRDPLVGLVGKPSSGKSTTLNSLTDASSKVGNFPFTTIDPQRAIGYLQIECACARHKVSDRCKPNYGSCVDGRRSVPIELLDVAGLVPGAHQGRGLGNKFLDDLRHADALIHVVDASGTVDAEGKETRGYDPSVDIAWLRSEIVAWILGNLMNKWGSIKRRHTAVKATAVETLSGQFSGYGANQVVVQRTLDRSGIKEPLEHWSDETIRHLVESFVDEKFPTVIALNKIDHPDADKNISKIAKQQDPNTIVLCSAISEVFLRKMAKQGYIKYVEGSEFVDTREDLIEQGDPEGGGLKELDEKNRNRIENLKDMVLYRFGSTGVVQVLAKAAELLGLVPVFPVRNTATFGSGASESKFVFRDCVLVKKGSTVGDVARKVMGDAPIAYVEGFGNIRVSEDDVVGVGKNDILSFKVGRA

SEQ ID NO: 844 - protein, 618 aa, Unknown
  Kingdom: Fungi, Phylum: Ascomycota
MRPTQLAVPRRKLQSWSKPSTVCVFCSLVTPSTQSRPRSTRRFQSTSTASPDSRKDLAEALGHLQSRFPSLVSLSKLQLALRGLQQPAGREAVRVAILNLRDPAKDSKNAARDVLRLLLADPLQDEQDWERQLAQHPAGEPLIIRVRASEAADGTLTISRTNTLAEVEISSPELDGAELEILLSDLNVHHGSEASIPAADLEASILEPEVQIPEGTHFTPLATPVHKALLVGEGFSGATRITSLPLSQEGGVILTAVNLKGLASQEIDANFEAIDTDLATEGIHLFRKGPQHGIEYERLWYASNLPVLTKWLRSGIKSTDGITKPVVRTLLTSVLADATARINESEAQASSSNARVLAIPEPMRGGVASWAQNAHAELQDQLDLAFTGKRWRKLGWWKLFWRVDDVAMLTNEMLTQRFLPTAEQELVYLTGQIEGSLQSQPVYSQPASSRDGSEQTRRLGSGEMAPIVFPSSANGLPKWPGHIAFTRRYLQNETVPALQALAQKLVVQSIGTSGLTTSLAALLYVSSFSSTLYEAGAVAALGVMYSLARMQKKWETARGFWEGEVREEGRKAVRAVEESVAGALEKGSLSGDGSPAVIELEEARELVAKAEKALERLK

SEQ ID NO: 845 - protein, 264 aa, Unknown
  Kingdom: Fungi, Phylum: Ascomycota
MSVKFEETVKKAQNVMSGAEGGSIPGTSGKHPIAERVGTALTGGRQNAGTKGYLAAYIKQIEEHPLRTKVLTAGTLAGAQELIASFLAKDRNKHGNYFTSRVPKMAAYGAFVSAPMGHVMIWMLQKVFANRTSLKSKILQILASNLIIAPIQNVVYLVAMALIAGARTYHQVRATVRVGFWKVMRVSWIVSPICLAFAQKFVPENLWVPFFNLVGFIIGTYINTVTKKKRLAALRKKHFGDGRSSGMGPRQDDYAPSIGPNPPY

SEQ ID NO: 846 - protein, 2186 aa, Unknown
  Kingdom: Fungi, Phylum: Ascomycota
MVPPPRAGSFSPNPASNLQTGSIHSPHPSHAAALSAGASPSTSSPTGTSSLTKIVVAQVYLLLSTIKEDKDRAKFELQVDQLRKLIDEHGMEVFSKYFTRLVASNAPQIFPGLNRPVANPGNYHILVGEMRKIAHDIDQASKIAESIESGTEDIFRDFDLSTFMEHFKLDALEKTLLALAFKLGSRSDLKTKADAILSTNFMTFADIISRPDLEAHKDLTPAFIALIVDRLLQNHPPSFNASSRRDLSTCVSKRFANMDQPPPSEVLAALDIGRVLAERPANALARYIQKTGSDFTRDEETCLGYLQNRLNNVNLNPDQVAPALTYTAISITPQYDVGVLVKALLRIVPKSFDWMEVLLFFDQPSARISPPQFLRLYKALLPVTENPNFDIQRLWGGSWSEPEALLSFVCAYASHNPDQLDATTIPGLHRSINLEDYANSPPNVQERAAVAIRHPLVSVVALTSIFNMALSSMHASQSVEAKRLFQDVVVPNLDVFLVSAFEVPRQSWANMAVETINSLFDNFLQKRSPEYDFVLDSLWKKDKDWVINRLTEAHALRPLDLSKIFEHAVQHKWLDELVYRNNGFGLDLAALAHAEGYLDLTKWARVNADRSHEYSRSLLQFLMIKANLEMQYQHPPEGEAPVKSTTTLQVRTVAALLQILEDFLPKAPVHDLIVVQRQCITAYPRLINYGEGFDDIIDANGQEGNALPPSASSKMEEHYKKMYGDETQVRNIVETLDRYKHSRDPLDQDVFADMIHGLFDEYNHYGGYPLEALATTAVLFGGIISHKLISDLPLKIGLGMILEAVRDHAPSDPMYKFGLQALMQLLARFREWPGFCKQLLQIPGLQGTEAFKKAEEVVRDHEEELARGRNGTSTPHSLGFGGESFANGNPEESATERQAPPFASIGVEPIPPGMNFEEPGEDAQDKIQFVLNNITEGTLQSMCAELRSMMEGRHQQWFASHLVEQRAKMQPNYHHVYLQLVTMLQDKTLWNQVLRETYISAARMLNAEATMQNSTERTHLKNLGGWLGLLTLARDLPIRHKNIAFKQLLMEAHDTKRLIVVIPFVCKVLLQGAKSSVFRPPNPWLMDIIYLLIELYHHAELKLNLKFEIEVLCKGLDLDHKSIEPSGEILNRPAVEEPAEVISQEQLDAFDSLSLNGLTSAVGQGMSPQTIPLTLPDLGPLVNIPPTNEMVVSSSRLHEIVRSALTRALQDIIQPVVDRSVTIAAISTQQMIHKDFVTEPDEHRVRTSAINMVKATAGSLALVTSKEPLRANFTNYMRNLSNDLPSGLPEGTIIMCVNSNLDLACNIIEKQAEERAVPDIEELIEPELEARRRHRIQHPNEPFYDLTSTNRWALTIPNPYKLSPSLTGLNPEQMAIYEDFARQPRSALTSGASASHNPSTSDATRSIANEVLQETYMPAPNVPSSSETPSSQHLNAPMQSYPPVHNAATGNMTNGRSPSFQMDVRNLAERVNKLLQELLRVAGEAREEHFLGLPRPHPVLDVVDALVQLIIKTSQSSEEFAIYAAEQITSLIFQQVDDNLTLESLVHVLETLRKISGPALNNRVRAMFSSQPGAAFLSLPLLAALVRTDLVDWRNIDLALSKALEARKDGSLEFLEQMLDLALLNNKPIALFADFVRTLDASWAWISDEPSNSVAQRLKSKLMGSGSRSEDQGAVQQEQMEYVFEEWVHLFHNHNASEKAAILFVKQLQSRHVISNRDDFLVFIRIATDVAVDRFEHMYHAGLANEAYTATDALARLISLFVRMHNNEMLTRASFLDSVLALITLVMNHHQVKRGEHFNQRVFFRMLSMLLYDLQLIGEDLNDEDRRTIIISFAKRLANMSPSVLPAFAFGWMSLLQHKAFTSILLQLPDNAGWDAMAILMSQLTECLGELLKAPEVSLVGKEMYRATLKFIAVLQHDFPDFVAANHMRLCANLPPHCTQLLNAILAASPQGTKLPDPLHPGLKIERLEEMKIIPNVLDNSSAILNESGLLNVVDQACQNGPSEDIVAQLVHAMTQNPNKQTSFGYFQLNTDVRVTTAAVMYLGHHGAQRAAQASGALSVSGSEPEVATLSLLVHELTPEARYYALCAMVNQLRFPNAHTNFFSQTILYIFGKDLNDPEETEIRQEITRILLERLAGFWPTPWGLMCTIIELVKNEKYMFFDLPFIKSTPDVADRFAAVLQRQMPQ

SEQ ID NO: 847 - protein, 1001 aa, Unknown
  Kingdom: Fungi, Phylum: Ascomycota
MANAEDAKEPMAMPQPMADGEASDIVTQENVSPRGQVARQSSTKNQVRHRASVACASCRDRRIRCVVPQGQAECNQCRRTGTECIIKNDDERRRPISKAYMSSLSDRITMLEGMLKEKGVQPPPAVHPPKTRHDPHAKGTEEHKAAPQTTAQHTSPSQGVPSPPDSRNEDFMLNGDVDHAEGMMSNSQMLAQLSKEDSPFRMLDAKQEDIVYRLLATKGNLSFDQLSGRLRYFGSTANSHVYAESPDQFDSREPPEQVRRAERIIRSLTSSTHDYLMNHFWEYYNSVLKIIDRDAFEADRESQNPKFYSSFLHITVLAMGYRGADMDRDDMKKISLGNRESTLHREAKYMLDIELERPGGIPSVQALLLLGDLECGVGRDNTGWMYSGMANRLAFDVGLHLDCRSNGMPEQEIKIRHMVMRACTIYDKYWALFLGRPTSIKSQDIGMDLLQSAFSQLASGLSEPTPAERDVTCEIYEQLIELMDLAGRIVETRDHHVGKNGVNNVDRNNVFAIGEAEDNAYLHVVNLDRQLQNWYRRLPDHLAWKPANVKTAPYSYFLLHQQYHVSMILLHRPWAKYGAITGDGASSTGSHPSPDSAHLNMGPESAPQHPGAGAAVDHSMGMGDPHSMVHDSRTSLSRSICTQQAIRVARIFWQHRQRFDGRKIFVTGIQHAGTASIALIAALAYQRSDADRRTYLGYLEILSDALGDMSCTYQPAGRMDGLLKAVLSQIRTSMGEPPRSSSSSIRGGFPLDSFPGSAGQARISGASDMAAPLVPSRREADDLDFMNPAKRRRPGNSRRASEYARPPPPFFPGTQPTPPQSYAAEIHHRTSSHSEQHMMFQLGSADGSHMNLDFLGGSAVDMDASGEEQLDARQHNGENMNLVHGGSGNHNNNNWGLGSMHSDHQAGHQSFDPSSLGTEWNAGPAGLSASSVLGQSAALTNGLMSASGTLGATPRTLDDDERGAHALMNGMSPGSLNGLVQSVEKDGDVSRNHELDFFSFT

SEQ ID NO: 848 - protein, 407 aa, Unknown
  Kingdom: Fungi, Phylum: Ascomycota
MTAIVVRGACCSAITVLDKLTEIERTTSTPALSAKPSIPETSASRLAEASESTNSLHETEQPESNTVLYLAYGSNLCAETFLGVRGIRPLSQVNVSVPTLQLSFDLPGVPYGEPCFANVDWRKIPKNPKVPPIPKLPPTPPIDPPKPPAVDTLRPPRAQMQWNGELMGVVYEVTKEDYRHIIQTEGGGVSYKEIIVPCIPIPPAIEIPEKPPLPELPRPFLARTLFAPYVPDERLPDDPRKDKWWFKYITPPHRPSKDYAQASGRYLKLIRDGAREHELPEEYQQYLHSLQPYTITTWRQRIGQFIFAGILVPLIMMFFKVGQYFADKDGNLPPVLMLLTAATFNLSWRFYDLVLKHLFGDGERTEEKSDRSAYLHVWRAESHRYDEEKAKLVMHCENSKDTGNNTL

SEQ ID NO: 849 - protein, 180 aa, Unknown
  Kingdom: Fungi, Phylum: Ascomycota
MCRSPLLLSLLVVAAPDRVIPARTVFALIIINKAGGLIYNKTFHDAGLQKISTNDYLVLAGTFHGVHAITARLNPVKQAPLPPTHPPGANMLPSRPEPSSGLEVLETENFRMQCFTTLTGTKFLLFTDTTQTNVDVTLRRIYDLYSDYVMKNPFYSLEMPVRCDFFDRKLLSYIREINNR

SEQ ID NO: 850 - protein, 591 aa, Unknown
  Kingdom: Fungi, Phylum: Ascomycota
MQDKNTNNTREPRPDDKSPTSHARLGGTYKGGIMGLFQKMGGLPEWSVRGSKLQGKALNWGIGVIASCGFLMFGYDQGVLSALLTLDDFQKSLPLMTPLEESNYLCYHDYPENNDRNEAMCTGSPNTQAAAVAVYQIGCFLGAVLILFYGESWGRKSSTFWGSLIMIIGTIMQAATFSYGLFVAGRIVGGVGNGMVTSTIPTWQSECARPHQRGFLILISGALISGGIMIAYWVDYGFYFLEGSVRWRFPISFQSFFTIIVMCGLLYLPDSPRWLAMKGRHAEARDVTARLLGLPIDAPEVTVEVEAITEALEAQSHGGKFRFKELLTNGPSQNLRRTLLGMFAQFFQQICGINLITYYATFLFENSLGFGPSMSRLLAALNGTEYFLASLVALPLIERTGRRRLMLFGAFGMMASMAILGGTVSTGGVADNGAPILEDRFGIPAAVFLFVFNTFFAIGWLGMTWLYPAEVTNLRIRIQANALATCSNWLSNFLIVMITPPAFANLGYRTYVVFAVFNAAIIPCVYFFFPEPRGRSLEELDVIFASAHFEGVDPVKRSKHMRHIEGQELEAELAKYFNSGSQHAENGVARA

SEQ ID NO: 851 - protein, 267 aa, Unknown
  Kingdom: Fungi, Phylum: Ascomycota
MMQPRSDLATGGGPSRTLIITLSTTIPGVIIVTVLGLAIYQCRRRRFSFLNRGITPIDDEEIESWRTERIEEKMAHSAQAVSARSHQPSMSASSIQKPPSILVYGRDTHFNSRPSMERSPGLGRTSVDVPAPVIAVAPNARLGLTDEMVQGDDAFVPRVKRQPSRLAKSQPPASPGKHQHKRSTNSHSSLHAAWYGYQEESQYAQTPVRHSGERLPQTPPPRGHRPNILAYPDSSIPPYSSHDEEVFHGGLSPRPMLHQSDIGRAIG

SEQ ID NO: 852 - protein, 538 aa, Unknown
  Kingdom: Fungi, Phylum: Ascomycota
MTWENIAAEKRRRRAAAIEAVQPILKKTQLDGRPASAPKLEDIAALTSQLGNGSITAESVALAYISREPLFDDAVKQARDLDAYFSRTGRLIGPLHGVPVSVKDQFNVRGVDTTLGYIARSFKPAERDASLVQTLKGLGAIIITKTTIPQSILWAETESPVWGLTTYPQHPNLTPGGSSGGEAALLAMSGAVCGWGTDIGGSIRGPSHLCGLFGLKPSSTRFPYAGVPNSQEGQAHVPSSIGPMSRHLSTLIDMTRSCLLAQPWDLDPNVTPLPWREDKYVEVQTRPLKIGLILDDGVVRPHPEIELAVQRAAELLEQAGHEIVPWDTSDHMDCIKIMDQVYRADGGEDIRNEVAAAGEPLLPHVAALLESARPISVYNYWQLHRLKVAAQQAYNDKWNDSHRLGQARHPEQRSVDVLISPVMSHAAVPHRKTGKWVGYTKIWNFLDYTAMSFPFARFSGDPTEVGDSSSEQILVAATRARAEFQQLYVPRNDLDEWNQQQYDPEAMHDLPIGVQIIGRRFEEEKVLGVATVLEKLLH

SEQ ID NO: 853 - protein, 440 aa, Unknown
  Kingdom: Fungi, Phylum: Ascomycota
MQLSSICQQRNRDIIPSLLSAHHAVLHGDGTVVDLSTAENWSTKERLVPRVRESLANLSEESRALLIFLWCFNSVYKDLAYASGVGGCSKTRKHIAKLLNDHFSPSRAVDPSHIILAAGGTFALTALIDQICDPGDAILIAAPYWAGLDIAISIHSRASVIPVHIPLDKFFQPESVVYYEEALRAASVPVKGVLICNPHNPLGQCYPKTTLRDMRDFCGRNDLHLISDEVYALSSHQPFPSDALPFTSILHVDSGDSVGVEDRQAQVHVIYSLSKDFGCNGIRVGALVNQTNTALQMSAALSVHSQVSTLSTFIASNVLLSPEVVDEVVSHGGLQCRESYEVVRSFLETRMMDFIPVHYGVFVFARLAKLSGTDEEAELQRCLKQRGVSVSTGTSYHFAQPGWFRICYGMPRTELLKGLERLDKGVNEYLQRDVSAQGDN

SEQ ID NO: 854 - protein, 334 aa, Unknown
  Kingdom: Fungi, Phylum: Ascomycota
MLALTHPGSSSSADLTMAVVGCGGMGVAILGGILTSLADLQGPKPLQTPTGTPYEELPPRLPSRFIACVRSHEGVKRVKSLLWEHSSILKVVRNENLHAVQQSDVVLLACKPEIVGEVLSEPGMAKALHGKLLISVCAGVTVEEMETAIYGAVSSNDPEVDGRCRVVRAMCNTAALIRESMTVIAKSDPPLPKQTETLVTWIFKRVGDVVYLPADNMDASTALCGSGPSFFALMLEAAIEGAVAMGLPRKEATRMAAQTMRGTTGLVQNGTNPAIVRQEICTPGGCTMGGTLVLEEAAVRGTISKAVREATVIASQLGNAAHHVNGTRRTHSGR

SEQ ID NO: 855 - protein, 131 aa, Unknown
  Kingdom: Fungi, Phylum: Ascomycota
MSSQPLLQTAPGKRIALPTRVEPKVFFANERTFLSWLNFTVILGALAIGMLNFGDRVAFISAFLFTGVAMLTMIYALVTYHWRAKSIRVRGQAGFDDRFGPTFLAIILLLAVVVNFVLRITDQSKKEKHGQ

SEQ ID NO: 856 - protein, 876 aa, Unknown
  Kingdom: Fungi, Phylum: Ascomycota
MLGQDETRAMQVTGHQSQHYGLPPSSAFASRSSPSWTPTERTPIRTPLRTPGRSPEPGTRTPSPRLTPFTGKVADFGSDASIVLAGIRGSGKSTLAIMAATAMKRRVIDMETAFQQTMGASSAVYKRAHGGAQCQEQQARLLCDTLEKNNKGCIIVCSWMEITAQRLLRTFAATNPVVHVVRNLEPIQQHLKISDREKMQNLLAVSNAIFRSCTNFEFFNISETESSSESHPSKSDRLPSPYLTLKGAERHFLKFLSQIFPPNAIPFIEAAFILSTIPTEERLFTYALSLSMADALDNTLEIEEHTTGADAVQIVVPPLPERGSPGMHANLGFELASDITRAIASIRRSTVIPIIAHIALPARLDEEIKSLYISLISHTFRSAPEMVTVDLRLEDHELSPLLEAKGHSKVICDYSFTASCDAPDWSSPVWETMYKRAVRLGADMVRFLRPASCLEDNFAVAKLRTRLESLGGRQLPVIAYNTGALGRNSACFNPILTLVEREQESAPARHSSMITARAASLALTASFIYDPMKLYVFGANVSYSMSPAMHNAALVACGMPHRYQPYSTDTLSGLRHLIEDPSFGGASVGLPFKVEIISLTHSLSKHAQAIGAVNTLIPVRQLDQRGYVPRGAQFVKTINRAGPVKALFGENTDWIGIRACIRRGLSPANAVRKGTCGLVIGAGGMARAALYAMLQVGVQNIAIYNRTVSRAEQFANHFQQLLQKDDFQFLGAGRQTRFRIVHSLNEPWPAEFNLPTMIISCIPTHRIGDVPAPDFRVPEEWLGSRSGGVIIELGYKTLDTPLLAQAKSRASKGWVAMDGLDLLPDQGFAQFELFTGRRAPRRIMRRDLLKAYADAHGKQEREEMGPRFGSINEPEA

SEQ ID NO: 857 - protein, 552 aa, Unknown
  Kingdom: Fungi, Phylum: Ascomycota
MPMMLVVALVTVASFAFAIPTNDPLVFRPSHAIAKKNAHHIFNEVHSAARQWGSSLNHNGMGFIPAVVTKGTLLHHGTHFKDTPDYPEWLAFEVEHSENFANSRRRRSQSDEDEAQHAAMNDQEVLDANAKPRGEKFRGYLHTYQARRDLHLLYLDGLAAAKTEFGTLDSQDYVIRLNATSSPRMGEGARARELCDKAASWGYDGFIRTEIGFEVIHCNFSDSLDLVSRPRTVVGEDKMTQHKLGVYHFARAASQRYDGIGAGRVKLDFSSMISGYFFPMNISSQTPGRPDLVRFASARTEELDAIRETIGEVAHQPRRHTVDWQAVADQVITRFAHRFSFLTARDGVADEIFRDELESMCLTYYDAPPLPDDEEPDWHWVSQEEDSERRQREAVQRCSKHFLLPALMFKEEFTLWDELLHTAFAEVTHSICETTQRLWLKLNATTEETPSHAFDDVAEAATTSQELRRREDASTLSQAVEEARVAIQTLMDELAWTVWKKKQPCPPDSFLFVAMWPFGTDKDHWEPGCRAVEESLDRESWYGYWAGVRMRT

SEQ ID NO: 858 - protein, 1003 aa, Unknown
  Kingdom: Fungi, Phylum: Ascomycota
MLRNAANAARKAVTELSQYPKPGDKLHGFTLVRSKHVPELELTALHLQHDKTGADYLHIAREDSNNVFSIGFKTNPPDDTGVPHILEHTTLCGSAKYPIRDPFFKMLPRTLSNFMNAFTASDHTFYPFATTNAQDFKNLMSVYLDSTLHPLLKESDFTQEGWRIGPENPLAEDEAGKKLVFKGVVYNEMKGQMSDAGYLYYIRFHDHIFPDINNSGGDPQKITDLTYEQLRKFHAEHYHPSNAKLFTYGDMPLADHLQEANARLDAFDKITGDRQIHEPVELRGPKEVTLKGPLDPLVDADRQYKTSVSWITGDTTDVVESFSLALLSTLLMDGYGSPLYRGLVETGMGADWSPNAGYDSSAKRGIFSIGLTGVQESDVPKLKARVQEILKEARKNGFEQTKIDGSLHQLELSLKHKTANFGFSMLNRLKPKWFNGTDPFDSLAWNDTINKFQANMAKGGYLEGLIDKYLLNDNTLTFTMAPSASYGEELAREEQERLSSRINKAIEEAGSEAKAREFFEKQEQDLLVEQAKTNTEDLSCLPTVHVKDIPRSKEPVTVHDSVAEDVSIQWREAPTNGLTYFRAINTLNNLPDDLRELIPLFTDSIMRLGTKDMTTEQLEDLIKLKTGGVSVGYHSTPSPTDFHQSSEGIILTGMALDRNVPVMFDILKKMILETNFDSPEAALRIRQLLQASADGVVNDVASSGHRFAMGYAEAGLTRNAWLKQQVSGLSQVKLITSLASRPESDQFEDVIHKLKRIQTFALASGNMRTAITCGSESVEDNTASFSRFASGLPSIPRQEPTEPRKLTQDSKTFFPLPYQVYYGGLAVPTVSYTSPEGAPLQILSQLLTHKHLHHEIREKGGAYGGGAYSRALDGLFGFYSYRDPNPQNTLSIMRNAGRFATEKEWTDRDLEEAKISVFQGVDAPQSVNAEGMGRFLSGITEEMKQKKREELLDVTKDQVREVAQKFLVDTLNKNEEKIAFLGEKQSWVDSSWAVKDMDVKGAE

SEQ ID NO: 859 - protein, 599 aa, Unknown
  Kingdom: Fungi, Phylum: Ascomycota
MLIVPRGRRVLFVASVAILGTFYFWSLPKDAIHPVQLDLPATVSVPSSLPLNEVYAWRTLKTNYPVSTVASLPTEQPRSFPKVQAVFAEESGSSRQQRLERQRAVRETFLRSWKAYKEHAWLQDELKPVTGGSRSPFGGWAASLVDALDTLWIMDLKEEFAEAVGAIDQIDFRETTLIEVNVFETTIRYLGGFLSAFDLSQDPRLLQKAVEVGDMIYKSFDTPNHMPVMRWDIKAAANGERQVANSGTLLAEIGSLCMELTHLSQISGDPKWFDAAHRITQALANQQDSTELPGMWPLVVDAEKQNFNAGSTFTLGAMADSLYEYLPKMVALTGGQLPIYQELYEKAMEVAPKHLFYKPMTPTNEDILVSTAFHTKGGSAVHGERDTQGQHLVCFLGGMLALGSKLFERQQDMQLAEKLTDGCIYAYRAFPHRIMPETWHMVPCEPDSECSWDENTWKKEVLRINSMGSDATLQEADAIIHDDALPQGFTKISDRRYILRPEAIESVFVLYRITGRQSFADAAWDMFTAIEASTRTSLANSAVSDITRSGEPPRQDSMESFWMGETLKYAYLTFSEPGLISLDDYVFNTEAHPFRRLKP

SEQ ID NO: 860 - protein, 1350 aa, Unknown
  Kingdom: Fungi, Phylum: Ascomycota
MASSQSSSRESSPELLTPRTKLQALLRSADSDEEGEQRTTKRKLDFRAGLPKRPSASPAHVQSSDEDSDVEIRPRGRLAARMQGAATGAADTRSSSSAIPESSLPDNPRERVRRMLLREEEEKARSQTQDDGKEEEEEEEEEEEEDELPVARRRLKRKTSVQPETESSQQQAAQTTRSVSPALFVSSPVRPSPSKATERGAQSEDDLPTLKSDRFKALVQRKRQEREAREAAEEARKVERRAQQEKLASELEALDSDDGNDSTISDDEGGRQLTQQARPSRKASKKAIEDMNRETQRMARNMQLAHEAKTRKRITKHSLFERFNFHPVGEPEPKTASSSRPGTPTSDSEMKDADTAPSSPPTARKDLAEETIQQTPVNAVSVASEVPSVNELPPQTPTLDKGKGKAVDFEVQEEQPTVKPRRQIRVKLPVPVGRATLDDSDDELQVMPTTKDKIMSVFDKIPLNKAKEPHSIQALRALAQVKSPGQERRRRSEQPSMTNSELHFSLQQRARQQARLERERRVEELKAQGVVIQTAEEHEREKQEVENMLLAKAREEDRRLMQEERAAAKKEALENGTADPLAWDDSEDEDFVGSTRGVNEADAEQSAIELSGSEEDEEDEEDEEEEEEEEEDEEDEVEEEGDRPRVVDEVEEEMKDAVPEPAVVLTDPVPADDDDELPSTNRRRGRKINAILSDDEDEVVEATPKPQKMFHTSPAVLATDSPAAPGSVLRSAKKTFIPGLPVESGGPAGLGLTQIFAGTMDDSQSQMTPARGPTQSMMPDFDHFPDSNFSAKSESRQDRLSPHNEDTQTSTQGVKFNLTQSQMRKLDSLLQKPDTQFSEMIELSQDGGFQEHTPLLDRFMEPPTSTVQTVVLDRTGGNAQPVDSPLVQRGRLRRKLEVIQEANNSESQSTPSAFNVLHDGAEKQRRKDEQAEFDRKKSKAKEMVHEQADESEDEYAGLGGVDGEDSDDESAASVQEMIDDEAGNDQDKAKIAAFYAERERIEDEQGMEKLYKDVTTGNLRRKRGADYDLSDSDDGGEARRRMKRRQFAKMQKALYADERVKKIAENPGNQAFLRTIQDQGSDDEMDLLGMDEPVEEEQNSTATPPRIDEGQTVPDSQPRKALGDAAENHRAPANLRRTKDGKKPSHIGEVRQTLSSLLEEREASIIPATQADSDSEDGDESNIGRQASFRSDKENDGPNPRRGRVAVVDRISLKRNNSSNVSTSRLAFATTANGPGASAIKIPAFLRRASSAASSSLGSIATTSSTTGAATATATGSFGEEAKIKKPTGARGRSGIHGFGSARGGAGLAAESEAMAKVRESERRRQAKRAKGAERRMGAVGGLLGKGSFE

SEQ ID NO: 861 - protein, 830 aa, Unknown
  Kingdom: Fungi, Phylum: Ascomycota
MEDQKPWFLRYSCPVLFPAHEALAKPRADFEAFVLREIRNRHGNANEFSDITMDEGGETEDTATLVTDTTTADIRQGLREMEMNTEAVTEEDVTDRPKVETEGTFMDLLHKYDERKSRATAGNMENKTFTQNGDMTNASTLNHLVDLFAELEDTISGPRLQNLLQSAWAQDPLMTLKIIFNARSIHLGKSSKVTFYRCAGWLAQNHPATLVANLRWLSRPVIEKKAKKDPEDEDLVFIEEPKDEDDPTRFDVKYGVAHGYWKDLLNIIALAASGELTVLSNPDKILNPENPSYFKERSKRKRGEKGAGRSRKKPSRVHGSEGTTQEEFVAAVKERTEMGKKEGRESRRTDLERLFNSDTVYRGLHLSIARLFSDQLKEDLVALRGDDAKARRKISLCGKWAPSHDRFHDRHTLIVSSIAEVLHPRDTFDHALSPTDTRETYLRYAREEYRKDISALRKHLDVVERKLSAKEIESIKYERLPSKAMQNYAPLFIEKDFDRFEKYLDAVAKGKAQISGATLLPSLLVSRQRKRREVPVEKLKKLPPAAIVKEKMKALESRVADGQWNALVKRIRESGTLSNCIAVADVSGSMGYPVFADETTPMDSSIALSLIMAEVADPPWRGSLITFDYKPTVVKLDGLETFSEKVDRLVSAPWGYHTNLVAVFEDLILPMALENKLTQDQMVKRVFIFSDMQFDTANGSSGREEYYTSSFDRIRKAYDRHGYQVPELVFWNLAGGQHSNGGGKPVTVDDIGTSLVSGYSQGMLKVFLDNGNFDDKEEEEVEEEMVEIVEKDENGELTVREEKRGKTIDPLKTAKKAVGHKAYDMLKVVD

SEQ ID NO: 862 - protein, 883 aa, Unknown
  Kingdom: Fungi, Phylum: Ascomycota
MAEAEEDFSSLPLADRFTHKVWKVRKAGYEDAAKQFSLTPDESDPCFRPFLNDPGLWKGAVTDSNVAAQQEGIIALAAFLKYGGRDACLRTRNHTITPMCEKALSSTRAAIKQNAIEVLLLYIELDVAGPVIEDVLPVLANKVPKNVAATLNALTQLVHNYGCKVVDPKPILKALPKVFGAADKNIRAEATNLTVELYRWLREAMKPMFWGELKPTQQNDLEAQFEKIKAEPPPKQERLLRSQQAAAEAAPAAGEEGDDMGDDVDEAPEMDAFDLAEPQDVTKNIPANFSDLLASSKWKDRKEAVDALFTAVNVPRIKDGDFNEVNRGLAKCMKDANVAVVTQAALCIEALAKGLRTAYGKYRSVVMQPIMDRLKEKKATVADALGAALDAVFMSTNLTECLEDITAYLSNKNPQVKEGTMKFLIRCLRTTRDVPAKAEIVSICELGKKLLSESSPALRDGGAEALGTVMKIIGERAMTPHLEGLDDIRKTKIKEFFETAEVKAKEKPKAAPPPPKPAAAPKKVLGGKKPLARKPAAAAPPPPATESEAAPPPPRPAAAAGKVGVSKPSGLSALKAPQRRLAGPPGASPRRPPAGPPVMPDDDAAPPPQPRLGISRGLAGRPLGKPVMPAETPVPAEAPIASGLTAVERAELEELRAANERLSRQVDDMRQERSKFMSEIQELKNQNAGLIEDHTRDVLSIKAKETQLVRARSDVEAKEQVNERLRRELERLKRALSRAEGLGTASGAHSPSVTSPTHDDAGIYRDHGSAAGGRHRMSFTSTMSEEKENGEPVFARSKLSPEMRYAGDSASSGRGSPARGFRSAASHREDGSESGVSITRERPTSSLPQPSGGVESWKRAAEVTSQLKARIEQMKAKQGMNRP

SEQ ID NO: 863 - protein, 273 aa, Unknown
  Kingdom: Fungi, Phylum: Ascomycota
MNGVQRIARQAARREPSQWACYFCQHTRPQPSKFESFRRTISSSTVRRTQQQQQPPRQQQRRVETAPSMAQMREHYNKKNRSVGYYGASVIIGFLALAYGSVPLYKMICSTTGWGGQPIRAHGADSDSDPDIAGRLIPVKTANRIKVQFNASVSDVLPWKFVPQQREVSVYPGETALAFYKATNNGDKDIIGVATYSVTPAQCAPYFSKIQCFCFEEQRLNAGETVDMPVFFYLDPDLLTDLNMKNVETVTLNYTFFKARYDNNGRFTPPSSV

SEQ ID NO: 864 - protein, 626 aa, Unknown
  Kingdom: Fungi, Phylum: Ascomycota
MSNPLPSMPPAQPAAIPVDSSSGLWDRLTSWASENKAVVYTIAGVAVVVTGAGVVYYLNSDSTSRSDSSPKLSKKERRKRKEAERKAAESKQTPSQGASQPPSASVQSEAELPEIDEATVATLTQQQREEYAAKLKQAGNKAYGDKAYNKAIDLYSKAILCKPDPVFYSNRAACHSAMSEWDQVIEDTTAAISMDDEYVKAINRRATAYEHQKKYSEALLDFTASCIIDNFKSDSTAQAVERLLKAFAEQKAKEMMASRPPKLPSPIFVGNYLQSFRPKPRPSGLEDSVELDEETGKGQLQRGFQGLEKRTGDGYEEARKAFSKALELGDLGEYEALAYNMRGTIRTLLGNHAAATEDFDKSIELDPSMTQSYIKRASISLELGEPAKADEEFAKALEQNPEDPDVYYHRAQAHFIKGDLANAQKDYQKSIELDKDFIFSHIQLGVTQYKMGSIASSMATFRRCIKNFPKVPDVYNYYGELLLDQGSFSEAIEKFDTAMEMEKQSKPMAMNVLPLINKALALFQWKQDFKEAEKLCQKALIIDPECDIAVATMAQLLLQQNNVPGALKYFERAAELARTEGEIVNALSYAEATRTQVQVTEKYPKLAAKLAGGASGPPAGLRMGPQ

SEQ ID NO: 865 - protein, 815 aa, Unknown
  Kingdom: Fungi, Phylum: Ascomycota
MSSRISSWSDISSIDTNPYDPPSPPPLRPRESLVSLDSRNIPAEEDIGHGTSYPGARHWNSSRALSRGGSYTPVGGELSRAPSSRPSLHSPLRALSRPERIEEEEYDMSLLSAAAPIDGALDPISPAPAFDLSAGMLPQEEDFQDQEARGTLTGGLGKGWVPEARVRHDELLSSPVVERSLSRSFSRRFGSRRLNRARALRDMGQDEANRRGEVIEVIMEEPADLSLIEGPSTLTVSDRRGSTFPTRRETTQIFYPQPNWKPFSMRFPWLCMLVLVSIGLAVMQEVLYRRYHDTGILRFKTPDDVKPALYFAVKFGPTLAAVVYGVLWQFTDFEVRRLEAYYQLSKPGGALAAESINVDYVTCFTFFRPIRALKCGHHAVAVSSIATTLAISLVPTFAAASIVLTPSRQERIDEPDREKVLHLTSAWSRLLTSVLCFCAFSGIALFWLLQKRRSGLQADVRGIAGLASMAVVSHVLMDFKGMDQAKHKEIHHRLKNHRYILRNLSLAPDDENPLSSQDREKYANIPLSENPHPLMLRTAGIIPFFFSLVLFMGFIPVFLFTKADVVTAEAPWFVTVLAVCLKLAWHGMETAVRMMEPYYILSRRHAPSKTLTLDYTALPFGYLPLRALFNGHILMFMVGFGTVMAEFLTVLVTGLATVEGRDFLLVYGKDDNDGESRGLDAGTETVHSFLVSLALTLFILLYMSIITFLIFLRRRHPFLPRQPNTIASVLAFIHQSKMLYDFVGTTKMGSSETAKHLEGKRDAEGKTKTYGLGWFEGRDGLQHLGVDQEELIGNYKHGRGFHMGNQPWNERWDEY

SEQ ID NO: 866 - protein, 473 aa, Unknown
  Kingdom: Fungi, Phylum: Ascomycota
MLFPTVLTAATLLSTGIAAPAGDNATVTEITVRADHKHQKIEGFGFSGAFQRAQLLLNITEQKQHELLELLYGTETGVGFSMLRNGIGSSNSSFNDWMNTILPASPGSPDGAFNYVWDEYDSGQFWLSKKAVEYGVDRIYANAWSAPGFMKTNRDDANGGLLCGVPGSEDQCEHDWRQAYADYLVKYIEIYRSEGINVSDIAWLNEPDLTTSYASMRSNAQQTADFLPILWQTLKDAGHDVGIACCELTGWDETQEMVEALQALGVEQYLTTWTSHEYTSPIDSALNTDLSVWQSEYCDLSGRWTTAWDSGESDGDGHHWAEILHRALTVGNVNAYFWWLAIQDEATNDNNNEKLILVEDGQYQVAKRTWAFAQYARHVRPGAYRVQTTGGELQTTAYENEDGSLVTVVLNPDYEAVAVQLTLVSCRLKEVNKVQAWLSDEEHDMEEVDAVLNDDGTVSVGLSARGLLTVKAT

SEQ ID NO: 867 - protein, 608 aa, Unknown
  Kingdom: Fungi, Phylum: Ascomycota
MRFTPSVLAALASASTAYAQLGSNSTIISSTGALTSSVLSTTTITEESSTGTSTGTQPTGTTGPPVDVGLDNAALGPGAEKVTLDDGTVAVLLTPEPNSQASFSVTTPALPEGITVGNLISIVFDIFVQAPSSRKRAATDCTLAVTLNGQTVYDEALEATGATTSQSTNGVPATADQKIAFVQSCGDSPAALQVSGVAIAAGDNPPPPPPPSSIATPTGTGSLSTAIPTGNGTTSGTATGTATGTATGTATGTATGTATGTATGTATGTATGITTGTPTGTATGITTGTGISTSSAGPIPTGFPAAIGDFALFGCVGSSSGFPSFELVQTSGSMDLNVCAGFCEGRSFFGVFDTDCYCGDAIDDASTARVDIDLCDVECPGDDSQFCGGQSAPSLFRRQSVPLNVLLTVYVNAGGAQVTTTATTTSTVTTTVSGVVSTVTAIYECFDGKCYLLDGNGGVIVFIFVAVSGDDCDGLDVFVIEDCSCKGGKQYVPKHCSNGSCNGITVYKSEECHDWWNQKEYYTACDESGSVVYKPWENTWGTPAQPNVPQLPSCSGSGCPVAPTSSPKAANTTGSPASPSTPAVVVGAGSKQAVSAVAYVAALAAAFL

SEQ ID NO: 868 - protein, 370 aa, Unknown
  Kingdom: Fungi, Phylum: Ascomycota
MASSSTTFLRSVLPYIPTRTLRTMRTTTETIPSTPIKVLRTVPSLRQWRRPHVLNHRSVALVPTMGALHSGHLSLIRAAARDNHHVIVSIYVNPAQFGRNEDLASYPVTWEADTKILADLDRELADDGGNLGRVSAVFAPTTADMYPNGFPGQDVDSKGSFVNITPVAEVLEGKTRPTFFRGVATVCMKLFNIAQPERVYFGQKDVQQTVIIKRMVEDFMLPIEVVICPTEREADGMALSSRNVYLGARRRRVGLVLSRALRAAEAQFTNGARSRSEILGAAHEVVNKTLQEQTALGPEERALFEVDYISLADPSTMMEIEEVDMEKGAVLSGAVKMLEVEKAREGEDLGYKGGPPVRLIDNIVLKPGDV

SEQ ID NO: 869 - protein, 851 aa, Unknown
  Kingdom: Fungi, Phylum: Ascomycota
MSGSNHSRPGSPGSHSDHEDHHLSDSHSAPTTNSDRPPAASSAQSHVREKKRRRPALACEQCRKRKVRCDRTKPCGPCLKASISPCTYAPTHVPAVRGKKSPAPRDPQESSTRQYDIRPAPVTRRGSTAGLWSTLKGVVQPPQQLSRPRSSNQTSIDDSTNQKPEDVDRLIQKVNFLQEKLNSVSQQVDSSDSGPKRWPAHATLQHQEKGKIVKTRYYSCGHWMHGAYLFPTELSILVHAESSKGEVFLNLMRCKDLARKIKEARLQPLISNNLGNSLPTRALADQLVENYIRAFEGPMRILHIPSFRSEYHRFLQSPDSASTPFRMQLQLCLAIGAALQDDTFTLRQSAMQWVYEAQIWMMLPPEKDRITYMGLQIMCLICLARTVCSAGADLAWIGGGQLLRMAVYMGLHRDPLKLGTMSVYRAEMRRRLWATVMELDVQFAIDAGASSLMDSMDYDTLAPANLNDDQLTDENEKERPASSDMPALKVPTQASVQIALHRSLPVRLAILRHINGIDSNDSYNATLGLNSSLVKECRLLSKTLHGLKVAVDKESPDNLDNGPVTSFHIKLAELGVYRFFHTLHQPVIIQSLEDPRFYFSRKMFHDSALKTGRLCNLILRVDEAEPVPKTVPERDFVRFLSNGAGMIRNIVSQSMMGIGLHIIYLKEEQSLSLGYISTGLEEGMGTVELKSYIKRTIELSERRIRSGETGVKMLCFVSAAMARHQQTAEGADRAAIHQAILESATEASRVGLELLKERAQLEGTPMPSADAEGAELNNGPIFGSTGAILEGRNPTIFGSMQAMGGFGDGMDWMTDWTWDNMSVLGWPDGGQQAWDQCLPTGAVGSAVPAST

SEQ ID NO: 870 - protein, 819 aa, Unknown
  Kingdom: Fungi, Phylum: Ascomycota
MALPIIVCGQTKKVGTGVVEGLKPEIEVVFFHLASGDAIAELSTVLLGKLPDNPASTLGSGNLSTIPKAVVLGGAFDLDTVKSLREAVNGISGVPTVPCSLRAEASAPTNPPAPGSEKANLHTTIPEDEQPPAYDDSLATGRLQIHPVPSRDAVVVKIEPPQHPRKDIDHVPCDIVLVIDVSGSMGDAAPVPGEEKEDTGLSILDLVKHATNTIIHTCNQYDRVGIVKFSNDAETVLPLTEMTEANKKTALRKVEKLQPEMATNLWGGIQCGLTLFEKSGNNVPALMVLTDGMPNYMCPNQGYVPKLKTIMPLPASVHTFGFGYNLRSGLLKSIAEIGGGNYGFIPDAGMIGTVFNHAVANLQSTYATQATLRLTYAPPMIVKEAMGPRVDVGAAVQRAGGLEELNLPLGNLQYGQSRDVFLKVEKLRGAKVTMMSASLDYKRANIVSSQGAPEAASFDSSADLTQPGQLSEAEIAFHESRAQLCTFILSMFQLKKDLECTQRNVALAGKQRELKSLIEKIPAAAFTKTDEDDEALMEDICGEDPAGQVQLAISKPAYLERWGYHYLLSYVNAHTRQICNSFKDPGPQRYGISSPLFKRCLAHLDEKFDKLPPPKPSRQVWNRQLGKSSFVSAGSISISKYNRSSAPCFAGSTAVELASGRRVSIKRVRRGMRVRTPLGPRRVALVLKTPVEQGALCRIGALLVTPWHPISLDGGKTWDFPANVEAGRLVRYTGAVYSVMLERDARTASHAIRVEDAWGVTLGHGMTATCDEDIRGHEFWGDWARVSKEVMRLGVSRGGVAVGAGVERDPETGLVTALK

SEQ ID NO: 871 - protein, 251 aa, Unknown
  Kingdom: Fungi, Phylum: Ascomycota
MDMEIVDGHEVGRKSFGRSYFDHTKFICQRRGVEDDYYYGIGKCRFADATPELIKSLRLIKIPNDLIFPPYEEGLTIAPNPLPHNVYIKSPRLIDFGDSEASSNVGRHLLHEAKMCELLRNHPHPNIAQYHGCIVRDGVIKGLVFQRYPLNLKKRAAENIPINIDHCFKFIKKGIKHMHTLNIAHNNIRPENVMMDGDMPIIIDFASTLEFGAKLAGWRCGSQPWIPPEAKQSDEYNDHYAAQQIYHWLRE

SEQ ID NO: 872 - protein, 401 aa, Unknown
  Kingdom: Fungi, Phylum: Ascomycota
MADHVPIQSVKEGIQGRRDDLWSMNSTIFHNPELGYQEVIAHDTITSTLEKHGFRVKRHAYNIPTSFEAEYGEGGRLVIFCAEYDALPDIRHACGHNLIATSSVAGFLGLAQAIKQSNIQGRVRILGTPAEEGGGGKVKLLEAGAFEDDPAAAIMMHPTSAHAIPSNITGIAGVKFVASLKLRVEFHGHPAHAGGAPWEGRNALDAAVAAYTAVSMLRQQIHPDERIHGVIEDGGKSPNVIPSHTKMNWYIRSPTVARGSELLTRVKNCFEAAATATGCTLTYTEAPTYMDLRINNTLSTEYASLMAKLGINFVPRMEEPFTFSTDMGNVSYTVPSFHGAFGIPGSKGALPHEPNFALAAEREDSFDVALSCAEGMALLGWRVLTDDDVAAGARRDFEAVE

SEQ ID NO: 873 - protein, 422 aa, Unknown
  Kingdom: Fungi, Phylum: Ascomycota
MFFVTVGILVAFLILLLLLVHGTCVLLSHSALVSLRASRKRLPVRNMASGQIPLWLDCDPGHDDAFAILLAAYHPRLKLLGITTVFGNASLENTTHNCASLLTAMGKHKDIPFYIGESKALERPALHAPTTIHGITGLDGTDLLPTPECAPSTKPGVEAMAEALRAQPPGTAWIVATGTLTNVGALFRKYPELAAHVKGVSLMGGSIGDNFSDAPMGKVDGKTRIGNWTPYAEFNILVDPEAASEVFSNPDLKGKIVMVPLDLSHQVLATPEIRNLLLYGRDGPKTGPGRSTLRTMLVELLYFFAQTYADVFEITAGPPLHDPLAVAAILTGTEDEIPFFDWDEERSEKPKHDERFEVTVITEGSIEEAKAGLKETGRTIAKELPVGEPGVRIPRGMDEAHFWRVIEECMEKADEVNKTFGR

SEQ ID NO: 874 - protein, 559 aa, Unknown
  Kingdom: Fungi, Phylum: Ascomycota
MNKAIVLLALAHAGLGLAQNTTTPSATPTSTFTDPKVPTGRPIVGDYDGRYRPQVHFSPPQHFMNDPNGMFVDANGTWHLYYQYNPTGLVAGNQHWGHATSDDLYHWTNQPIALFPPNEETFVFSGSAVVDVNNTSGFFPDQNNGVVAIYTLAEYPDGQPGPQTQAIAYSRDGGYTFTPYADNPVIDSDSSQFRDPKVIWADDRWVMVIAYAQEFQIGIFTSPDLKNWTAASNFTGGLLGLQYECPNMIKMPVLDENGERQEDKWLMAISINPGAPVGGSITEYFPGTFNGTHFEAVDRVARIADFGKDNYAGQWFYGQAEDELPVVPTGEEGWRSIMSLPRENYLTEVPRLGWKLVSRPYNLEPVLGNALASNSSLGNGTVVVDYSEVESNALYFEANVTKIPATGIPSTATLNFTFSSVLTGEYVSGGFYFGGDTPFFVSRDGARGFDNVFFTDKFSTNSLLTDKTSWSMSGVIDRSILEVFVDGGVESATNTFFSTQPLTLMTLSTADLPEDMDVSVRVVALDSAWEKMKGDDGLVAGNTTSVIGAANMKRLFGGM

SEQ ID NO: 875 - protein, 236 aa, Unknown
  Kingdom: Fungi, Phylum: Ascomycota
MAFGTPMVMNMLDHRMHLPHRNRDADAEPFPRVPSIEIMSASGTPTNPSTSSFQRRNRDTGFPEPFNGDRNTTLPYPGADLSPNARITMDDGLLNTDPFSNKRSFRRSRLNKHKRTVSYGKITPQFEAPHSVVSSVDTTAGVSSTSSSTITRSETETSLSPSAPAAASAHPATHSMQPSHVPQTPMSTSFSSPRTSREETDSFRSKREDETPPSSPESHSLRKEGFMQRWRSLSRG

SEQ ID NO: 876 - protein, 367 aa, Unknown
  Kingdom: Fungi, Phylum: Ascomycota
MAEEDYEIDFYGDDEPIEEQKQEQPNQNSQDQSRDRTDGTNEQQANDSRDRHGSVDDRMDEQRDQEYHNHGSAQPAPQGSKRKTEDGGPVDPGATTALMISELNWWTTDDDIRGWLREGGCEDGIKDITFSEHKVNGKSKGQTYVEFDSLQAATAAKHLISQMPSDSGNMGKKISAAYWNTSMNPFRTLPKDAPARGAKEPGRTTSGSYNDRGGYNNNNGGYRGGRGGFNANRGGNMGQNNFQRNNYNNNVGGMGGMGYNGGGYNNGMQGQFGFNPRGNMMGGGMRGGGMRGGRGGPMMGMNMGMPMGMPGSMPAMGMMGPGGMPAFQGMAPNFGGGGGFGGYVPNQGGGGGGDWGNPHGAKRPRPE

SEQ ID NO: 877 - protein, 350 aa, Unknown
  Kingdom: Fungi, Phylum: Ascomycota
MSQPNGAGRIAIKFGSGAPSKNSSRPAPPSSLGKRSRPQPWGHDDESGSDDDIRGGAHEKITGFGASGAENEEKRERPEKKEYVIARQPNRDWKTEARGNKRGRHASPPGVARQQNGGDTETEPADQDKGIKWGLTITKKDKPEDGDAHNVEPDPEAPPDEASKSPPPAPRTVDDEAMDALLGKTPKKDELVIPSAPATEDSAYQAAVAEAGEASTLADYEAMPVEEFGAALLRGMGWDGKERAPARKPVVRRPNRLGLGAKELKDAEDLGAWDQGKKRSGGRDKRPPKLSDYRREEEKRKERRGEDSYKRERERERERDRHRGSDRRERDYGSDRHKYRDRDHDRHHRR

SEQ ID NO: 878 - protein, 1142 aa, Unknown
  Kingdom: Fungi, Phylum: Ascomycota
MDDIWRRNEALFRRLYQEERKTLVEVKEIVEAEPHCFPEHRISIYETRLRDVLGLRKKLKKEDWVSIHRYTIAQGLHHGEYDIFLNDTRICPKKAWKEIRRNRCHGQRNTLSNNSLPPGVRVLRRPMITSTQPEPSSATTLARNHQPAAVASNTETELAQSQPLQTWDSFSAALYAIDTFPSFPANTIESTDKGTQAITQYSVAEIVARNVHETLPWNHFRMTVLGLMFNRKITYDMVDLNGLVSQYMPNDGFFPVAPGSLVSPFADSMYPSRLGPNQYAISHAITSDQLVWYQQLARLGYMITEGIGFHLDARQFVEFGSLLRQQSPEVVFRISGSCRLFMRAVWDAFVAHMQNACSFPRDRYLQSNPHIDADVLRKAFTDVIRVVLATYPEWIQDSKDMLLMVSAWLGSPDLVTQLLDHGATASYSEGDRSTILCAAEAGLTAVMKRLVSTIDINAPITTDGNASHFSILVQGIIKEELYARTKSGGDLLDTLNILLASGANADDPYPFTNGNRGRKLKRLHGPWPLSCIEMAFYYSHRAYAVMAEYSSEEFGVMTRLGVCVAASTGHIALEHYMTSRTSPDVTRRHQLLKLVLLHTMLIPFYASGMKRLNARQAKITRVLLQYGVCPQFLENEPRITEYAISAWLGSVKEYGLTDDLQAILVFLRMVHMEPEPLFWENPIEENGTLLLTFLREHNVVNELVVRRHGHIMLTAAALNENTEAITWLLEMGADINAPMKIPECLFTGSCIAFCFESGASIEMCRHLVRLGAKLRLFSSDKSCARLLCYALDNALRNPYGHGRTSYVGRTLGIWNLFQEYSAEVDLISMLEWRRVVWGLHRKFAIWKDDKSLAPLFHFLLSKTAKPGCTPPLIFAIRLNQESMVRTLLASEVDVNEAYADTTPLHAALDQADFQLAKRLIDLGANIKILRRRGFKLSDDALSTACFAYKHDPATPLARQARLKVIQLLIEKGADINGGHIPASPQTLLRPPLSICALLGDLEAAALLLKNGADPNVVQLLHMGGVRFKMTALDDAVRGGRLNMTQLLLKSGGMSAAPGRTGFDGALDIAAERGYNAIAELMWQHIHDLEMSFGESAGGRARHEAIVANVQSRAEDAMAFVDVQISISEGQSDEDEWSGEDEW

SEQ ID NO: 879 - protein, 574 aa, Unknown
  Kingdom: Fungi, Phylum: Ascomycota
MTSPAQLPGTLGPLPTQRSSGHFSATWHCRGGHGARGRLSPRWDAPNTAELHSLHTPVRHPILQIAHPPPTLASSSPSTARAPPNSRRSASKIGRLLHGSSRARCSWASREEPTMTSPETETARVVDAAATAAPDQQAQTSQGPGGMPEIELLARRPARSETPQPQSNDDLQRETANDDIPVAASKRRLFYSSAQWTADGTTVIVGASDNSVSSFVLPADLLQSAGQDLVLEPQATAHLPEPTHAIAAAPFFSLADPASQTYLVGCRDHPIHLYHAFSDPDAQSTPLGAYRLIRKETEQYITPNSMIWPQPGTHFLCGSANRLDYFDVSRHGSDGPLLTVPTIPSKRHISKGSGVGMKGTVSALAASPYDADGGLLVAAGTWTRWMGMYDLGRTDKVVANWSISQAASANFGLDVDGQGIVQVAWSPCGRYLIINERHSSGLLVYDIRGAGKLLSVLTGRTCFSQQRLTCDVFQGDMYGSTGFEVWAGSQDGNVRVWDNVGLQEGPAPPSWEWKAHDSPVGSTILHSCGSVVATCSGAWEHSPDHLLGDAVDEGSQSRVLDESSLKIWSIGSQG

SEQ ID NO: 880 - protein, 635 aa, Unknown
  Kingdom: Fungi, Phylum: Ascomycota
MRFCSIPAGLYLCWAAIVAAQAPYDFGVDIERFVRRQDTGARIVVGRLPITSNSTIPRRLEIREMREDAYKWDLFMLALSMFQYVNQDDPLSWYQIAGIHGVPFQTWNGVEPVLGGAMSGYCTHSSALFPTWHRPYLALFEQEVYRLANLIAAMYQNPAERALYQRAASDLRIPYWDWAKDAPPGQTQFPDVFWDAVITQNGPRGQQLIRNPLYSYQFRPVNEDAFIWSPLKFWTETKRAPDTNISVLYPPSRNDLINAALLGKLPEIQQRLYILFSGYKDFNSFGNKAWAVSQNLSSVDSLEAVHDVIHIYGGLKGHMTYVPLSAFDPIFFMHHAMTDRLVAIWQILNPKSWIQPMAAGETSYNSLKGTLQQSDTPLTPFFKSQEGAFWTSDDARTTEVFGYTYADTDPFLAANQNFRGELARKITMWYGGSSPVALKMKTSLHHGTEPSGSVHLRDNHFKSFRPNLKPDALDPSLSSIVQQGKYTEWVANVHVNVEALDGSFTIHFFVGEAPTNIGEWEGAQNHVGSVNIFAMDRNTGSRSKISGTLPLTSALMKLVAVNALSSLDPSVVGPFLYRTMQFRVVGSDDSEVNPRWVDGLFIGVSSSEVIMPDSDLELPHWGPSVRRLEIWPDEQ

SEQ ID NO: 881 - protein, 1649 aa, Unknown
  Kingdom: Fungi, Phylum: Ascomycota
MHNMSGNHIIGNRNSTPEANTASSLRPPSSRPVGAGSSLRASADVAALTAAPPSSRIRPSSDFYGQSQQGSGQGNLETDSQDKIAQQWIADIDQYETTLEEMAAATLDQDFKDELSAIEQWFRVLSEAERTAALYALLQQTTQVQIRFFIQVLQQMGKNHPLSGVLSPASFDKDPMSNRLSDAMGKLNVEPARPSLSRNSTISSVKRQSGLDPSTINAMFPDAAAAIATEKAKFTQQTGNPPASNRNSAALDARLSMAGEPRDATSSGGAVPWGSGLGDQNAPKGQAPMGQFGQTPQSAGLRSPVPRTQMANNAPIQSTTLTAPDTNANDLPLLSPYNSGSGNWASMVNTPMAPSFNQQQQNGGNQADMVANATAMKLAALSTVNNRFALDDVRKYRRARSNDAHGSGQTPMSPANQSFSIPGTNVVMINEHGQVLSRDQIMAIQAQQNMNLGGQRSRPTSPGLAMQQSGMGALPQFTSPQNNGFLSAYDGTSPLMNPGIPSVNIGQLGLGEHGGYLSDHSDIARGRSPRGRRGSSKPPEDPTDPSLLQDIPSWLRSLRLHKYTDNLKDMKWTDLIELDDKALEERGVNALGARRKMLKVFDQVKEAKAEEVFLDFWCFRTREGSEVFEALDKAQYSKFERRQPFKAPEYVPIEIPVTLFVGAIRTSTELRRLAVYHNLSSEKPIYNNPMEAQDDDAHSESGQFDDADSDLEELQGDIAKYDESVRQFLASHHEAGEAALHLRGGPRGRGARGPRKAAKPRGDITARLAKVNQAFLAGEYDRALDLAFEVIRINAETHQAWTALSSTFAEIGDKSKALSAMVYAAHLRPKDVAGWIRCASYALDTIAEDEGGNLHTARLCYSAALRADPNNLEARMGKATVCHRQGHLATAVSEYNKLLKRHPGDIDLVRKLAEACMDTRHAESAVPTAIIAYQRYFKLEMGESGDQMPALDLWYDVGVYVEMFAYTGSYGEAIRELKTLARWLIGRGDQKVWDEWQEDDREWDLDNIRINQLPPDFGVQWAREDSGASQRLPLDLRARLAIYRFRLGQPDEALHHLALLQTDEQTTATFTDEFPYLAFDLANSLAQYGYNAYAKTFLEFLQALPGEADAAVLVQLGRCNLALGNTSAAEECFLAAIDADEMGIEPRVELANMYESAKEGEEALILAAEAMAIREAQAEGTGIAVSSPSELTGSAGDNAARQRLAAGSVRGHSRDGRDAGTHPMIPRRYRPKRLADPSKRRQEEQAHAVKLAHRYQLVTDLKRQIADGKKEQIPAWMSSSKDLIDDFRSLRRFYTWDKYLHFLGPGSTTDKPSREQGAENDLSQLYQRLAKNVTPAGEYSSRSESTSILETHQGITFDQWLELFLEYAIALAIEHRHEEAYRVCESARDSTVFQSAEHSFLIYVTWTVCAIYASDEGKAIALARHLMRDMTSSDGSRLYGLMANLCQSPISWYTSGPAQKFILRQIKLIDAASGSAANTLPVMTHDSSSGSGLDLCLLMLYGHILFTSTSYTFALSYFLRARSIDPNNTMVNLSLGLAYVHYGLKRQSVNRQYILLQGQSLLAKYAVNEGQVSGPLGSAESNYNIGRLFQLLGISHLAIEYYVKSFQAALTGKGTDNVKMMAMVNCVNMFIISKNRGLALALTRQNIVL

SEQ ID NO: 882 - protein, 600 aa, Unknown
  Kingdom: Fungi, Phylum: Ascomycota
MTSLFFRVCTANHLPKTLLNEEHRLRDSYYRALVARASARLRRIRAFRAPATHLQKRRKISGCYSLQKLIQRHPDMASTHHQQLRRRCSSAADRASVEPLAEPEATTTTLPTPEHSSPTIAHEVTKMGPQSVSCDTTGDAKAMPPPPLPTGVEAASPTRQSRSTSTASRNANRLSLTLPIALPTSDPSRPTPTSAVSGSVPPTPIDSPAMKTPSGTNEFIIAVAAQERRVLELREELARAEADLIKLKKQWTAQEAQQKRASLRQLDLSRTTTPTPDDEPRSARLSADLDRRRSLLLNQGTPTSTPGRRRVLRGGHTRTLSLLSPPKSDSGFAVHEDREHEAMKLPSAELRATQLTNPTLPKRSSWQPRMQPSQVQQVGGAAMPQLVEDFKLGFRAFVEDIRQITVGEEPINGQNGAPGHGRSTAGTSSTDDSKDHTSRDQNTIRPTQPSRPNVVTTFDLAGSLSAGTPTPPARTRDAGRDNVKPTKNKRFSWTPLGFDSLDDTDWSNWESPASTKSSRWSGSTVNTSATDDTPSIPENEETTPRFELDTPLSPSKLKEIIPSMVNGFSPSNLKRTATTLMTEWEKSLITPEDPDKENEM

SEQ ID NO: 883 - protein, 118 aa, Unknown
  Kingdom: Fungi, Phylum: Ascomycota
MLYELVGIVRPGSLSEVKEIVQTVGTLVLRNGGVIRGIANWGVSALPKPISVHQIKQTHGHYFVMRYDASAKIHETVRSTLRLEPRMIRAGHVKLGDGRLSTTAKFGAPKWKTKLGEV

SEQ ID NO: 884 - protein, 351 aa, Unknown
  Kingdom: Fungi, Phylum: Ascomycota
MQAISRSAVRSAALRQVSSRAYSSSSSPYSKTIENLRINSDTKVIFQGFTGKQGTFHAQQAIEYGTKVVGGTNPKKAGSTHLDLPVFKNVSDAVKETGATATALFVPPPLAAAGIEEAITAEIPLVVCITEGIPQHGMQPPRGTLAEYKSLMMMLDMVRITDMLKTQSKTRLVGPNCPGIIAPGQCKIGIMPGFIHKRGRIGIVSRSGTLTYEAVNQTTQAGLGQSLVVGIGGDPFSGTNFIDCLKVFTEDEETDGIIMIGEIGGSAEEEAAEFLKANNTVGGGKPVVSFIAGISAPPGRRMGHAGAIVAGGKGGADSKIAALEAAGVIVERSPAGLGKALYDEFVRRDLL

SEQ ID NO: 885 - protein, 353 aa, Unknown
  Kingdom: Fungi, Phylum: Ascomycota
MADKSKQSPEAEADPAPTQALPTTATQISEVTGLPEQTPQEAIVQGPVQVDEDIANDDDDGYGGSDGSTSYVTSLASSVLNYKYEPNDDDEQERMDMGHHIYRLMLGGELGLAPIPKNPPRVLDLGTGTGIWAMDFADEHPASEVLGTDLSPIQPKWTPPNCVFEVDDFESEWAHRRPFDYIHARELGGCISDAPKLFSRAYDALNPGGWFEINATRPGRFLSDDGTDKLATDAQFWMTNICEGAGKFGKPLDSAHEWAEQLRQAGFVDVKEEIRKVPCGPWPKDPTLKEIGKVQLYQETQLISSYTPAIFSRVLGWEEAEIQVLMAKTKMDLKNPALHLYLPVYFIWGRKPE

SEQ ID NO: 886 - protein, 298 aa, Unknown
  Kingdom: Fungi, Phylum: Ascomycota
MASGTAMAARHDDIDNYDAGDLSDDPFASPPPDSGPKKRKVNGDGGLGIDEEVSVQKRARVPNVKLDEDRLLSPAGLPKLKARASSLKIKGKGHEFSDAARLLSFYQLWLDDLFPKARFLDALAMVEKAGHKKRLMSARNEWISAGRPGNRAIDDDDEGLESNTRSAAHFSDVVNSTAAHPSTPPRDDVPDDDDLYDATPRAPRQTQPSEDVPEGDDLDALIAEAEANDRTKQHLSTKTPFATREGDAADELDALIAEAEATEGGENGRTKGDKETGNGTGNDFADDEAAMQEMEGLW

SEQ ID NO: 887 - protein, 437 aa, Unknown
  Kingdom: Fungi, Phylum: Ascomycota
MTGTGAPGGGSSAGFSGQAPHRSYEERAAAREQMMNNIRETSQQDRRVYVGNLSYDVKWHHLKDFMRQAGEVLFADVLLLPNGMSKLTPGVCSQSSQGCGIVEYATREQAQQAVAQLSNQNLMGRLVYVREDREAEPRFIGATGGNRGGFGGGMSGGFNAGYGGGGAPGGGGRQLYVANLPFNVGWQDLKDLFRQAARIGGVIRADVHVGPDGRPKGSGIVVFESPDDARNAIQQFNGYDWQGRMLEVREDRFAAAGGMGFPGRGGYGGGMRGGFGGGGFGRGGFGGGRGGFGFGGRGGFAGGGGGGGGGGFDAPAAASVPPNPFTDHATAGTERSETIYVRNLPWSTSNDDLVELFTTIGKVEQAEIQYEPSGRSRGSGVVRFDTPDTADTAIAKFQGYQYGGRPLNLSFVKYLNQGASDSMDTDAHAGLTQDQIM

SEQ ID NO: 888 - protein, 285 aa, Unknown
  Kingdom: Fungi, Phylum: Ascomycota
MAFTTNATIASFGGRILKLTHQSSTTGTPMNLNLFLPASASPSKPAPLLIYLSGLTCTPDNVTEKGFLHAHAAPLGLALLYPDTSPRETNLPGEHDSYDFGSAASFYIDAKKDPYAKNYKMETYLTKELPGLLFQEFKELDGGRVSISGHSMGGHGALTLYLKNPGAYKSVSAWAPISNPSKCPWGEKAFSGYLGDDKEEWKKHDATELVSGWKGPLNALVDVGTGDNFYKQGQLLPENLESAAKAAGVDGLQVRYHENYDHSYFFISTFGKDHINHHAKFLSLL

SEQ ID NO: 889 - protein, 261 aa, Unknown
  Kingdom: Fungi, Phylum: Ascomycota
MADDHDGYGTAGLMDDPEGYYPPTPPPTQTVFTMKSGHSLTLHLVGSSPTEAHHLWNGAKIISDYFEASPCRVKDKTVLELGAASGLPSLVAGLLGAKKVVMSDYPDVEIVQNMQKNIDLCDEGAPGDLRGRIGGGTVDAAGFVWGADVQPILARLPPSHDRFDVLILADLLFRHSEHGALVKTIREAMAEEGVAFVFFTSYRPWMREKDMKFFDVAREAGLLVEKVEEVRLEKPMFEGDPGDLEVQKTVTGWELRWPRKA

SEQ ID NO: 890 - protein, 195 aa, Unknown
  Kingdom: Fungi, Phylum: Ascomycota
MKFSAACLTALAGFALAQDTQSKPFKLVLCSDDKSLNGYPLTSCHTGAAIESLCLYDKTGSEFRFNTTAGAPPAAKGYTPSGELVWDLVGTGFSVSEPMYFSVDPSTNVALPLFTPSDSDIQYVAFEDKTDALRVFSYVDDTKNPPKTTGPTALNRWYVCSTNYAGYQYKTLTWVLGNGKPQNPSCKKVDVRRQF

SEQ ID NO: 891 - protein, 241 aa, Unknown
  Kingdom: Fungi, Phylum: Ascomycota
MPLETITLEHLPDTHKAHLAFFRNVQNASFLHEQLLARNADFEYAFIDASVCERPACVLDAVEQRVKRHRALSPEALFLAERNLLVLVLTFTRLQIISRLQVLSAVFRATTTLVHGTLKTPNVHSEVVASLTSSNNIAEAYRRFGVSPATRDLIVVKVTFPSATSPEPSSAESVWSHLKEHVLGEAADLTDEALVAITDLSKIRKYYKLNGLNWLENVEDERTRRKELESLILGGMALRGI

SEQ ID NO: 892 - protein, 1230 aa, Unknown
  Kingdom: Fungi, Phylum: Ascomycota
  misc_feature (1008)..(1012): Xaa can be any naturally occurring amino acid
MAVLDSKKEQAAISGSSEQLEDAPSSSVAAALAEENLAIPPLEPDRDAPPAYGDSPNQMHFSQPGIDAGAQVTDDGRVAININTKNDRLAELLRPLIQKTLQREPALPPGYIPPSLGGQPGQVPPPKLNVVIQIVGSRGDVQPFIALGQVLKNTYGHRVRVATHPTFQSFVEENGLEFFSIGGDPAELMAFMVKHPGLMPGFDAVKSGEVSKRRKGIATMLLGCWRSCIEAGNGFGPAPKPHAKGDTFDPTQDLPGDDTNLPFVADAIIANPPSFAHIHIAEKLGIPLHMSFTMPWTPTRAFPHPLANIQSSNADDVMTNFLSYTLLEMMTWQGLSDIINRFRENVLDIPHMPLTAGPGVLTRLRVPYTYCWSPALIPKPNDWGNTIDISGFYFLNLASSFTPDPSLTDFLESGPPPIYIGFGSIVVDDPNTMTTMIFEAVKKAGVRALVSKGWGGLGADDIGVPDGVYMLGNVPHDWLFQKVAAVVHHGGAGTTAAGIKAGKPTLVVPFFGDQPFWGSMIARANAGPEPIPFKQLTADKLAAAISVCLQDDTQERAKELGLKIASEKGVDEGGQLFHKHLDIDSMRCALAPHRTAVWRVRRTQVRLSPLAATVLVERGLLQYSDLKLYRSKEYVTESQPPGPITAVTSALVTDISGIGLAIADMPRQIFKTTTRACSPHGEEETRLTREDSLPPSSGSSMRGAMRGRQLKSSGSKSNLSLVSSADSVDTSSTLLGEADSITTKLFKEKESDSTGQQTPSGTLTPVSNAPPPPRSAPKSQDKDCTVGAEAIIEAGRGVGHIVGMGVRTPMNFTLGLAKGFRNLPRSYHDDTVRPEEKVSDFRSGLRVAGREFGYGLYDGISGLITQPLRGAEKEGAAGLVKGIGKGLAGVVAKPAAGAWGIPAYTMQGLNAEVNKMFGRSLHNYIIASRVAQGKGDLTTATAEEMEDIVLRWNTLHDELKPFFSMKEGRHHHHGRSFKSFWHTRHMSFDERKKLHAQKAALKKQSLSXXXXXGTSTPTSIPAHASRAADTGSLYSLASEDPVFEQAIRDSVKETSRGNPEEDVMVEAAIRASIRAMQEKGISIPQPEQVDLPAEKDPSIFKDPEYQVTDEEYQALVEQALQRSMGGQPQEESGDPAGQVDDSELKRAIEASMKDAQKHDSQRAEEDIVLEYVKKQSMAEEEYRTKHREGGQGTEGSMKGGDEDEDLRLAMEESLKMSQSSGGGPSGASRS

SEQ ID NO: 893 - protein, 376 aa, Unknown
  Kingdom: Fungi, Phylum: Ascomycota
MKVTFRDLKQQKFSLDVNPDDLISAVKEKIAAEKGWDAKHQKLIYSGKILKDEETVGSYNIEEKGFVVCMVNKPKEKPAPAQSSSAAPPATPAQPVANTPAAPAAPAPAAGLSNTSAAPSTPTPQRTTEGSAGGNGSSGLALGAERASAIASMEAMGFERSQIDAAMRAAFNNPDRAVEYLLTGIPEDAESARSANLPPPMSEVEGGDDDDNVNLFDLAAQQGGPRSGTGARATQEMNAAGGDSNNLDFLRSHPQFQQLRQVVQAQPQMLEPILQQIAAGNPGLAERIASNPDQFAQLLSEEGDDDAPLPPGAQSVSVTPEERDAIERLTRLGFSPDQAIQAYFACDKNEELAANFLFDQPEDDDQPPGAGAGGQN

SEQ ID NO: 894 - protein, 757 aa, Unknown
  Kingdom: Fungi, Phylum: Ascomycota
MDDPWGSPWAADDTQLKLDLPVPPPQVHAPQTPHKTASPWGASDEDDTCGAWNAAEGGHGADSPGWGRSPALRPARSNTVSRHVSPEPWGRLRTCDSKSDATEERKSDQDVPVPVDSAISLGEEDPFAPKLQGEKEDALPQSAVPVSFNEVELRTAHEVHSSEDVSAKQDEGPSEWPESPTGEPSRASTAPDRPEVTRQTSKVQELVHMYDGIAKRKNFPGEPLVAGPRIVLVGSDGVQDQDQDQDQNQEDEARAKLAEDGAYPSAQEGTSDYNNFEGNDGKDDTSDDVFNDVVSTIEATESSQLDEPEKPGGPVEIETHGEPPPEQPLSTDAKRRPIPYSYDLKWLDELFPSTPAPTVDPEPVPDVIIDDTFASISERKAWYRVSRRGPMRQHNQGNDEDYVRLDWRSSGVRGRTLKIVRRWMEEDSIAGRVVLGKRTGPVGASMFNWDSQAPQVGIGELLGKSSHRRSISGASRGSKGSLPSPSSATFAWSARPDGPSSNVKPSLEEPKRNSWIAPPQTIMSPVAPDFGWSSAPRNSSGLGDKSASSDVALDTRKDPTSLAALPSRTPQSLDSIITTGLTSASLRDQPIPEAENDDDDEWGEMVSSPTWPPNVTASQTGQLGDLAPDPIQDAPSTARSQTSSPGSELHATSTPLQSKPLEPRPTTTDLWKEADHQQRTPAADQDVLDPWSMFEPSKKADGSLPGVSLELSKAATISADKTPESTVKPPSTTLTAEEQEFVQRTLHDLPDLSYMLR

SEQ ID NO: 895 - protein, 274 aa, Unknown
  Kingdom: Fungi, Phylum: Ascomycota
  misc_feature (15)..(16): Xaa can be any naturally occurring amino acid
  misc_feature (157)..(157): Xaa can be any naturally occurring amino acid
LQSLPGYSLSLSLSXXTVGLAVALPAPQENKPFIVGGVEASAGEFPYIVSLQVSNSHICGGSLISPTVVVTAAHCSGRQPSQVRVRAGTTRWSSGGTVARVSSITVHPGYNDSVLDNDIALWKLAQPLGEGNNIGYVKLPTQGSDPSANSTTTVAGXRSASLDSSLTPAKNRGYLQEGGWNVSPVLMKVDVPIVGRGVCTKQYADFNPITEQMVCAGLQEGGKDSCQGDSGGPLVDSTGTLVGLVSWGSGCARANYPGVYTRVGSFIEWIAQNI

SEQ ID NO: 896 - protein, 1518 aa, Unknown
  Kingdom: Fungi, Phylum: Ascomycota
MPVAASRPSRRAATRRNAVVDSDDEDDLIANTTRRQDEDEQDFEPEAPQSPKRTRRSSRQSSIAPSQPPASRGRGRPRKSVAPDTSVAEENSIAESEAASEADRTIKAAPETPPKRRKMNTPSIAVSTPAGKTLPTPQSAAPSDFTAVTATPLSDITATSVNTRLLDETQATVKPIRTMDAIMENPIDIKLKSRTMTNMPFVEPEAPKSRIVLTYLILTNFKSYAGRQEVGPFHATFSSVVGPNGSGKSNVIDSLLFVFGFRASKMRQGKVSALIHNSAQYPNLEFCEVAVHFHEVMDQPDGTQQIIPDSDLVISRKAFRNNSSKYYINNKTSDFTTVTTLLRDRGVDLDHKRFLILQGEVESIAQMKPKAGNEHEDGLLEYLEDIIGTSKYKTPIEEAATEVEALNEVCVEKSGRVQHVEKEKHSLEDKKDIALAYIRDENELVMKQSALYQLYTHECNENLAVTQEAINEIQAQLEAELEKHHGSEQIIKDMQKQYTKGSKDLEAQQKAAQTLAKDLAKFEQERVKFDEKRKFLDDKKKKLEKTINNAEKNSVEADETIEQCTEEIEKRTKEIAELEEQVRAEEAELASIRDSLKGKTQEFSDQIAAKQKSLEPWMEKINQKQSTIDVAESELNILQEKANAGAKAREELEAKAVQIEESKATKVKELKDCEKKMGELLEEKAKFESELEQLAGTEPKMRAKISNARQKADEARSSLASSQSRGNVLTALMRMKESGRIGGFHGRLGNLGTIDQKYDVAISTACGALDNFVTETVEAGQQCIEYLRKNNLGRGNFICLDKMRSRDLSPIQTPENAPRLFDLVQTKADKFRPAFYHALQDTLVATDLAQANRIAYGAKRWRVVTLAGELIDKSGTMSGGGTSVKKGLMSSKLVADTTKEQVTKLEQDRDAWETKFQEFQEYQRECETRMKELEKEIPQLETRMQKLSLEIESATKNLTDVQRRIKDVSKEHSFSAADEKRQSALRSEVSKLNREIENLHSETSSVEKEIKALQDKIMQVGGEKLRAQRAKVDGLKEEITSNQEETSSAEVRKAKAEKQKVKLEKDRAKATKELDAALQDLEKLDNDVSNQGEKADELRAKVDEAEESLNAQKEELATLKSELDEKSAELNETRAVEIEMKNKLEENQKTLVENQKQLRYWNDKLSKLALQNIDELIGEPDKGPVGPQPAEGEPASVEPGESNDEAASSDVEMADARSQQTSSDAEMVDAKSHQTTESSEQGEESGADAEDETMIVETRAAKYELPQYTPDELAGMSKKTLKGEIAALEEKTQNVNIDLAVLAEYRRRVEEYVARSSDLNAALAQRDSAKKRCDDLRRLRLEGFMEGFGAISLRLKEMYQMITMGGNAELELVDSLDPFSEGILFSVMPPKKSWKNISNLSGGEKTLSSLALVFALHHYKPTPLYVMDEIDAALDFRNVSIVANYIKERTKNAQFIVISLRNNMFELAARLVGVYKVNQMTKSVTIENRDYIARPQPVQRQAPRPPIGGGNTTTLALR

SEQ ID NO: 897 - protein, 334 aa, Unknown
  Kingdom: Fungi, Phylum: Ascomycota
MAFPKLIAVYGATGAQGGSVVQSLLQNKDHAFAIRGISRNPDSEKARALATHGVDMVQADGFNKEQMLAAFKGCWGAFINTNSDDSSVNQPGGPSEEDLGKIVMDAAAEAGVKHIVYSSMISVTDLTKGAVPAISFDHKHAIGQYAVHKGVFETVNLISPGWYMENHLLEELAPALGGWPLVPDEEGYLTLRVPRWGGNEKIPFIAIGEDWGDLVHGALLHPEKYNGKLVHGMSQESTASELVDIFVEVTGKKSRYIPIEDWRTFETYGEGALDTVKHMFGFCQYSGGLYYAERNDLAAPSELKRIAAEARGLRGEDATLLTLKSFFMRNFPKE

SEQ ID NO: 898 - protein, 746 aa, Unknown
  Kingdom: Fungi, Phylum: Ascomycota
MSDIPVGAAIEEASAPAPAASNATSTAPTFEGANKFQHAISAWRNLDLTALTANLDNTASEIVAYQRDSTVQRKDLAQKTKDFRKYDDATKLTEIKGLLKAYQTFIDLITNHSKSINSAFLQAYTSLSDVPDPYPLLEASVDAMLVSEETVPKLTEENKHLQESVAKLTSQLEETEARLQTERSARKELEDSLEGRVKEVESSWAAVLDEKKDNWEAKEKSLEEKVENQERLLNEIRASYEVNQRLGKNGDEQDGQRGNVSSAEFEMLHADLERTSSRLAEVEARNEQMRIELAQAKASQTSHSETSLEDDPGYMRVRSENSSLIRRLDAARVEKDGLKRDLDTKLRSMEREVQLLKEEKDTLKAKVQKWSDYDDVKQELEVLKSIEFATGDDEDTREHLEGVVTDGAKGETLEKLLLSRNKKLGDELTILRVSHQDLQTRLEDLQEELSRTNAELEKSQNLNEKLESDLEKMHAEGANAFPSGASVAGTYITRNAGRIKGRISPTSSIISGIDPRSGPGEREPMGGGSGILPMVTAQRDRFKKKNAELEHEISESHRTVQQLRQEVAALQKDNLNLYEKTRYVSTYNRGGATVSSSSAYATNPNPSTVSIGGVSSAGGGGLDRYRKEYESNISPFAAFRGRESARAYRRMSLPERVVYSITRMVLQSRTSRNLFAGYCVALHVLVFFTLYWLGSADFESHATNLGASAAAAAAAGRVANGNAAAGGAAAAGGKNDWKPAAFDGKT

SEQ ID NO: 899 - protein, 345 aa, Unknown
  Kingdom: Fungi, Phylum: Ascomycota
MLRLRSTAISLTSTELREFELRCRYRKHLRSRGSLLPAVDGVSATDDNSASLDRRCPGPSGPQAKPLRVAMAESTATAVQLTSGLGRADGASPVTAELEDQFRSLHSADTMTDTIEPSKSSTSPKAQRDARAKLLVDDAPVSEDTFNRLSQGTDGQSRSSLTDSREVDSPRTPEQALGDGTESPRSRSSRLMRSTVGRLLSRVRSLGSRGHGDAVNGLDREEGHADSTAWSHLETSLTPRLSIYDDSVTHTWQPRSASSLPESRHRSRVDATVLVQTSRLAGLRIGSPLSDATQAQAVGGQLSPVGGERPVSSPGMRTPGFQGLYGGVENLDEEILQRLRSPGTR

SEQ ID NO: 900 - protein, 476 aa, Unknown
  Kingdom: Fungi, Phylum: Ascomycota
MASSTTGDTGSVSTATIADPETKPLPASTSTAKPFPDIDLEKNNNHVATENAVADERQTVQAAPRGPPPGMRPEDFPEGGRQAWLVVFGGWCALFCTFGLINCIGVFQSYYVSGPLRNYDPSSVSWITSVQTFTMIFFGTIYGRLFDAFGPRYLLYGGTITYVFGLMMVSLSKEYYQFFLAQAVVASAGSSAIFSACMASVVSWFMRRRAFAFGIMVSGSSLGGVCLPIMMDRMIKSVGFPWMMRTMGFMFLVLLTIACLTVRSRLPPRRHPFVLMDYIKVLKDVKLSLTSLSFFLYAVGMFVPFNYVLLQAKAAGMSPGLVTYLLTILNAASIFGRILPGLFADKYGRYNTMIFVNLISALFVLAVWLPVKNNAGIIVFVIIFGFSSGGFISLAAPIIAQITPDLRQVGTRLGVSMACQAVGALIGSPIAGAIVSAQNGDYLGLQLFCGLLMAVSVVVLLSVRWMQQGFKLLAKV

SEQ ID NO: 901 - protein, 105 aa, Unknown
  Kingdom: Fungi, Phylum: Ascomycota
MSAAPHFWATPLKYCRWASRERPALFWSVVIGAAGPAMLPTVPPIRRYFGDVDPAPIPVTYPGTSEPEPQALCPFELPGTRPSWAMLTYDIVPNSPRKQLTGYDD

SEQ ID NO: 902 - protein, 322 aa, Unknown
  Kingdom: Fungi, Phylum: Ascomycota
MAILVTGAAGFLGRHLVQFLLDRGQDVIALDSLWTGSIDNLRAFEKHPKFKYIIGDVREPLPITEHLEEIYHLACPASPDQFETHAIDILETCYTGTKNVLDLAVKNHARVLFASTSEVYGDPTVPVQAETYFGNVNCFGPRSCYNEGKRVAESLTYAYQAQHKLSIRVARIFNTYGPYMDVNDGRAVPNFIGAAMEGRDIKIFGDGTATRCFQYVSDCIDGLVKQMESEYTDPVNIGSDVEVGVGEIARMVTKVVAEKMGKKEVVKIEYLQKRKDDPSRRKPDITVARKELGWELKVSLEEGMSKTVDWFLETRDAAPGKK

SEQ ID NO: 903 - protein, 1241 aa, Unknown
  Kingdom: Fungi, Phylum: Ascomycota
MVHASFYHNLSQMGTPRGEDITIHGERIKAYLARATKPKSNGGAILYIPDVFGIWQNSKLMADNFAERGYTTLIPDLFNGDVIPDPRPAGFDIKKWIAGGGNGDNPHTPAQIDPITVAGIQALKAMGYKKIAAVGYCFGAKYIVRHYKDGIDVGFVAHPSFVDEAEFAAIPGPLSIAAAETDTIFPAENRHKSEEILRKIGVPYQINLFSGTEHGFAVRGDPKVKSQKFAKERAFQQANAVILTLMAPSADPGDPPPLPSPILTPTTPTKPCLHTVDTNATLSTIPSDEDPSSEDGSFRSSPGRQPTSNPSSISDTTPDEDENGWNTNTGTTPAASSQTEHLEAHAPVASSRSRSSSSATNKKSVNGDGIPRLTAAEIKELASSPESLPVAPAPARGSIDQEYVAQFSDQREAIRQSMSRHPEIQHPDTFFLSSHATKEARNVRGFRDSARRPSPAPRTLSTPPTTRSQYSELPSDTVSSRRYSYQQTPHLAPLHINIGGLDGTTTSSPSPAPWTGPPSIPSQPAHSPLPRAPSPIPPMIPLPPMSLPTHLQLELAAQRPSPLYIHQSHTADIPYESSAVKFERLKNVLLLPSYLERTLYFGALACLDAWLYTFTILPVRFLIALWILVKWWAYVISKEVLWVLGFVWLGIGRLWERERGRGGERSRRPSELSEPMRSRSRSVLSEHAVDADAAITHPAERQQFLRRTSQTSQPGTGRIKSSTGPSHDPGPKTGTFRQHRRTKSMPSSLSAFHKADLLQGCVILCSSIALMSLDASRMYHFIRAQSAIKLYVIYNILEVGDRLLSALGQDILECLFSSETLSRNASGRSKILLPLGMFLLALAYNCLHSVTLYYQVITLNVAVNSYSNALLTLLLSNQFVEIKSTVFKRFEKDNLFQLTCADIVERFQLWIMLLIIGMRNVVEVGGLSVPGAGLDAGSDEAGPRHTSSNMPASFTLIPSWLMSGEVLSPFLIVVGSEMLVDTIKHAYVTKFNNIKPTFYSRTLDILCKDYYTNAFSAPSLTRRLGLAVIPLSCLFIRASVQTYHMFLSTHVSMPGPPTTQTSLSDPSATPSSPAVLAALTRFDSLIRDSLGRATYGYPYGSPLNSRPWYSWTSDDIIATLTMVIVFFIVFLVLLILKLLLGMLLLKYARNRYANMRMREQAVARGTLERETFEAAGRRVGGFGHIEVGEERQRWIHADKTEGLRDAKGIGGKRGGGEGEKKKQDVDFQGVNRYDMVSKRIW

SEQ ID NO: 904 - protein, 91 aa, Unknown
  Kingdom: Fungi, Phylum: Ascomycota
MKLSGAIWACLTTFGVVDFVAASDSDHPKFKDQWSALKYADKLNRGVRPGCKESGGKCFSRGGKGKVFCDPAEVMAAVAMAELASDEWQKS

SEQ ID NO: 905 - protein, 685 aa, Unknown
  Kingdom: Fungi, Phylum: Ascomycota
MAARDREMDDGGESLDPELLYTKEFCIGGGSFGKVYKGVDKRTGHAVAIKVIDIESAEDEVEDIIQEIAILSELQSPFVTKYYGSYAKGAELWIVMEFCSGGSCADLMKPGLIGEDYIAIIVRELLLGLDYLHSDKKLHRDIKAANVLLSSNGQVKLADFGVSGQLSATMTKKNTFVGTPFWMAPEVIKQSGYDHKADIWSLGITALELANGEPPYADIHPMKVLFLIPKNPPPRLEGNFTKAFKDFIETCLQRDPKDRPTAKDLLRHPFIRKAKKTTYLTELIERHSRWSATHKDNDENDWDSADGGAPTQREQVEEDMWDFGTVRLVGDRGGIVHRPSLNAMDEKATNARAARLQDSSGDYSEKRREASPTKTRDFALQPDTTLKANSRQSSPQRKPVPAGQMSGSPAKVPLPPSPMKTLLRGEAPAEQTPKGQRVLPSVPSQSPDYDQELQAQLQRDMGLMNLNLAPVLQASSGSPRSSVANRSAAAVSQEQSRPSSSRIAPIQLPEIPPFRGGSRVSSQQRVEPSPPPTQGQVPLPNPTLAQLPLPSKSQSPAPSESSIAPSSFPSPAPANPNGELDALNDVIFPALEEALKRRQIRLQHLLRPAVAGANSSTPTPRQQRAEASHEKLRKLVYKLAHVCKEIDHYDKAEPVGMGRDVGSFLEGLLEEILVRVEPLDEEEVA

SEQ ID NO: 906 - protein, 363 aa, Unknown
  Kingdom: Fungi, Phylum: Ascomycota
  misc_feature (55)..(55): Xaa can be any naturally occurring amino acid
MSSETTTLHRLGRDGPMIPAIGFGLMGLSSHSYGPPPDDDGRFALLDRAWEIGAXRERESYISSSCDPILLTSFLSRSLYGDNEELLGRWFKKTGKREDIFLATKFGFVKGGQKYEVDSSAEYCKKACAESLRILGVDVIDLYWLHNANPKTPIEETMRAMVELQKEGKIKYIGVSGVSSTTLRRACKVAKVSAIQADYTVFSREIEGPAGSDLLATCRELGVTIVAATPLGRGILTDNFSSGSAEYASGDTRPQYMPRFQGDNMDANVKLVKKFKRFAARKNCTVAQLALAWLLKQGEDVIPIPGTKKMKYLEENWGALQVSLTDEEEKEIREFADMTGFAGPAAPPQFMAYLYRDTVEEST

SEQ ID NO: 907 - protein, 402 aa, Unknown
  Kingdom: Fungi, Phylum: Ascomycota
MAEPVNTPVPASTPRSASPVPFPPGISTESHTLLPLSPTKLATLSINHHTNIAGSRKPRVLHIGDPVRYNPDTYLTLVTQCEVIRPPAEERERAQFIKALKEKRWGDFHAIFRPFWGTGGEMGKWDAELIDLLPPGVKVFASAGAGFDWADTELLGRRGIIYCNSGLAAAEAVADFGVAMIISTFRHLPWCISAALDPTRFSQCHHNATASSHLLRSNALGIIGLGNIGQQLARRCRHGFGMRIHFFDVERKPADLITELHATAHDTLESLLGAVDCAVLCAPATGSSGPIINASTLAQFRPGARFVNVARGSLVDEDALFQALQEGKISTAALDVHANEPHVHPGLARLAKEDGRVMLTCHNAGGTIQTHQGFEELSMRNIMAVLNGQDPITPVNLQYLQE

SEQ ID NO: 908 - protein, 370 aa, Unknown
  Kingdom: Fungi, Phylum: Ascomycota
  misc_feature (70)..(70): Xaa can be any naturally occurring amino acid
  misc_feature (86)..(86): Xaa can be any naturally occurring amino acid
MCKGHEQLQSSGDVDDASHADSFRGPISDWPAADPVSDRFPVIIQFVDIETPFRTEKFSSEDGLNGWLQXPLTKIRDPDAVPKGDXPSNLHCLIVFDLLTFLFLTLAMDALRRRLDEHIDPADHELQVRLQGFEKSDTQYQDSQSSDESGRPPQGDLEEYFRARPRHNWILLVVILLLATTLAVLSTFHVVLLQKLSQPGEIGSHHQETQHLAKKHADCGASVAEAKSKGCTWDELTKAWIPSQCPQFGLDEYKTEGMLANPHDNATSWPYYADQGGEVEVNLLVLAEDEDRDPLEPVWTTSRQHLTHCAWSLKRVLWSYENGEGHYDKISRLHHVNHCIDTLLRRAVRLDDGVDLITTTVKVHFGWCDF

SEQ ID NO: 909 - protein, 267 aa, Unknown
  Kingdom: Fungi, Phylum: Ascomycota
  misc_feature (256)..(261): Xaa can be any naturally occurring amino acid
MALSICVSSMRASMRLLNNTRPLAATASRAVTARSFNTSALLMKKQKTRGKEPVEDSSDNDSRRHKGKHVTGGKQKNTDPSTASNSPLDPSAPDPLDFTSLTDAFQPIDSHIKSLLQSLLHGGRFNPETIGALSVHVKPPHDSPPDTPTDFPLRELAQIIPRGRTHISLLLNDASYAKPIMSAIQASPDFNQQPQKSEDNDLELILRVEAERKDEVVKRVKDVTQQWRDRVRQARSKHEKTMKEWKKKKLVLPDDXXXXXXIMRRHK

SEQ ID NO: 910 - protein, 269 aa, Unknown
  Kingdom: Fungi, Phylum: Ascomycota
MRASIFLISALAMGAAAAPKYPEFDLKHMKEPGAAIETLSNYFNMIAYKAKAAKVIGRPPICDVSTAQMPTSPELLPPPSQGLKPHHIALGRGTQNYTCADSSDSTVPVAAGAVATLFNISCLASVSPDLVTTVANMAIHFSVDEVTHRPLGPTPWPVSGVHYFRAPGVAFFNLDEGSTADKYGEAPCMKNASAVAPAAAAVGPKGEKAVPWLKLNTIEGATQDIKEVYRIDTVGGSAPATCKGMSKTFTVEYAAVYWFWSGEIVEDDK

SEQ ID NO: 911 - protein, 325 aa, Unknown
  Kingdom: Fungi, Phylum: Ascomycota
MSTAANLYQGYPLALTLAAIALSTSLVLLVQFLRKSQKGYLASPRNRLLLPQPESDEIVALYVYPIKSCRGFPVKSARLLPTGLDLDRNWMFVTADNAEFITIRANPAMTLIRTSYDEDSDELSVSIRDEKTFVIPAHPTAEWLRDNTELKKAGIWGQQTDAWQYPAQLTQPISDFLNSDVRLVYKGPTPRVLRGCGAPDRLGRTEAVKFADMMPVLIASTQSIAELNSRLAEAGENEIDIERFRPNIVIRGREPWAEDSWKTVPNVDPDTAEKNPRQPWDKLVSYRRIDPGLRHKPSFGMLCVPKAAGQVSPNEMNGLLQDLAL

SEQ ID NO: 912 - protein, 1223 aa, Unknown
  Kingdom: Fungi, Phylum: Ascomycota
MHGGHQDRNGLPPNTHGAEHDQEQVERGRTKALPALSLPKNRSTGNLALARSPDPSSSATAADKSRYRMSFDIGSAVNIDSDSSLARSPLMADHEHGLGLSGLRRIRQHHPQSRAPTLPNSNASSRSPSVVALSRSTSMTAMLAAPNTFSISGGPSSPSFTEDLSRFPTESLHSFSFAHQSEEFIHNRENVLKRSIEYMKDRKGWSLSSMQAGLASAQARVTGDLEAQHMLELLARAQLIEAGNLPNADSSVINSGPLTGPAEVSGENLFEKHFIPRTSSPEPISAPSSSIAAQNASKTQPTQHEGSGSGTELDTSSRSQNVANSEESSRTTTGESATTAETSPPASRPTSLKRTMTDTHGITMQTRLIDTLAQPYVLGQPSVPETSALPNFPQFTPTAPTFPAALGPVAHGHTNRWVPAAQAIFTTEAKPPWTIIAANDLACLVFGVTKAEVRKMGILEVVQEERRSWLEHQLLRKEEDDGPEGSAKKKTTPAASAASALLGGRGGITAQLLSKPNSRSAPPKIPSRRAQTVHSGDPTPPKTRASSNHRSNLSRGVLLCGDVVPIQKRNGATGSASLWVKEKRIGLIWVMEEIHEDVANVVLDEEGIVKSISGASQAIWGISEDEKGFDIATLIPRIPRQGINPNEGDLDFAQIAKRRYFTAVNAKKTNIPCTVEQVRGRIELKVSTFPHMAGIVVVDPENMQIRSSNSAFCSALFGFEKPDGRSINTLIPDFEKILQILTQEEGLHLVDGMVIPEHRFRRASAFLALKEHRPDAAAAFLQPEGLQARHRDGSDLKIDVQMRIVKSEKQPAILEETVVEECSESDDEKDGDDTFQVRQSEIVFALWVTYSRNLHSSQHQLGTTSTQASGATTPLHQPSPGQTRVTSPMELSSDGEEQGKQEERRSESKTLNLSKQLKDAALNAAAKLTGHPKPASKDDEAPAPTADDQSQPPHKTTIDDYTILEDMGQGAYGQVKLARNKLTGKKAVLKYVTKRRILVDTWTRDRKLGTVPLEIHVLDYLRRPEFRHPNIVEMEGFFEDDVNYYIAMVPHGLPGMDLFDYIELRANMDESECRSIFIQVAQAIHFLHTKALVVHRDIKDENVILDGEGNIKLIDFGSAAYIKNGPFDVFVGTIDYAAPEVLAGKPYSGKEQDVWALGILLYTIIYKENPFYSIDEIMDRDLRIPFTLSDESIDLVRRMLDRDVKERADISQVIEHPWCQMQS

SEQ ID NO: 913 - protein, 1234 aa, Unknown
  Kingdom: Fungi, Phylum: Ascomycota
MSTTTSLSPSQSTKATQGGSAQETAGIGLTSFLTSLAVAVAIFGVQTLLFLLLRNKLARIFKPKTYLVPERERTDPPPNSPIGLLKHLFNFSDREIIKKCGLDAYFFLRYLKTLLVIFVPIVCIVLPILIPINYVGGKGQRINVNEDPNNRNSSAVTGLDTLAWGNVKASHTSRYGAHLLMAILVIIWVCAVFFFELRVYIKVRQDHLTSAEHRLRASATTVLVSSIPAKWLSEEALRGLFDVFPGGIRNLWLNRDLTELLDKIDRRDKIHKQLESAETDLIKDAKKAQMKKRDAEEKKQRKKLNLKSLTKQERAERDAEEDAEAQRRANSAAGLNAGDQHQVPHDIEEGMDESKDQEGQKGDQEQSGRGFKIPRLANPFDFVTQGVKEAVGAMEKTGQGVNKEIETTNGFMGMGSTGTSRAKASGESYRHYTEGGGVERSSVSETLQQKATRSRSDSNATDDSAQAITKDPESAPVPQLNTVRKLEKMDDMYKKDTVKFWQFWKEPPGGYASPVPQGTEAQDYMTRKANEKKTFGQIVKSWIPFMGDTDIEPLEYPPAYNPDYTEEMDAEAEWAKYLKKKKRPTHHLPLFGVMALPGIPFITKKVDTIYYCREELARLNLEIEEDQKHPERYPLMNSAFIQFDHQVAAHMACQSVMHHIPRHMAPRINEVSPSDVIWDNMAFKWWQEWLRTGVVFLIVSAMIVLWAIPVSATAALSQLNEIIKDAPWLGFLRDNSTVETVAKALAGVLPALILALLLILVPIILDLLAGFKGAKTGAQKSEFVQLFYFAFLFVQVFLIVSIASFFAASVDDLIDSLAKLSNVQSVLDLLAENLPKAANYFFSYMILQAMSTSSGTLLQVGALFFWYIVARIMDSTARHKWARNTKLQDVNWGKFFPVYTNFACIGLIYSVVAPLIAIFAIITFSLLWIAHRYAMVYVIRFESDTGGVMYPRAINQTFTGLYFMELCLAGLFFIVVDESGTHTCTPHGIVMIVCCFLTAIYQVLLNYAFSPLFRYLPITFEDEAVLRDEAFQRAQNRRLGLEDDEEGNWPADQGTTVASPRSEKSRHGELPNGDIEMDAMKGRQGTNKFKRNPMRQVGTWAKGGGNQLKKLRPGGGASQAANYRRQRRQKDLEAQRAIGEALYGGFHDEIEDLTPEERDRMVRHAFTHSALRARRPVVWIPRDDVGISDDEIRRTKEFSEHIWITNEGTALDSKVRVVYGKNPPDFSEVDLINL

SEQ ID NO: 914 - protein, 4933 aa, Unknown
  Kingdom: Fungi, Phylum: Ascomycota
MAAIDVSRQRWSLLQDAATMQLLPSEINAVIRDETSTRLLDAVAEAALSPPLTEHIFVHFEAVFADVCARWIATAADERRRIRVASSLARVLPFAPYLAAFISQPTALSRHQHTSSHAQPLCLRLPDFNANPEDLSDTELSRLLLTAWRLVHFDPRTFCQSISPAPMQRLFRHSSRAVRYLAVRIYCQLLRASDLKLEELLKEHVGEGEAVSGDFDGQTIDYGFLSLHEQTRAKRTLLARELVRNHAPDPVPRIPPQSLSQYVIAYDDAVLPRPLGPTGDLSHLVMTSTTKQNLQELAKCLQTSDPVLLHGLPGVGKTSLIHEIARDLGMYSDMVTLHLNEQTDAKMLIGLYSTDSKPGSFQWRPGVLTTAVKEGRWVLVEDLDRAPTEVLSTLLPLIERKELLIPSRGEKIRAANSFRLFATVRTLKGMNGKENLPSLVGMRFWQTLHVEPITTDEVEQVIVEAYPFLRKFVTGVLAVFRRLVAMSNGQAMRSSGRPITMRDLLKWCRRLQDCLQTAGSRTGEEPISETTRDWMFLEALDCFAGSTPDVQTAHTIGQAIAEEMHLSKDRADHYMTANIPPLEEDETRLSIGRTRLRKNKFANRLRKSKRPFASTAHAKRLLEQIAVAIKLEEPVLLVGETGIGKTTVVQQLAESLGHKLIAVNLSQQSEVGDLLGGFKPVNARNLAVPLKEEFEDLFSATGISITKNQKYLDQIGKCFAKGLWSRVSKLWKEAPKMFLQIVAALERKQDDQAEARSTEDQPAKRRKTGSKLETLRDLRPRWDAFARNLEQFDIQIAGGSGNFAFSFVEGNLVKALRNGDWVLLDEINLASPDTLESIADLLTGPQERPSLLLSETGEIEKIVAHPNFRIFGAMNPATDVGKRDLPVGIRSRFTELYVRSPDTDLKDLLTIIKTYIGSNAKNDQAADDIARLYVNTKRMAEEKRLVDGANEVPHFSLRTLTRVLTYVNTIAPSYGLRRALYEGFSMGFLTLLSRESEAMLVPLIHHHLFDRHGSSQSLLSQAPKHPNDGKEYVKFRNKDRDRQYWLFQGDQEPVKRTDYIITPYVERNLLNLVRATSTRKFPILIQGPTSAGKTSMIEYLANFTGNKFVRINNHEHTDLQEYLGTYVSGTDGKLKFQEGLLVQAMRQGHWIVLDELNLAPTDVLEALNRLLDDNRELLIPETQEVVKPHENFILFATQNPPGLYGGRKALSRAFRNRFLELHFDDIPEDELEFILQQRSISTSPPDCRRIVTVYKELSRLRQTSRLFEQKDSFATLRDLFRWALRGADTREEIAAQGFMLLAERVRNEDERLAVKDVIEKVFKVKIDIQALYSIDALPELKKIANQANSQGVVWTHAMRRLYVLVARALRNKEPVLLVGETGCGKTTVCQLLAEALSKELHIVNAHQNTETGDLIGSQRPLRNRGAITEALEQDLRRVLKEAGLEAQGPLDHLLEQYKLLSPEAAQSITSEDKARIATNEMRSKALFEWSDGALVEAMKDGQFFLLDEISLADDSVLERLNSVLEPSRTLLLAEKGIDDSLVIAQPDFQFFATMNPGGDFGKKELSPALRNRFTEIWVPPLSDSEDIYQIVETKLEQRARSLTGIIIQFASWFGAKFRPNSATAFSVREILVWVQFINKFETENPLASLVHGASTVFIDSIGANPSALLAVEGKTVNQQRQLCLQKLSELAKEDLSSFYQNKPELDMSHEFLKIGAFSIPRLPSGIADPGFAFHAPTTRLNAMRVLRALQMKKPILLEGNPGVGKTTLVAALSQACGQPLTRINLSDQTDLMDLFGTDVPVEGAEAGNFAWRDAPFLQAMQKGEWVLLDEMNLASQSVLEGLNACLDHRGEVYISELDQVFKRHPNFRLFAAQNPHHQGGGRKGLPASFVNRFIVVYADTFTEDDLTLIASHNFPDLPAATITNLIRFVSQMDQELIVKKSFGSSGGPWEFNLRDVLRWLKLLTAPDPILRTGRTDDYLDIVIRQRFRTQRDRESVDRLYESIMSAAPQPHSLYHNITQQFGQVGLAVLQRGLNTQIEPFPKIDVVPRLSELESLMICVKQNIPCILSGPSGVGKSALLEHVAAIAGKALVVFPINADIDTMDLIGGFEQADPLRELNAALRDLYQFLQESILSLAPADAPTGALDLIHLLEDVATDAGSITPIREAVDSLLKQVPKDSEVGKALEEAKILLERPVVLSDPRFEWLDGVIVKALEKGQWLVLDNANMCNASVLDRLNSLLEPNGFLSINEHCGPGGEPRTVRPHPDFRIFLTTDPRYGELSRAMRNRSVEIFLDAMPPALEPSTKLVAGIESNLFRYSTLTTVADVLGSNTTTHEIALDHLSCSDLALLSRYQGEAKSLTKESAKEATMVDDFATFLQSSSGKASVSVVAQFYSQNANLPSTVSRALPLNPMNNPPVARLLQPSEQAKWLGICLDFGYELYAVRNELSTLQVQAQSSKITSLTRLQRSLVSDRVVAVSKDSTVGLAKFVSSIATAMDSLLQTPPTAPSESLNRALALRLVACYLNRTMEMTNSAAFDEAEFHAHLVLGSKIMRNHVSNESDVIGQHFATSIVRMLEQLFAHGFKLKTGLSMEQLWVTFRPILIGDQESMSRILQIIELGNRFDQLRWKTASGLPSLSKALSTLEQSFEIARSADTQVDELIANLRSAVESFETETANDAPIHKPYLVHQFDALRQLAVLRKMRRQETCEKLSDDEPTDRTVITLSNVPSKSSLLFAGMYGPASRLQLLDFLTVTGTRVWDGKLLASSWQKLRDLDSVTLGALALVEAELPVLGRQLANFSDSVTEDPLLRLNDVLYLLIVDTFASYDPNVRTACSSLQLTSSEDMRQLKDILLQTCHGLDAHDFCKVSQEHLLPALNAIELASRSEIDRTHYSALAWVHFSSGLVELFIPDKMFDPEIRPRMERDFHKDLLEGLESKMRVIGEFEKLFTGRNSNSRIQLLQDEATAIGPLPAEVLPVYRPQPSQLSRLQAEFSNILKIVMGPSIVSLLQQEPASDPDLDELQLVKGNLERLLDRLGARFEAYQDVTQPASNLLRCMLVGLSMFEAKTEVRKPLITPNYFGNVPFLGGISSSVEVADNKHHTFGKLEMMRTAASVEGLHKLTEAERQAIAECFHAFFEDWRKRLESDRKAEEAKTSLYRFRGSAEDEEDMDEQEFNELFPSYEDDNETKSSAHREEVRDMSRRVADIHAKIFGTEVADPGTAIRDLIEDTTERLTESAKDRGFICHDWNRRLLPGVMTLLQEKSDGLTSPVPNSQYNFYTDANLPEARQLVTLTNKIKQRFRELQLVDEIGHMQPLADVVLACDRLLELVHSEPLAKILTRVEQLHALVYEWQFGGWASKVYGAPVLYDSLTETIVRWRRVELSTWARLLNTEFSKCQDDARSWYFIAYEVVIAVPLSMLGSASDLREYAVSLAQNLQLYFSTSILGQFQARLGLLGQLQNHLELLARDHPSLNIIVNAVTNFSAFYRRYEKAVRDAIEKGRVPIEKKMKDVLLMASWKDTNINALRESARKSHQKLFRLVRKFRAVLGQEMKAIIEQGLPDLEQVPCAHPARHLEAVTMPSDAVQIVKKSLPGWLEDHKRIGNMPQTVNIMRRVGASALETSAVGHLLNDFVGTLQSSAAELRKETPSTLTEENKSLVKHLKTRKRKLFADTLRNLRQMGLQYNLAQDRLKEQGSSAQIFATVPPVVYSEDSFVLSANYYFEKVLDLLPKVRDTARDHSEDLTPAEVGRSIGFAEGILHLLLSQRKQLAVAVGGFARLQESVRSFAAIGSLLDDKDELELRQTKFDWHRHVAWLVNLLQYAINLVKIHENLGRSCDNIVELLQRHVDEIREQLKLLASYQSLPDSLTSNRRSKLEINLSKAMSDIRQALLECQKRRPNLEYIVDSILPWTHVEIQDFKYIAEDEISSVEGFGDALSTLCDKALVSVERMKRNYGREPVQETDSDWLAKSNERLFSTINGLRMSAVRSEVDSCLSMLHDVLRTGSIASNGVVAAARLVVPILDQYVDSCQSIIEQLSANHQATAHMGFKLTTLFLQMSSQGFCTPQEKSDEESAAEGKLESGTGLGDGDGAEDISKDIQDDEDLSELAQEAKKEEGDEIEDEKDAVDMADEELEGDMGSVAGDDDEEDEKKDGEEGEEDEEDIDEEAGDVDDLDPTAVDEKMWDGKDEDEAEKDQQGDKAKGQKKDDEQMATDEKPQKEDNGQQEPDNAETEDSQPEAEEPDEEQEEVKDASEMNRQEQTAEENDALALPEEMDLDLDEEASETEDDDMDQFSDVEDDKLDDAQKPGTDDEEDLPADELKQEQEQEQENNDQISEDGGEDDQVEGKDDGQPTDEIKEDDEPEQEEPKDEQNDQAPQPADQGATDLDNAAPSDVRGSGEDQNAESMELDQQFQSNAAKQEEGKTGDGAADQAATAGKEGKMSRSDDPMERGEPDTEESQPSTNDPFKKLGDALERWHRQRSDIQQADADQEAQSKDDPDQAQEQAHQEFQHLQNDDDAADTQAMGTAEEDEVQPIDESMGIDDDTQDPSSRLLDDKKAEDQTQDDAELMDRDEKEEAEEDAKVHKDADDGRSGVQTRQGNYQREHTPSQDETMVGERDDSDETVEEASTQLSTTHLTDERRPLREYEEAARQWSDFQSKTHALSLSLTSQLRLILTPSQTTKLSGSFRTGKRLNIKRIIPYIASSYKRDKIWMRRSIPTKRTYQILLCVDDSKSMGESSSGKLAMESLVMVSRSLTMLEAGQIGVLGFGGDVFPAHSLTEPFASDAGAKVLQNFTFSQDKTDVALLIRNTIDTFKEARQQTSGTGSDLWQLALILSDGLTPSSAHDSIRRLLREAIEERIMIVFIIMDDTEKKKGDSVLELKEAKFVNEGGESRVVIERYLDTFPFQYYLIVHNLEDLPGALAGLLRTWFAEVTA

SEQ ID NO: 915 - protein, 462 aa, Unknown
  Kingdom: Fungi, Phylum: Ascomycota
MAVKSRDPQVQDVLHRSPETKLEVTIVGAGLGGLGAAISILLAGHNVTVLESASEIGEVGAGIQVLPNAAKVLYSWGMKETLEALATKPRRCNFYGWKGNHLGEMNYHGYAAATGGYSFLDFHRATLHRCLLDRATELGVKLVTSAKVERYDAAEDGSVTTIYLEDGRVLQTELLVAADGIGSKLREQFLGRADPPQLTGDLAYRLLLPTAEMRKDPELRPLVEDPQVNYWVGPGKHAVNYVLKGGELFNMVLLVPDDIPLDQGNLLKGSVDEMKAHFEGWDPRIPKILNLSKDDSILKWRLNIRPGLDPSWSNDSGNFTMLGDAVHATLPYLASGAGMALEDGGVLGICLGRIKDKSTASKKQALKVYEACRRERTEKVVQRGTYNQWIYHLEDGREQEERDARFKDYDRFDQDWLSGKNPVLPRSPDTGDDPFPWRYNGVGRWLLTYDMFEDVEEKWACC

SEQ ID NO: 916 - protein, 188 aa, Unknown
  Kingdom: Fungi, Phylum: Ascomycota
MAASLILSPAPYHIISYGTLLGASAWHSFVNGPVMFKSVDRHNFSAIQNNLFPIYFGLQAALPVVLALTFPGSPLLGVPSGVSGLFDASSRWDSLLPLGIAFATGILNLGVLMPATMKIIKERRGQVKRDGKDWWAEGPQSDEMQVLNKRFGRLHGVSMLVNLGTIVATVAYGFTLGARLQSIIDRTP

SEQ ID NO: 917 - protein, 893 aa, Unknown
  Kingdom: Fungi, Phylum: Ascomycota
MKVSTLLATALATSTSLVSAEHARPKSSGRGVVPGAYILELESAEDTAQISSDVQNHGTVRMELNYKLFKGVSVVLNDVEKADETVMKIAEANPAVKNVWPLQTYSIPKPKVEWIGKPNIQSSDLKKRQDGSNGTVESFAPHVMTQIDKLHEKGVKGKGIKIAVIDTGIDYTHPALGNGCFGKGCIVVEGHDFVGDNYNGSNTPVPDNDPMDCGGHGTHVAGIVAARENQYGFIGAAPEASLAAYRVFGCSGSAGNDVLIAAYNRAFEDGADIITASIGGPSGWSEEPWAVAVSRIVEQGVPCPVSAGNDGATGQFFASTASNGKGIISVASIDSTVTPSLLTVSSFTVDGGKSADFGYTPAEPAAWADVKLPLWSVSKDLADPKAGCDPYPDNTPDLSDRIVLIRRGSCTFVQKAQNAAAKGARYIMFWNNVPVGSLATEISTVPGILAGGMVSADVGSGWLKALNAGSEVVLDMVDPEDPNVKVSLSEVPNNVTGGALSTFTSWGPTFEGDNKPQIGSPGGNILSTYPVAKGSYAVLSGTSMACPLVAGTLALLAEVRGTFNSKDLEDLLSANANPQLFNDGTAFYEFLAPVQQQGGGLIQAYDAAYASVILSPSSLAFNDTDHANKVLNFTLKNTGKEELTFDISNVPSPSWYTLAKDEPYPIAGIPEPADESASLEFSEAKVSVGAGEEVTIEVIPSPPKGLVSSRLPVWSGFIAVNGSDGTSLSLPYQGIAASLHEASVLLGDNYTWIAKSTDPNSAPVAANTTFTIPKPGDVIVPSKDVLPAFALDMALGSPFARVYVTPLTTCPPNRTVEYKGHKVLGEIQGSPFQYLPRSLNALPWNGILADGEAAPPGKYQFVIEALHIFGDSSDKDDKWDMAKSPSFRIKYKE

SEQ ID NO: 918 - protein, 463 aa, Unknown
  Kingdom: Fungi, Phylum: Ascomycota
MADEPKPQCGGGQVAGDYDVPLHVAGLFIVMLASILGAGFPVVVKKVPAVKVPQKVFFACKHFGTGVLVATAFVHLLPEAFGSLTDPCLPDVLIKDYPAMPGVIMMGAMFMLFTVELWLHGKTGGHSHGNPNGDITAAPRRSMIMGVNGMPAMTPPRPPRPDASLDYGENERATILDYEKAMAYQADMEKERYPYVTNPFDDPNNAVLPQSEMPAWFVVFYEQYVRQRLELMNMINRNNAKNEKEHRRMMESAREQARAVEAARAAGVENGKLQVPTINVSGPAAADFNFDLEEQQVDPEVLRKMSLNISLLEGGILFHSVFVGITVSLTVEGYLVLVIAIIFHQMFEGLGLGSRIAEVPYPKGSWRPWILVLAFGTTAPLGMGLGIGLNGTYDPDSAFGLILVGCFNAFSFGLLIWAALVDLLAEDFLSDEADRVMTSKSKRIAFCWVLLGAAGMAIIGAFA

SEQ ID NO: 919 - protein, 512 aa, Unknown
  Kingdom: Fungi, Phylum: Ascomycota
MATRSRYGCATCRKRKKKCDEGRPQCGQCVSRGVRCGGYDMRLTWGNGVASRGRLAGSTFAFPDMVRNGSTGTPSPPSAGSIGSAMNILEHDTPGAITTAHQDSPHSSIPSQPSPQARDRQSSTYRNEEERDVILKTFLNEGIHRLYATTACESIVEAFKDLMPTSEVLTLICVALQEVISTGPTVSALEKTARALEMFRHQVSLENFRSQEELFMTGAWICTLHLIQGLPWTSTFYQFLEFCQIGDDLSKLRPNPRYHLGVRQQMETISVLDFPNFVLGRVSPSRGLWKRFRKLQSSWDDRYDGGVEPVTGLPRTMLDLLAFNPLDINEITDQCEEQLWNWNGQTSASLWVCQLWDCYRYAGILAIRHQRSLSYRISQSGRGLNISLHPQLNVGTGTVPSTEIILFRLLSSLNAVLNERYCTGSHPSLQVQHLALYPLVYASLQVSALKATKHPWREDLIRMREQIVALEPGTQGHLLQLFDILDEAWNSGYDGFDADGAARHRELEITII

SEQ ID NO: 920 - protein, 236 aa, Unknown
  Kingdom: Fungi, Phylum: Ascomycota
MADPKIKAVFFDFMGTCLDWHTAVTSAFPDDVPKDEASEFALDWRRRYFVSNSERNNQGLPVENIDITLSRILDVKLNESPSIQSCFSETKKADLVKSWHAQPAWPEVREAIRCIREELGLEVFVHANGTTRLQLDLTKSSGLSFDMLLSSQLLGVYKPNPEAYRKALDLVQLEPGEVVLVAAHAYDLRGARACGMRTVYVRRWTDDIDEDMNEVKKEFDVFLEDMEKLPEAIQSL

SEQ ID NO: 921 - protein, 678 aa, Unknown
  Kingdom: Fungi, Phylum: Ascomycota
MASRLSCRNLARSLVTINKTRPVGASRRSFASRPPPPPTLQTIPTCPSPTCGCAETPPMPEGLDIDHAGKLNGVITGYAEHVLVCTGQDDWPSKIEEDQSGDNLAADLKELFGRGGRYCDPFHNISVLNSSFPSSVPPRPEVQTSSAYLLPSFKYVPYLPRVSFDSVEALAKGYLLPEKLHSAHDGLSPIHRDRLTRSEAYKSLLPGVRDVNDVLVLICGHGGRDMRCGVMGTPLRSEFEDKLRRLGYNVLKGPVQDSHEQTLRIEGGSVEAGQTARVGLISHIGGHKFAGNVIIYMPPKLRSEGKLHPLAGHGICGIALRSFLAIAALGGAFFYISSFSTSKDNLNDTTFTPYTITAREAISPTSFVITISPNTPQQNLPYLFPGSPAWRYPLWSVEFKQPEVQIARHYTPLPPREGDDPRDGTLRFYVRAVGDGEMSNYLSRLRQGQRVWLRGPHRGFDVLQRLGSRKQLTVLAGGTGVAPGMQAAEAVLSARKDTTVKILWAVRKREELEGAKPTARSSWWSSAKPTEMKTGLESPSPVGRQLEEMKRRFGERLQVYLAVDDETSTFSETFLADTLKTTSGEADSQMSGEAGCRLHSQNLHQTASEFEGQTPDCACSGRGKNLLLISGPDGFITHYTGPKVWLGGLQTQGSIGGITGKLQEQRPELQREWLVLKL

SEQ ID NO: 922 - protein, 658 aa, Unknown
  Kingdom: Fungi, Phylum: Ascomycota
MVPSMLARALLVGFSAVRALGLPAHAQYATFLERQSDASDQYDFVVVGAGTAGLTVADRLSEDGQYTVLVVEYGYLDTSHTIEALTVPDIASGPPDIYPRETRMYNISSVPQNGLDGTPKPLAAGAVVGGSSAVNGMVFMRGSAEDYDAWVWAAGEDHRQEFAAEWGWDNLLPYFRKSVTFEPPTAKMVDEYNMTYDVEAAYGGTTPVWSSYRPFNWPATIAMWNAFKQIPGYRFPKEAASGNASGVCWTPNSINPNTERRSFARTGHYEGEPATRDNFHILPAHRVTQLLLSPSSDSDDWVAEGVRLGPREERNDMSKKLREVRARKEVIVAAGAVHTPQVLQRSGIGPRGVLEAAGAEVKVELPGVGENLQDHPNLGISYQFSKQYSPNSGMLQTDPEFAAEALELWETNKTGPYTAYLNSVAFLPLNLISDRAEEIVQSILDQDPGEYLHADADPTVISGYVKQKETLAKQFQSDDSTLLEVPFSGNPFFSTVLLKSLSRGTLHISPDDDGVDPSGRGNMEPVLDFRTFSNPVDLDLVVEMVKGVRGFMSSAPMMEAFGATETSPGGNVTDQDELKAFISRMMSPSTAHPVGTAALAPRELGGVVAPDLTVYGTSKLSIADNSIIPLIPSTHTSSTAYAIGEKAADMILRRARGS

SEQ ID NO: 923 - protein, 233 aa, Unknown
  Kingdom: Fungi, Phylum: Ascomycota
MEAVKAWFGPPDPQVQARKCNALLRQNMRKLDRDIASVKQVELKTKNLIQQADKRAQRDPSRRNQANKEVRGFALELVRARKASARLVTSKAQLASVQMQVNEAFAVRRIEGSIRASVGIMKEVNSLIRLPELTSTMREVSVELMKAGIIEEMVDDVLPEDGDMDLEGEEAEGEVDKVLGEILKRPEEKETQPKLPAAPMPDPKKNEPEEEEEEEDAEEMMDQMRNRLEALRS

SEQ ID NO: 924 - protein, 840 aa, Unknown
  Kingdom: Fungi, Phylum: Ascomycota
MAPQGRRMGAFLDRRAIGAVKVKRWDGVSRSCGEWDCLRRDPELWFRDGNCLVHLYGKGQSKRGPSFKVPFSALIDAQCFPLIARFLSTDGHRPRTPQEMKRLERTDPSQTIDLYVAPGALENKEQTLQYHLATRNLFAWVFGLPLVGVHLGQALIGLLNSMHEFRSGLGDNVSDLMEYFERAGYLRLTGSPDHALALAYFAEHFQMRDLYVRAMTHCVGMNERLHFSSEYLYIDQSMKKLLRLLRKDMDDRMFRASDTLRNFLDDELSDTYVGLPSGPRAHLERFRSFLMGYYTKQLGYYPPRLFDSNLLRMMREDFEALYELLVDHGYDTSQPMPTIAVGGICTLQLVQDFDRAQDHKPIEHPLPLLPHVQEMPSVKRMNWLPRGGRTKPDQRLLEHTALIKATNWKREFFTNELVCAYRKFEEDTILAPKKTDKQERVSLIDARKVRWLVVYAVYQVLKNVTEEPAEVQDDMDAAYHLSISTGLLPVWEHKHELGFLIRSQTDMVRTSSLVGTRDTRPQMVELPEPKIEIKPDIDYFALTHKDEPGPSKGGLVLMTGSAPLTRSNSLSKALSLTKRRSMMFFKSTTGVPPVPSHPYLRPVHQEIVVPGYGNGMNEVQLDVKEPVPSGSWASRSDSTASKTPSNVESIFDRTDGTDEYESEIETPSSSVKSSSPDVTFGQTDHDWDAMPAPLNVRSKRRDVVSMIIPSIPPRRGTVPRPLSAVLDLDAAGDGELSTDSSAVDLSSPSLPHSSSFLQRKATKRLSELRRRSFVPTTGSKRTSESNEDNAITFVTDEKAEWASMQSWLDGDHDRLEVSGRNGNGDSWGQYAELGGLTETK

SEQ ID NO: 925 - protein, 1031 aa, Unknown
  Kingdom: Fungi, Phylum: Ascomycota
MYSPTTKPDYENLEVIQRNRLPARAYWLPPTSLLLNGTWDFQYAPSPLEASEYPSPNDVDDAEPWSEITVPGHWQLQGHGHPHYTNVQYPFPVCPPHIPTENPTGTYRRSFKIPAEWDSSSQLRLRFDGVDSAYHVWLNDSFVGYSQGSRNAAEFDITAVARKDQENTLVVRVYQWCEASYIEDQDQWWLSGIFRDVHLLAFPGMARIEDLFIKTELDHQYRDAILQVDVTMSSSASKPYQLNLILLDGRKETAKAQQKAETGDSLITFRLPVSDPKKWTAESPNLYQLQLFLVTPDGETIQTITQNVGFRKVERKNGLITVNGSPILLRGANRHDHHPKHGRAVPPEFLKEDLLLMKKHNINALRTSHYPGQPLLYDLADELGLWVMDEADLECHGFYDVVTHGIDPPPYEDYEGSKEEFFPLAARFTSDDPAWRASYLDRMVQMVQRDKNHPCIFSWSLGNESFYGANHVAMVDYARSIDERLIHYEGDIKAETADMYSYMYPDMERLTREVEVDGVQNGKWEKPVILCEYAHAMGNGPGALQDYQDMFRKYERLQGGFIWEWANHGLLHKDGYYAYGGDFGEDPHDHTFVMDGLCNSEHKPTPGLVELKHVFQPVRFEAQGDRIMITNEYDFIGLEHLEGRYTLEVIGETSVTLESGDLQIPSVAPWEAVELPIPTDLSRFKENKDEVFLNISLRLRKSTNWASASHEVAWFQHKISWDTKPHADVATLKEASEGVTVQNGRAAVKISGNGWSITFDRVRGYITKWTGAKDLLEVDPKTRAAIYPCIWRAPTDNDKDGAVRVWKDYGLHRMTSQLRSFEVSQSGDAGAVTVTTQTYFAPPVLGWGYDIRTDYLISSSGSIAIKMDMKPKGTCPADVPCVGLNLRLPKRLDQASWFGRGPGESYPDKCTSQRLGIWSSTVDGLEVPYDVPQGNGNRMDTRWVRLENAEGAGIRATRRDASTFNWTGTRLSTETIENAKHPCDLVREEATLLNISPLVAGVGSATCGPGVREDLLVKVEPVAFEFLLERI

SEQ ID NO: 926 - protein, 1057 aa, Unknown
  Kingdom: Fungi, Phylum: Ascomycota
MASTDPRFDDSEDEEDFNPAPADLSDAEPEDDAEDADERPRKISRRDSPERDGSDVGRSSSPAPIKRRDDDEQEEDEDDDEPSAGRRAMDDDNEDDEEDEEEDDEDEDDVQQPRRKRRRERGNAFIDIEAEVSEDDEGEDDENDDEEIGNFIDPSHPDDDGEAGRPDDDRRHRELDRQRELEANMDAEKLAENLRQRYGNRRTAKGFGDSAVVPKRLLLPSVDDPSIWAVRCKEGKEREVIFSIQKRIEERLGTKDELAITSAFERGGPNSVMKGFIYVEAQRQTDILVALDNMLNVYPRTKMQLIDIKDMPELLRISKTPTLEPGAWVRLRRPAKYNGDLAQVMDVTENGLEAKVRFIPRLDYGMRDDAPSITSDGKRKRPFGAAGGPRPPQRLFSEVEARKRHPRYVQGNPSTNTWTYMGDEFENGFQVKDVKIQQLTVTDVNPTLEEVTRFASGAEDGTENLDLKALSASLKSTNSLVTYLPGDMIEVYSGEQKGVIGKATNVQGDIVTISVTEGDLAGQTIEVPTKGLRKRFSIGDHVKVIGTSKFEGEVGTVVDISEDRVTLLTDNTHAQLTVFSKDLREASDTGGSSALGQYELQDLVQLDPTTVGCIVKVDRESLVVLDQYGDTRQVLPSQIPNKLPKRKQAVAADRNGSEIRLDDVVKEFSGQQRQGKIIHIHRSYIFLHTYENTANAGVFVTKASLVNTIAAKGGRVSGAGGPDLNEMNPALKRHQNGAENSKPPPKQTFGRDKAIDQSVIIKKGAYKGLLGIVKDTTETHARVELHTKSKIVTVPKESLAYKDKVTGATIDLNSRGRGPPGGFNRGGSDRPGWSASGARTPMGSGSGDRVPAWGSRTPMASARTPAWNKGPDHGGRTPAWASNDGSRTVNPYDGSRTAYGSGSRTPAWQAGGRTPAPGDAFGAGSRTPAYAGGGDSWGGSGSKTPAWGAPTPGASGGGGDWGYTPGASGLDAPTPGGNLGAPTPGALNAPTPGGAFSAPTPGAMNAPTPGGWGAPDSAPTPAVGAPTPGYYSAPTPGAFGGAAETPAASGPRYTDDD

SEQ ID NO: 927 - protein, 619 aa, Unknown
  Kingdom: Fungi, Phylum: Ascomycota
MFYSADLLQKSGPLARVWMSANLERKLSKNHILQSSVADSVEAIITPNQAPMALRLSSQLLLGVVRIYQRKTRYLLDDCNEAMMKIKMAFRSSGNNDMAASMQVTNREALVLPDKITPYDNLDLPPPPDPSWLLSQVDEVSATPVGRKGRASNRDINLQEEMDFDNSQYLHGNPLDDDAIRPLDDLDLGLDFGLDFDDDPSIEMGRDAPVARGVDEDMLSEIDMVSRTKDGAERDQSTNLDFDDGVRIADNEGDVMMVDDDDFQFNADDQSAMPTMGGRPDSRARISESPLSDIDDEFAKAVEHEFTRNHTDLYEPEEETEQTLVRRPAQRAKKQKVMAPDEEISLSSTHIKQQQADRSNILREPSFLPRNPYLLSLLEMQKSGGFVTNIIMDGRSSVWAPELQGMLGMDFRSSGDHKRKRDSGVADVESDSGAKSPRLELGDDTELGIDGQLAGNQSVARDSTIIGLTDDDGLVLHEDEGMDTLPAFDDTTAPLVHPSDSGPVSLGTKHAVHILRDIFGSEAATNAEKRKKAVVFQDLVPEQRTTKAEATKMFFECLVLATKDAIKVEQGPGLGDPIKVRGKRGLWGSWAEREAGGEIQDQDEPEHVITQAPAVAVGA

SEQ ID NO: 928 - protein, 316 aa, Unknown
  Kingdom: Fungi, Phylum: Ascomycota
MAPGKGSAEAQAFENYYLKRKDKELPDDPRHRALVEACARDGYVVIPNAFTVTQALEAKAEIDRLHGESPLIGRSEFEGYKTNRMWALLGKSRKFDAFCLIPEVHALNEYFLSDEYLIYIMSSIVIQPGEKAQFLHHDDAGTRMPRPRPPMSVGTMICLDDYTERNGSTRIVSGSHRWGDGVYPRDEQATPALAKRGSVVYFLGTTWHSGGANESQAPRYAITIQYCQPWLRPFEDLKTAIDPRRILAGEIDQRIVDMMGYRTAQPYWGVVDGMNPIKGARRLVRWLQNPVETRQSGYAHEEGKTDEWFKKSYSKL

SEQ ID NO: 929 - protein, 863 aa, Unknown
  Kingdom: Fungi, Phylum: Ascomycota
MEPSSKKRKLAPKITSQDPASPSAINSSLHATTASYPAEPQYPVQDAAAAAAAAALASNSERHDFESFARHLQDAAMLIQRQAERQAEILASTKVSVLLLRWADDPTASADIDALEHTFQNCYRFHTQRWLIPSDSNPLLKLLQHVACFLENAPRNHLIIIYYAGYGFVTSDDQLYWASNARNDAAKVKWDGVRCLLEDTMQDVLLLLDTCALPDIIPSGRHGVKQGIAACTPERMNRQEGPSFTSCLNGALKKLGRGRPFSVQRLLEEIQGQKNQHSSSESPTAANGNPSQSLSTTQPVFFTLARGNGQYLTLSPPSGQAHMPHSPGDANGDANVSIVCEDKAPESEDVHGLRFDEARVLVCTTFVGEASADMGFYNKWLQSPPASASNIIVEGMFLGPPTMLLISMPHSVWTVVQHDQVCCYLGFINSHNMLHLYQRLVSTGDAQPWAKKVEAGTMLLDTREVAGNAPARVKVDVDGHSPTLSRNSLSSKDHRGFHAINSSPGSSFNTVKPKDEVQDSAEMQEAAEQLKALSHVRTRSDEGIPAPHVSGDRQRTTLPDSIPDVRRQEHSRPLPDSADPALNDAEIQTSPGPRLKAPRRALPKQESRCNHCTHAPFKDSTALRKHILAAHTRPFPCAFSFAGCNSTFGSKNEWKRHIASQHLCLTYYRCSSCSKTTVDGKGNEFNRKDLFTQHLRRMHAPHDIRRALQKGEAKSEEEWDARVRELQQSCLVVRRKPPQRSACPKEGCSMTFEGHSAWDDWTEHVGRHMEKGEAQRLGVDKLLTKWALDEGVIEAWGDGEYRLTAGSSVGGGPYANSWPSERHAHARRRSSATAYSADKSSVEGAKTEKVTTSTIPMDVDNDV

SEQ ID NO: 930 - protein, 274 aa, Unknown
  Kingdom: Fungi, Phylum: Ascomycota
MSTPVAIVTGACSGIGLALSKYLVQTRKWRVVMADIQEDGSTTELGSENVLFVKTDVSSWDQQHALFKRADVWAGSGGIVFLAANAGLSDPPASLDGLLGKSKEDELTPPTLDPIQVNLLGAIYSLQLFAHYVRSRGGAGKAVLTSSGAGIYPMPSHPVYAASKHAIVGYTRSIAPSLLSDCITVNTILPGFTPSNMTAPLLGVIPQKYVTSLDTMMAAYDVFLNDDSQMTGRVLEVSASKTSHFRDHPPYPDEEIRWLNEESAGFFAKAFGLA

SEQ ID NO: 931 - protein, 666 aa, Unknown
  Kingdom: Fungi, Phylum: Ascomycota
MSAAKLAREGFKLLVRDDDIADPEEGDAGEKELFAAWALFILIMLLIVAFFTSYILQQKKITAVHETVISIFAGMIVGLILLITSGDSISNIVRFDYQIFFNLLLPPIILSSGYELHQANFFRNIGTILTFAFAGTFLSAVVIGLILWLFALIPGSLKMTFVDAISVGATLSATDPVTIIAIFNTYKVDPKLYTIIFGESILNDAIAIVIFETAQKYKKTDATSYGLISFIEATGIFLLIFFGSLMIGVIVGVATALLLKFTYVRRFPKIESCLIVLIAYATYFFSHGVHMSGIVSLLFCGITLKHYAYFNMSRRTQLTTKYLFQVMSQLSENFIFIYLGLALFTDAQQFQPPLIIITIIAVVAARWVAVFPLSKALNWFFRYRARRRGVETTADELPYNYQAMLFWAGLRGAVGVALAALLTGENSYALRATVLVVVVLTVIIFGGTTARMLEILGIRTGVVEEIDSDDEFDIESLNTGLQVKRSGAGIGYNPRRNGTVPLNTLDTASGGPRSASYVSGHRSPNTAAAPRGTSLSRKNSLRNPDDFERADLLGRRGDEDSDIGSDIDTSDLPPPARRSPMPRGSPAAHAGSGANSPFTAPAGESSATAGSLGSTMTATGAIRQLWQTEDPAGLFRQLDEDFIKPKLLLHGDGTGRGGGTGGGEGH

SEQ ID NO: 932 - protein, 652 aa, Unknown
  Kingdom: Fungi, Phylum: Ascomycota
MARGLQSIGRGYKLAAAAAATTVLGGGFYLSYSRKPHLKQPLVDLRRDDAGRIVTPTFPAIRSRAEQLAELRRHNGSSPDEEYDLLVIGGGATGTGIALDAATRGLKVALVERDDFSSGTSSKSTKLVHGGVRYLEKAVMSLDYPQLQLVMEALRERRTFLDIAPHLSTSLPIILPLQNWIQAPYMFAGIKAYDILAGSRGLESSYVMSKDEALTKLPTLRKEHLVGALVYYDGQHNDSRMNVSLALTASLYGATMLNHVEVTNLEKDANGKIRGAVVRDLAAGLSGDEAGAKEFSVRAKGVINATGPFTDAIEKMDDGNRKDLVVPASGTHVMLSGDLCPAGMGMLDASTSDGRVVFVLPWQGYTLAGTTDNGCPVETDPIPPQEDVDFILKEVSKLMAPVSRSDVLASWTGIRPLIKDPKAKNTESLVRSHLVTVSPAGLLTCAGGKWTTYRQMAEDAVDEAIETFHLTPKAGITFPDISGYGQPGITSTGKCITRDVPLIGAHGFSPELAGHLMEVHKIDRDIASHLASNYGDRAWAVLRAAKTPAARLLPKLPFIEAEVRHAVHYEAAVTATDVISRRMRLSFLDVNESLKALKQVIAIMAEELKWSEKRRRQEYNDSVHFLRSMGLSESAASESLGLPAGGLLKSTE

SEQ ID NO: 933 - protein, 264 aa, Unknown
  Kingdom: Fungi, Phylum: Ascomycota
MILSNLLSVAATSLLFPCSAFADKNYDEECSLTTCWASFNLECEEGPWYCSFNDSNSYPEFDRGDQHDPRLVITDDDIEIEWRDQDKSHPIRVSWHWWAENDTDSTDELVDITGEDSTAIINFWKIIQEEFPNNHTNLTSWEVLGWLQNNDTDMVLAIYQPESPKYKQIQDEWNAEPEEHHLLDYSNSFKLSQYNGKWDSVRRYMNAQYSRGRKSVLGKWRMGVGIGVGVGVPLITLIALLDGYMFGKRAGTSKLRPISDNPSS

SEQ ID NO: 934 - protein, 380 aa, Unknown
  Kingdom: Fungi, Phylum: Ascomycota
MLVHALAGLILPSLALAQTSTKCDPTKQDCPSDKGLNQASYNVDFTKGADSNFIMTYGDANYDSNGLSFTIDKPKQAPTMQSDFYFFFGSISAVAKAAKGTGIVSCVILESDDLDELDWEWLGGDAGQVQTDYFGKGNTTAYNRGTTVNVDDVQNTWHNYTIEWTSSQTTWYIDGAPVRTLNFADALGGSNYPQTPMRVKLGIWSASDTGAPGTIEWAGGNTDYSQAPFTMQVKSLSINNYNPAGSYIYSDKTGSWQSIKMSKDVPKDTSSASASASDVSAIQPTTVYAINPVTSSSSEPKSAHKTTDASSKSEPTTSAAASQASKAVSTGLQTIQTPDASSTKPAESSKPSGASMGSAMFKIDGQLLSAIFLAAIYQLF

SEQ ID NO: 935 - protein, 1591 aa, Unknown
  Kingdom: Fungi, Phylum: Ascomycota
MAGNMQQHMAGAGQMMGQQVRNKNTQSSHLTNWVLQNIMANSQAFDPNTWQYQINPAERTGKTMNLITNFWLATGGPQVNAANWGCQFERDQFHNSATKEIYDNGMSNKSMEFFQKRRANTPGMQAGLNANAQHMVMQANQMGMGRGQGPQQAFQQFPQNMQQQQLMQQAQQQQGQQMHNPGMQAQMSQQALQQAQQQQALKQQQQQQAQQLGMGMGMGMGMNMNMANAAGRGLTPAQMQQHQAQQRMAMSAAQGLQQQPQTPTDFSKLTASDKARVMQLAQKLMESASEQAKAATRDQLQKNLTPAQLNEYQAQGKDPLMFVYQNQAFNMIRNNANNLNRQQVGMGQNMNMPQAAMMQQQQSQQSMQQRQNMMNAAQQAGVNNVNDFSQFNPNMDSIKDQQMTGLMAQQAGQMVVPQSTGAGAAQMNQGRPTQQGQNPMARQQQQAQAQRQAQQQQQQQQMQHAKLNQAAQQSQAQLQAQQQARQMQGQQGPMSQGIQPSQSPAMNTLNTPAIGSGPPNNANSIAAQGMAQGNVQFGNERFNQGVQRPNAQAWGEMLREMSSEEQRQVQGLPADKAKEIMMKWQNSRHPNQMAKPAEAGPGQMQNRQLNQFTPTMGGQIPPGMQQQQQQQQNTANVPQMSPQILHMMDSMDVPAPILQRFSAQLGPDKRKWGDLKRFFETTPIEPPLRQRLHQAQVQQFQALWRQRGQQMQGQQAQAGQQQQQQAQQSVSMGMAANMQTTAGQMPNPQQQQFQAQQQQQQIQQAQQQGMQQQQQQQQPGMPGPMAIPPGVTQVTPKEIAAYRAKPDTSNMTDEQIRLAIQQFKRTVFYQRAAAMAQKQSQGQPQGGMQNPMAMPQNPQQLQQLQQQQFQQQQQLRQQQIQTQFQMQQQQAMNKSNAQQQAQQAAGQMPQAMQAQAGGQNKQNIAVGNRQQNANNRPQPPKPSPAQANKGLKRPSVDQTAEMGDQSQAGANGPVAQAQMMASQTGAQGPAGQQQQRRGPGMLTPAQLVNLTAEQRARYEEHIKKFQANNAKSSAGVMDELKRLNEEARAEISQQQRPTVSLTPEEFNEIVPKLRAVLVSTSRFAKALSRWYSVSKDEAKAKTFFKARLHLSQQFLDGDLATTPKDALTISNEEADKYRMLIEGMAREVSVAYGQMKVAGQQQQQGGQQALNAQMTQQQLQQQQQQLQLRAQAQQAAQAQQAQQAAQAQTTPNLNAASLEKTNAPASEKKVPKQAGKAGKGSQPPAAPTTAQPPFSFGASSPHGNPNYIGRAKDMNLQLPPSRKKQKTQTGQTPGSSTASPQVGKGQSPEMRRAQEPAAPPRPVFRCTEPDCDAPIGYATEQALQQHVQDEHVRPREDPTKFVQEELALALGLEPDGSPKKSAKESEGAPAMASSVSKQGLTPTNLAATPRSQDMSMKRSASGMGKPLDKKGGATPKAGDGKTNGEGAVTDPWASSTIDPQSLSNLANGLGANMGLSSVFIDLALNRKDSTSPKDTPDSLKDSGSSEPNSDIPETATLDIGIDWTNFDTGLLLNMDDATFEANGGLIEHNGQSVDILDLYENKTKVIDWSDAQDALDKPFKFDTSKYHFNIG

SEQ ID NO: 936 - protein, 119 aa, Unknown
  Kingdom: Fungi, Phylum: Ascomycota
MAAVQRVRKTLDRAHLSHQNNAAGQKHASLASRIEGLKKSGEDGDRDGKEVEVHVTGTGKALEKVLRVAAWFEEQGDCSVEVRTGTVGTVDDVVDGDGEEEEDSRVRRLSCLEVVVKLK

SEQ ID NO: 937 - protein, 561 aa, Unknown
  Kingdom: Fungi, Phylum: Ascomycota
MSSTQEAEEYYNLGSFHRPISTTSRDTQTWFDRGLVWSYGFNHEESARCFQKAILHDQDCAIAYWGLAYVLGPNYNKPWSLFSKKERADTINETHDTIQKAKKIADSSDTSPVERALIDALIFRYPRDQDPSKTNCSTWNREYADAMGKVYEEFPDDPDVATLYADAMMNLTPWQLWELDTGKPASAARTVEIKRVLDRALASEGGLQHPGALHLYIHLMEMSGTPEEAMPAADHLRALAPDSGHLCHMPSHLDVLVGDYSRAVEANTAAVTADEKFLAREGPMNFYTLYRCHDYHFRLYAAMLSGQSQIAFETVAQLEATISEDVLRVEEPPMADWLESFLAMRVHAYVRFGRWSDLIELPLPHDQELYCVTTALILYAKGVALAAKGRVEEAEQQRALFLQAVPRVKPTRTLFNNQCVDILGVAEAMLDGELEYRRGNFETAFAHLRESISRYDSLPYDEPWGWMQPTRHAYGALLLEQGHAEEALGVYAADLGLDKTLPRTHRHPRNVWALHGYHECLVRLGRTDEANEIKPALEEAEKAADVRITSSCFCRKTVLKL

SEQ ID NO: 938 - protein, 457 aa, Unknown
  Kingdom: Fungi, Phylum: Ascomycota
MDEKITPDITRLPTPDEAVKGEIIDDDDGEVFKMTKGQTQFRTLGVFKTVVVLVKLCFATGVLSIPAALAVVGYGPGLVLLALWSAMTMYYAYVMFQFRMEYRGVHNIVDAAMLMGGPIAREVVTVLFLLTWILATGSGFIGLSQGLRILANGKGCMIMWTVVAAIATGILSSIRTLGKLAILTWVGFASIFTAVFIVVVGVTVVERPAAAPPTGPYELGVVSVGNPGFVAGLVAALNLFSGFGSTSTFMPVIAEMRDPKSFPKSLFISQGFLVACYMSFGMVVYMYCGVYIASPSLASAGGTLEKVAYGVSIPGFIMTSTLWVHVASKFLFVRILRNSEHLQKNSVKHWTTWLSSTIGITILSFLIAEAVPFFNYILGFIGSICCSPTCLVIPAWMGLYLRKGDYFSSKKVMALCAFHCVTIVGGTFMAIAGTYTTVQSIVDAYASGTVSKAFTCG

SEQ ID NO: 939 - protein, 847 aa, Unknown
  Kingdom: Fungi, Phylum: Ascomycota
MNKSSTATDGTPASQSATSTPTPNQGPAPESSSAALLKRNASAVQVDGTSSKHSSATNSVTPSPFGSRESSPVRNPRRTASNTKLSASSSRRSSHQDLSPSRQMRSSIPGPTSSSRTLTAASTPTLLPAQDTSSDITTPSKSSVNTDSPRWPVSPRLRSPPPQLNRPSVSGGHRQEPEAPSITVQRPSPSPIPTDHLPEASESEAEDSQTNSGQRTPARAGLETVQEVSLPNSPSPRADAGFMEQVKEKLSNPENKSDSALHDAHGLKTRPSWPSQEKESGSESGNSRTDKRRPTSVPPPLVTRQSSALSAKGGKTKTEGLTQTMTVETETVPSIPQIALSTNTKGENSNGTLKTKTSNETIKPRKEKRKTSRKQPAAVAGTASSKADIFEAKIASAVDEANTSDSEETFVYDSNPPDAGDRSTRRFHSRTPSATSMVSQADRQNFRSIHGVMDGSVGLSNGPKKNMKFVNTSAANGNDSITTGDEDGTGTGRSNGTGSARGTTRRLHHIGRWGREPPKHPSLFDNESPFPNAARSKLSGVASRNSSGPPSPRNHQSARGLSAKRSMQMSGSYDLDETGADDERTPLVGTLRSHRSGRRRGPHNLRQAESQTFGRRSSYLNRFAACLVLTMMLLLVITGAIGFMFATSQPMTNIEIVSISNVVTSEQVLMFDLSVKAHNPNIVVVTIDQANLEIFAKSEHAGTDSDWWDNPHGPDELHPWDDPLDDPPSGNPDDGDDDSKPNVLLGKISEFDSPLTFEGSLFHKGTSQSTGEMQLQYPGNGTSGGSARWERIYQNDFDLIVKGVVKYSLPLSAHVRSATVSGRTHVKPNSASDPSLKPNNTLTDDNH

SEQ ID NO: 940 - protein, 544 aa, Unknown
  Kingdom: Fungi, Phylum: Ascomycota
MEKRHEDLRQGYDGTDTKLADVEKAVPAKDGATPQDTLEEESGNKSAFKSLGILDRFLAVWILLAMIIGVLLGNFVPQTGPALDKGKFVGVSVPIAVGLLVMMYPILCKVRYESLIEILKHPGLWKQITFSIIVNWIVAPFLMLALAWAFLPDKTDLRTGLILVGLGRCIAMVLIWNGLAGGDAEYCAMLVAVNSILQIILFAPLAIFFIRVISHESTGDDISYSVVATSVAVFLGIPLAAAIITRFGLRAVAGAAWFDRVFLKWASPWSLIGLLYTIIVLFASKGHAVVHQIVSVVRVAAPLLVYFIVIFFVTLAITKKLGFGYELATTQSFTAASNNFELAIAVAVATYGQDSDQALAATVGPLIEVPVLLGLPNLSASFALSSTSRTTPTYISPQNKPHLPPTDPLQTSVTMATRVAARRLFSTTARRFQQQEQQELKRETKRNPELMILGGVMVLALGGAGLYFGRSPTSSTSESPVHIAKGGMPWDSDTLGKYKYHPGGDPSQAPRDAPSALNSVVIPNVTVPKEIHDQVNKWGKEGYP

SEQ ID NO: 941 - protein, 527 aa, Unknown
  Kingdom: Fungi, Phylum: Ascomycota
MDASHLSKAHDHARAAAVATRQSPSDPTSAITEHTHAAGEFANAARSTSSVEALRTLRLLEQHHRRLAEILQLPPERTAAASVASHGSDGTEINEKGGSEKSGETVPGLRREGSSDVATARTGSKPTLSQQRREMSSSIASNLASARGIKSKYRGTPLTPSISSDQAPGSLDPHSRRDGSRTKMQNIIEHQSGKPTWVPPMAAPNTKPVAPVKAVSSPRGEASTAVTDDAGYGRFYNTFGSIINKISAPLAFAGLPLIQEESTTPEQQETAAPAMPKSPRRSKFSGSSASAADPDLSKIYSKATMRALARDGHTSLPSDSFYVVPTSGHTMSYASILTYAEKEKRRLGASTHSGGPSDPGGDDGEDDFVDARESPVPLSPGAKRRIGKAKSERDLNNTIEELYTENKSLKDLLDKLTQRLHAFEASSQTSAMALAESYRVMRPGSPLTSGSGGGGGVGPSGSSSSKEAEEQLAAMMKQMEKLEKDNRKMQKTLEKYREKWELLKKGAKARREAQGPADSLEDAAAVE

SEQ ID NO: 942 - protein, 320 aa, Unknown
  Kingdom: Fungi, Phylum: Ascomycota
  misc_feature (218)..(223): Xaa can be any naturally occurring amino acid
MVTEAQALEIYKSSIHFDGLNICNWSPEIFQAWHDGGITGVSCTCGLWEGLRGSLANVVQWKEWFEQHSDLIVQAHSVRDIRQAKDTGRTAVLLSWQNTAGIEDQLAYLRVFRDLGVRKMQLTYNTQNYSGAGYTELNDSGLTGFGREVVAEMARLGIVCDLSHVGPRTSEDVINFAPDGKPPCFSHVLPGGLKAHPRNKDDRLIKLLGDKGGFVGLXXXXXXALDYVIGLVGEHQVGIGSDASEGHGRPSDFMAWCNKDKGYARQLTPWGSQKVVKPLGKLADRAQLAAAMARKGWGEDKIRNVLGENWLKYLEKIFGE

SEQ ID NO: 943 - protein, 202 aa, Unknown
  Kingdom: Fungi, Phylum: Ascomycota
MSLTYGLGGLGSFFLVVGAYMLFTGSGESFNVGAALESISPYAWASTGIALCIGLSVVGAAWGIFITGSSILGGGVKAPRIRTKNLISIIFCEVVAIYGVIMAIIFSAKVSAVSGAEMFSADAYYTGFALFWAGITVGGCNLVCGITVGINGSGAALADAADPSLFVKILVIEIFSSVLGLFGLIIGLLVSSKAHEFGQKSN

SEQ ID NO: 944 - protein, 655 aa, Unknown
  Kingdom: Fungi, Phylum: Ascomycota
MFRFWSSDFRGSERSDQLTEAQHSLSGLTQPHHLDLQQQQPTHSTFSVDSSAITSSLELQPLKRRRPSFDDSDDNLSPDEPAKRARTCDSACEVDSPSASPRMDLQSHSLHSALDRARDEINHQFGLEILLKHDELRLINQELAKCQVALEQLRRCHLIPYPTACPTPQQMLDISAGKGPALRSQPGDEVPRWAAPFGVADGPYARHYAKWLIPDPAFDGIEPEWQFTPEATRSRGSFAEGRTTRNSFTEPGPSAKGRPSRANAGAKLQALSNGYPQPKERAGPCILKRSDGKTVKLVCIDCHRDNFSSTQGFINHCRIAHKRDFKSHDEAAMQSGQPLDQEPAAATAAATAAATNSGVPDKAPVPNTHASVTPAAIPAAVHPFARSDISDQQACVALRSRIAASLELYNRGELPGVTAVPTSQHAPGNSADCSNEPDVPHLSRLLQRRKFNGSLGQLVRDAKTKISFDDITPGEDSDDADMSNCDKEPSRTPVVMRIPTSATKSSAPSASCKRPTSSKSRSHMTFVPPPQLPPNALKNSPKATLSDDDIDMEDANLSPNTLVSNNAPSLVSDDGEYDDSDDASSVSGDSDVLDDESETDVAEITLDDDHHDPRNLGRGSGTVRLRKDDAKHVTFMSPVQNATQPPTQGRRKHKA

SEQ ID NO: 945 - protein, 333 aa, Unknown
  Kingdom: Fungi, Phylum: Ascomycota
MTRRGTIAVEEAIITPSTTWLLEETQSILTPGDHSGKALQAHTEKLLDIHGKRLASMDAEGVEYMLLSLTAPGCQGITDPELAKKTARESNDWLAGQVSKRPDRFGGLAALSMHNAEDAAQELERAVKQLGFFGGLVNDYQSTEDGKRYFDCEAYDVFWNKVQDLDVPIYLHPRYLPKRDIQPGSLYGDRPHLMGAAVQFHLDLSLHIYAICSSGKESLTDFQVLGSIPFNLWRACHWYNKPTKRATRPSKEDYKFYFERNVFITTSGNFSTEGLKFCIDTIGVDRCMYSIDTPYDEIEEAQAWWRTVDLDEATKEQVGRTNAIKVFKLPLDP

SEQ ID NO: 946 - protein, 513 aa, Unknown
  Kingdom: Fungi, Phylum: Ascomycota
MWEAASDAMDEAFLEHQLHIIVYLERIGGSISLIAVFLIFIAYALVPRTRNVQNTFIVFASVSNIGASVASIIALDGLQAGKETALCQAQSFLFEMFMQSDPWWSLAMAINVFLVFFFRTSPDSFRRWWWVYCLICYGGPFIIALSLLFVRQQGRGPVYGGATIWCWVDREWDDIRIYTYYMLIWVCIAGSILFYSMVGYHVFHTRNQLRSLSTSKNRDGGDVSELPRADLPPLPSDGFYGTATTEIQVTHSSLPVQSLPPSTPKRVHASNVSHVSFEEDCSPPPNPSATRTYYSSVTSSAPPLSKKRGSSRSPSSTLSRSKRAFKKTVGKFGIDDPIKRAYLRTSVLFALSVLVTWIPSSLNRIHSWLQGESPFEYHVATAAVLPLQGLWNAVIFFVTSGTALKAAWSALWAKESGRMPQDDGGNVDSDHYEYGQRRRQRGHGEFDSDMDDGDSGVAGSDIELRHMVDPPGKRSESERIELDSGVWELQRSKRKDGTGRALFGLVSEVTGVI

SEQ ID NO: 947 - protein, 368 aa, Unknown
  Kingdom: Fungi, Phylum: Ascomycota
MSEQEYPICGFVPSYILEAIATSSTAPEESKSACKATLEHKHKCDAHRNDTSAVHQTLQASLSTANDTPGLQRRIYDCQGKDEFPKKPVRSEGGERTKDRQVTNCYDGFKITYDFYSTVFGRKSLDGKGMPLLGYVHFKPEEDVVGYNNAYWDGQRNRMVFGDGDHIYFDYLTDSLDVIAHELSHGFVQYSSPLEYYEQAGALNESCADVFGCMVEQWHMRQSSDDADWNLGQTLFPVAFTGSALRTMKAGKAYAGDPVLRTDRQPKHMKDYYTGEDDGRGVHINSGIPNHAFYLAAKAIGGNSWEKAGQVWYRTMTSGLIPYRCDFKTFAEATVKIAGESFDDVDGAAVKKAILDAWVKVGVLTASD

SEQ ID NO: 948 - protein, 574 aa, Unknown
  Kingdom: Fungi, Phylum: Ascomycota
MAEERQPSAIKAQPTSASASSSARPYIPTLAVTSPSNYGNIDAENESNFQILSSVESPRAARDRPLKSAPRQGGGNPRKRARSSADGSMAGMCVLLSVKVVSFAKLLVVMANSGAAEARPGGNKATDESLLCKLPPELIDAVLEILEPFELVPVSATCRLLRKHAISDVHWQRHVQDNVPVVTVTSPNPIKSFFELYALHHQLWFLPKYKIWFCDLERTGRLIIARFNPAKASIEAYQLVVACTSKTYQQWAADPRVVIHKFEATTGLHKARPILFFAPGCGHNASNYKRSAKANPFFDEIPIPLDDRSEGIHNCLSRARALDDETVQGSLQTQFPYRNIWPPPTIPARDYIQSYSFDLPSESRPTCRAEASDQTFRIRRWMEMSGAIGIHMGEDISSYSTLDPKLYTPTETKPWRGIWAGDYSGHGFEFLLIHQPDDPPSTDAELGLVRLEDETDDEWERRRLETRVFRGRLEAIKLTGDPNVPRGEYTFVADDLGPDGYVGLVHDAPLMGDDPRGTRVVRSKGHVALTGFVEDMFIESQLMLISHDRLAQYWVEFGHISYFQRVDIDKLLLD

SEQ ID NO: 949 - protein, 1609 aa, Unknown
  Kingdom: Fungi, Phylum: Ascomycota
MDLPPPAPTPPVNLGMSANGSGGGPNGAATDGNRTANLLNLLKFSGGGGGGAGIAGTQRQGSLEALPSPVVEQQQHQQLSPPQSQSYQPHQHAQSFGQQHSFQHQPSGLSQTQFPPTAHQIHQPAPTAADPSGLLAALMRGASQDPEEPKPLPVAAPTAPAAPQPPSAFGHGSPPPDTTSYLLGLLNRSKPAQSEPQPQQPMLTETSRSNNHTPQSEDRLAEAERYIAQQQQKQHQSRTSSYGMAQQYQHQERDYPYRPAPEVGNDVALYQQLVSNLSQGSPHSQSSHPTTSQAPFQILSKDHPSPAGSQHREQQPSGTEGSPFASPRFRGQVERTSSHHSHPSAKQTPPSSDHDRHSASGKGRDVIQDPFDVVPSQTDQDARDASERAEQDRARAEIADDINGMLQAKSDSDFENSAQAAAQAIKQELDREENNGVLEHTLPIEAAQAVRDIVNEAAQGVADSWESADQDEIVVIEDKEVAAVKVFNFPMKPWISINLQDGSTEPRPEFRPEAIMDIARLKKDFDQIDRNLYTASQNYMTYGMSKQGGLRVIRQDDGKDAKVFTDTKDRIFNVAMSVTPADSEGPHREAIIGTGISGTVYWVEIKDGSKDHTDDAHLEQYGFALPPINTPEGDAPGGALKTRARASTMHPEFFAVGRGKSINLVWPSYIMQNNLFKPGHDRVVDTDKLLSQCSLKINTGKAGKDFTFSQDDSVVVSLDKSGRVKFWDVRDLTAVKEGSDPRFPIPAQSSLEVMEPLMTLASTPEGEKAWPTSVLLLDKQRPYQKRCALRYMIVGMKQNHTLQLWDLALGKPVQEFNLPHSKESDAVCSVMYHAATGMIVIGHPTRNSIYFAHLSAPRYNLKSVSQAEYIQRLMAQDSSIPQPESTAVISGVREYSFENRGVLRSLDILSNPAMTQDSDDPTLFELYAMHSKGVACLLIKQPELGWSKDNKVLEAVDAVTEGVVTVSKLRSPQPVEVPSAANDGPQVRSIHRGASKDAIQQPTLAQAEGSLRPADSAGQVRTKADNKDVETPVQSSKENQTEKPERKPRKKKAAVQNSDTAGNGSSNTPASSAKNESSRAPAISADNLEFAIAQLESRLNTSLSESVKSSLKSLQGKLDEGSRARDESFNQHQLKLLDMVSEVLNENTQKVLEALIHHQFTELVIPAIGDKAGKAVTDLLNNKLQPHVASTLQREIQSALPHALNRSLRSNEFVNSIADRVGANVATSVQQEVVNTLAQRLTPTINNIAKQSAQTVAGEVHQQYREQFDHMKSQHAADTQKIDQLLSYVTRLTDMVSTMAQSQSALQAEFFKFRQQPVHELPGVSGGPGSHPTDAPRNLAQQVLQHGAIAGLQGPPGPPSHQGSFGPGHPPSHSQSYMGSPQYMRGQHVMGSPQASAPTSEQLGPTSSVTALAGSYANQMQKGDTEADQELAHQIRVIEQLVQEGRLQDAVIRWIQSGREAEIFRRCLSRYPPSKFEGIPHLLLLVVIATISKDLKPNPRLKEEVEWIEMAVRAFRDSLPSYVSYFFPSENQKRADQAQDWDQAGVREVMKSTSQTMQMLISRVRPLLAGIADGYPKDPFLMSLEPNKLDWIVRTADQILEGIGGNGLY

SEQ ID NO: 950 - protein, 154 aa, Unknown
  Kingdom: Fungi, Phylum: Ascomycota
MMKLTACIIQKVIHVALLIMTEVDETHISVRFKHGVHTIYLFVDTLAPVSEVTAELLRLLRERYPKGLTTSVDPPKTTPVPESTDIAYAVLNVPTDPTRGWKKLKIGERGEFTPLKAGMKDNGIVAIAFVDSLGDEAIFEVEWPREDEEAYEDA

SEQ ID NO: 951 - protein, 251 aa, Unknown
  Kingdom: Fungi, Phylum: Ascomycota
MAEQDQNAVASTFPDPPPFWKEFTPDRVAKIAELRAAYAQNHNGEGEVPVRIPDLPQELVMLQPPPEPADGRWRIFGDQYMLDDKLPTLEDQGITNLPNTSLPESKEAKHYDRAFELKRLAKSLLLNFLELTGILSQSPNDAEAKIQDLRTLFINVHHILNEYRPHQARESAIELMQDHLDRTRTETVAIRTQVDKARRVLEGLGSLGIVDTAAKVGKSEKEVKQDEERRMEELRIKREAEVWAATDAACA

SEQ ID NO: 952 - protein, 2333 aa, Unknown
  Kingdom: Fungi, Phylum: Ascomycota
MDATKIASLKRAFKAYLDGQRSVTTLHEARIFFDATKVQDSPSECLEKIIGSKAGLKAVRQSVRLSLDRNYVRDSLFPFLWFFSDSEVQALYDGTFLQQLIMVVASPATAWNNIVKLYREDTILHGQIESQTFAWLCYQVISHPDKDLSDLIDGIVEALDEHPLLKSPWDETRVIGYQVQKALDARNAGKDGAGLTFGQGGPGGRHDNDFENFRETSIFPTPDELTSTLKPFLRTAGEVAETNDAHRAACHLDNQFRLYRADFVAELKDDISAVVENKKQGRRRGEVLGGLSLQDTELVHSDPARNSAYTLDVSFTSGLAFPSKLDQDGRCNYLKTNPRVLGHLNLGVLFHDKEIIAFALIQRIVENLALIPSVISLNFVSGSDFINAVQALLSQPGLQFAVINTPYFAYEPVLEQLKQMKEVPLQHDLFMIEQSPSPDTQGFQPTESVKDFITRCRENAAKGREIRIVDKAYQLDEAQAAALTFALENPLAVIQGPPGTGKSFVGALIIKVLLESPSSRILVITYTNHSANQMLEDLCEIGINRGLMTRLGSRFKATAQTLDMCFESQVRNSGGKLRREQWNRINSLKRDIIELRGDLESALESLSRKISLTAILWFLEFDDDKQSHEAWAAFQPPSMDEDFEAVGKGGKQLRAEDNLAGWRQGKKPGLSQAQLSQESKSIWDLSSNERMQLWTKWHNALRRDQIEAVKNLASRIEGMQKEIDMAFNQSKYAFAQTRRIIGCTTTAAAKNTDLIKAFRPTCILVEEAGEILEPHVLAALCPSTQQLVLIGDHKQLRPKCNSYALSVEQGDGYDLNRSMFERLILQGRRHETLQKQHRMAPEISQFVRSLTYPDLLDGDKTLDRPRIQGICSRVMFVNHSMPENGVSQIGDKRDPGNKGSKENKFEAEMVLKVVKYLGQQGYKSSDIVVLTPYLGQLRLLRDMLSMENDPVLNDLDSAELLRAGLLTQASANLEKSQIKLSSIGKSSIPFKLPLLLSLTINNKRGDIGFMKEPERLNVLISRARNCLIMIGNMETFMKAPTGQKVWRPFFTQLKDNDFLHDGLRVRCERHADQTATLSVPSDFMEHCPEGGCNQTCDAALSCGIHKCERKCHLLSDHSKISCNIMVKRSCEKGHAHSRKCSDKTAIICDILVKMHCEKKHQYSKKCCDKRHGCPVCEEHEEDIRRRVKRDLDLEKARLTRQENYRQELQQIKDEIARHERETELKDEEKQEAKSILVHLSKLEALRRAKKLSEASEGSSGDSEKQGSNTTGEVPGNEFSDGPNTIKSPARDEWESSKQNEFAKSTELDTLMSMIGLEGVKRIFLDIKSQIDVTTLQGLSVAKDRFGCTLLGNPGTGNAFEETTGSKLANMGIDGCQKMIDGVLNRGGGIIFIDEAYQLSSGNNRGGAAVLDFLLAEVENLRSQIVFILAGYAKQMESFFSHNPGFPSRFPMEMKFEDYNDEELRNIAARQIYKRFRGRMKVEDGIHGLYCRILSRRLGRGRGKEGFGNARAVENALAKIYRNQARRIKTERNQTRQQGTSPGTVPDPLQLTKEDIIGPQPSKALFQSNAWGALQDLVGLQSVKESVQVLVDTLEANYERELVEKPIVEYSLNRVFLGNPGTGKTTVAKLYGELLAQIGILSNGEVVVKSPADFVGDVIGASEKITKGILDSTVGKVLVIDEAYGFYSGGKHNRGADVFKIAVIDTIVANVHSTPGDDRCILLLGYREEMRDMLENMNPGLSRRFPLKSAFVFEDFDPTQLATIFHSKLKKQGFGVTPKAEEVALQILERARNQPNFGNAGEVDIILDEAKVRHQKRVTAGKTKMKETLEAVDFDEEYDRATKADITHLFQGTVGCERVVSLLQGYQTTIRRMAGLSMDPKENIPFNFLFRGPPGTGKTTTARKMGKVFYDAGILASDEVVEVSTSEIIGQYIGHTGPKVRKTLDKALGKVLFIDEAYRLALGAGHFAQEALDEIVDACTKERYHKKLIIILAGYEKDINHLLTANSGLSSRFPEVIDFQALNPSSCLDLLAKDLTKKKTEVESSGNNNSMDIACLTENEVRLRLIDSFTRACQLEAWANARDVLTLSSAIFNAAIQASSSGNVVVTEEIAVLEIEAFVEEKEGRDLAERMPQPQQPAGLPTQVERDEHSPAQPSASSAQANGQGQPNASPEIEDEETQDKADPPKPETKAEGDKMPTIRDAGVSDEVWEQLQADIGDQNERDQRYQEQLQAEKKANDDLRQLIVKELIAEQEKKDEEHRARLRAEKEAIEESRRRIMKQIAEEKKWREEEAKMQEKLDQRGLCPMGFQWIRQAGGWRCAGGSHWISDAHASML

SEQ ID NO: 953 - protein, 655 aa, Unknown
  Kingdom: Fungi, Phylum: Ascomycota
MSAPPPPPPHGGVPKGSGLPPGKYDIFVIPEHSAGSGFLYLPSLQPNVNSFAAGFASALILVALFQSMAPAFRAWWDQFQGMGNTGILLIIAGVGFGAWALGRTQQDSSKQPPPGGHPGHGEGAGYNTHASGATPGPDPNAAPPPPPPPPHNEQPKPQPPPPQQEKPKPSWQRQTPPQPGAAKAESAKGSWEKAREEMRKREEERKAKEAEQKRREEAARRLAELRAKEARERQEREAKREKEAKEAQAMKDAEKRLAEIKAAAERKAAELKAAELKAAELKAAELKAAELKAAELKAAELKAAEEKKKQEEQAAQSSRKGSSYAFSGVGERTSMWPNGRPPVPTHSPAKTPASPNAKPPAPTAKTYLSTDDDQYSFRPYDQPKKPRHKPSISSFSGSEASWAASQTTAKTTPPGSFRGPYSTKDPDKIVISGVYLFASQFAKEPASQLLSGVGPVTDGLILRITTEGLFIDDDVRGVPQREWDVKAWTLKQVEVWCPPHCLTPSSATPSLAHPKAAPNLLHKMAGSKGVPRSQAGSPRLLTGDEADLYLAEMLRACKDCCRLGLCDEHKLSRIANTVLPAGQTGEWKTKGLHVLRATVRDQDGKRYLFVVEDAESWKLAVGLQRLRRGTQVRQLGVSGMSATDAKGTLEMLGYH

SEQ ID NO: 954 - protein, 201 aa, Unknown
  Kingdom: Fungi, Phylum: Ascomycota
MMESLQLSQVLADLSNLGAAVRSHPLCSRAHTDSHHCVEPEAAAAIVSANTTISVSKTVAATSAPSNALQVPQSQQRPSSLTRSWSAEPGQPKLDKYGRRILANTPGSHSGSTGTSTPGTPRLGTSTSDATREQLDADLERASTLMALYDIRSKLKQQDNSSLLRAREKINALAARQQSQQAARPEEIRRNRYSFPKPTQG

SEQ ID NO: 955 - protein, 1022 aa, Unknown
  Kingdom: Fungi, Phylum: Ascomycota
MFSISTAPAKQSVGDTITTLSGRLSSATLLEDRRAAILGLRSFAKDFPASVASGALRSLIGSLSKDGEDVDTVKVVLETLLTLFSPNEESPEASDEIALWLADEFTQRQENVTLLLDFIETNDFYSRLYSLQLLGAILSARTERTEECIFTAPLGISRLVAVLDDPREAVRNEGITLLTYLTPSSVDIQKLVAFENAFEKLFGIIAEDGSLAEGGRTVEDCLILLANLLRRNASNQALFRESGCVSKLANLLSGLLRAQNDLTAEVAGWAETQRNRNLYAFLAVVRLFLGRRFAGRTQNQAAFWKHGLSFHVLQLAFNHDAEAQIRAEALMTCADMIRGNASIQESFAQLMVTSPLHVPDQAKDQANGLSQVYVIDGLLDLTLNLAELGAFDVRFAACECLQAYFAHHEDVRLHFLGRAIEGYQAHHDESANVLSVLLRSDTTTKVTDPYRMWFAAVITFHLLHNNPTAKAKALGLTEGDTESGEEVVTVVQTIAAHFFSGIRRDDDVRILVASLMLLCGWLFEDLDAVNDFLSEGSNIQSLVQIVTQSSVAGGDLVQGLCALLLGITYEFSTKDSPIPRATLHSILTSRVDREKYADRLAKLRSHPLIRDFEVTPQRLGSSPPGELPEVFLDATFVEFLKDNYSRISRALDREPGLEISVVTNGVQKGISRELVDSLRSQVDEKEKALQEVQAALAALEGKLVQEQADHRRTKESVASEVSKAQSATENLQRAHDAELRKLQSQLSAKDVEHQKAIARSQSQLSTKDNDHQKEIAKLKSQFSTKENEAQKEMAKLKSQISTKESEAQKEINQLKAQFSAKESDHHKELSRLKAEISAKDGDHEKQLAQVKKTVEQDAERVQRRTQAEIADLKATISRLEVDLMKANKTKTQELQALKDEHSAALAKEKKRADDAENAVKANDGKLKEADKKSKDYAEELEKAQKKTDEMRTKATETASALAAANKAKDSTQSELDDLLLVFTELEEKVAKYKNRLVELGEAVSDAEDDDEEEASGSDDDVD

SEQ ID NO: 956 - protein, 1088 aa, Unknown
  Kingdom: Fungi, Phylum: Ascomycota
MSLTREEPADVSRLHAQVPITALAIHESHLLAAQDNNLYIYEVSSGRLIHQRSPRAFTTVNAGQPIHGIHVHPVSGAILLWGASAVAYLPGGWKGGKEISGKAKDWIYAGALSPGKDAGFGVVVTAHNDLVPVSLGDPSGTLVFGQPISASRPILYSATLSFLSADTLLVVGGTVFGEILVWRCHLGSALISQDGTMGKAEMLHTLTGHEGSIFGVTISPPLGPTGKRILASCSDDRTIRLWDITESNAAVEFHDDNSKAARETGFNTTTTTSSKPIAVAMGHASRIWGVRIVTADEGASTVVYSFGEDATMQRWAVDLEAGKLTHEKTFSLNDGKHLWAHALATRADGSLLFATGGADSRISLIEEAAPSAESRSNLMSIDIRDVLHGAPAITGSTKRAKEIITRYDFLSADELVAMTSSGRILRGVVGATAEEWRIVPIENKNHAGDLSLCYALRTVSPGVVALGTTSGNVYLYDMDKGLSLITNLDGRIMDLIAVQGSPNPNGSVDVYVQLQGNKAPWYLSISTTSSTLVTRAELTDVDERFVAVSALKARGYILIGSRHGFLSVLKPDNTTNTHPVIFTLPPRAPDAISCIIEIPPDYTTTSNPPLYILTTSRDGHFRIYHLQESSSSSDITLQLLHETPAPFGPVLTGAFFTPSSATSTPELILHGFRGKDFLIYDETHRVELASIHCGGAHRMHCLWTDPLSSSRLRFAFTRTSLLSIYAQETVSHRTLTPGTHGREIRALASNGTYLATGSEDTTIRMWSISPESTDQQPHLLMTMKAHNTGIQQLRWLGQSHLLSSGGFEEFFIWRVRRLDNSLYTGVAVMREAKLEDTGGDTDGDLRIMDFDACWVTGREEMQMIVTMVLSDSTLKTYTYALDEGFVRRASGRYTGACITQVRHLTNGTASPLHLVTGSTDGHICIWREDQESKTYHLETALQTHQNTVKAMDMISHDAGHLVLTGGDDNSVRLSHIALSATSDTNPKKHYTITNRADFLRAHTASINGVAIVARSPGQPGYLGVSASNDQRVKVWDLGDSGQKLSLLADRYSGVADPGDLEILHHNKGTLAIGGVGMEVWHVKETESP

SEQ ID NO: 957 - protein, 98 aa, Unknown
  Kingdom: Fungi, Phylum: Ascomycota
MGVASMVLLVLITILFPPLGVWMLAGCGMDLFINICLTLLGVLPGHLHAFYLIWVYYDRREQAREGRYATRPAPGVYSSHVQTGGGHGYGTVNPPPAY

SEQ ID NO: 958 - protein, 1835 aa, Unknown
  Kingdom: Fungi, Phylum: Ascomycota
MEESAWDRSVHAASALLRRRADESSEEPKIKDKNYKRYAAGVDKVLALFDTALEEWADYISFLNKLLKALQSRPTSITRIPTAPTVAKRLSQCLDPSLPSGVHQKALEVYAFIFTTIGKDGLSRDLPIWLPGLSSTLSFASLSVRSPFLDILEDHLLKIDPRSLRPAMRSIILALLPGLEEETSEDFERTLKLLNRFKEAVRAPDSGLLTDDHSTGDQFFWQCFFLASITGQSRRAGSLAYLVRYLPVLGSGSQGNTFQAQLASMVTSPEPGLLIRCFATGLADEQLLIQRGFLDLLVTHLPLDSSVLQDRVKAPDLQLLLKAAVGVVTRREMSLNRRLWAWFLGPEPPAGEMDHVPESAAAASEPSQTILNSRTTFFEEYGLQPLTKALLAMIHDSGTGTASDRARPYRICLSLMDRWEIGGLVVPEVFLPVVDNVRQFKSQARSRAEFIEVLRSASVFFDGIESGLIYGELVGLLAQAMGPGDATMAVRRDKLDLVLFVLEHFNVREEEMITVHAPLCCLTAMAMLEDYVSRQSSEAVQSDESAALQEQLLKTASALLELVPERAFPKHSKSQVAKDRKKSPASVELLKKIRSFYVHEQGNIEASPAPFGPVDIGEILLEKSVRFIRDDLEGHCTMDLRSRIRFLLLVLLKTPEDYTFDREDLLSFLHDRMTSENNVPFPEYSAVVHLATQLHSLGRIGIDQLSDLVLPLVRHAWAFLAASEPKYHVEAVRCMWYLQSSLSVASREVEAALCTLIVESKSPISRTTGAVDIGRTFGVLWSHTLQDNVSDRRGPKTPLVEHRTSPRLSGMEHFEVMLTQPLFLVLDSLLDERTQLFMTVKSWLNSMIGIDRLFLVFIPKFLQMRFLADVESETTDGETYNPKPIQFSEDDDLELEVSWAVVATKHLSFDGGTAQISSGDSSSDITLQAFFVRVCVRCVIGDVPSSATPDLVERISELQRFALSTLHIFFSARFATSFSGLHLENILIQRLSTSISHSDPYVQVLLLEVVHDTLKLRDMISPEPPASPGEKRPGSIDPSRPSRTSIALSESQPTKPPPPPQLLKCLQSGLSSPQSRMVLDSWIKFLGQCLPFYSNTIFQVVIPLVETFCKQISFTFSSLKDTFHVSRDSAHTATGSPESTLIYLLNGLEQVLAAAHDQLLSAEARAQLSKSPDQPQSIFGSMVSGVWQSDSPQSRSATANDRLTVHLAFQDAVRMCYSIWCWGQGEDALQQDPASSASFNYTSLRMRNRARRLLEHLFHAEPLECLETVIDMWNKPAASTSKSQVFNLLSALDASRPRHAVPALFNAIYSRTNPGALEPWRKSTLTITLEDSDLVIFLVEYARSLDDDAMDEIWTDCITFIKDILSNPFPHRQTLPRLLEFAAILGEKVDNTNFGEQRKMRRELGDLFLRLLTALFTTRPMTFTDSANGSEKSSRGVAAGDSEEQQDVVSILAAVVPELPKVLVDQDRVLSAAGTISTSVIAPTIRAKSFPDTVSKNTLRLLHELSRLQNNQKTWKKDVGDAFNDSRFFSMNLALVKEHWLPLLRLWTRSDKERLPEIVGRINPPTTAGIVFGVGATSARLEADRKTQITLRRIATLVLSSAEDTFVTDLPLIVDKLVELLTATATSSPSSTTRADVYMVIRALVLRTSPIHMATLWPVVNSEIHAAMSSVVAPDHSAASDLYNNATVLQACKLLDLLICVAPDDFQLHEWLFITDTIDAIYRSHNYQAVSLVDELSEELSNSTGVPASSTSVDASAMVAGNPNRRPLLGPQGISDDVSLERREELVARILRPFFSQLSIFAFESTYALVPLDRELCLDLLLKDLFEERSIVKAL

SEQ ID NO: 959 - protein, 525 aa, Unknown
  Kingdom: Fungi, Phylum: Ascomycota
MLKQQVASSASAVYAKLSSKPFLLYAPVVITKMSTTEGSIRPQQPRGIDHADSGSEDEVVVQGKVNMPNNGRYFPLGYKDAAWQWWSSIAPPSAENAVLSHMPYLKRATDSFTQLPSEAAAEAVADPYGNRIWKRTLVQLSGQDRALNEISVERVGEETEENLVMLHGYGAGLGFFYKNFEPITRTKGLKLYALDMLGMGNSSRPPFKIHAKEKEDKVVEAESFFIDALEEWRKARKIERFTLLGHSLGGYLAVSYALKYPGHLNKLILASPVGIPEDPFAVDSALPEPEESTMTNEFTQSQDVTTESSTTARSARAANSTKRPMPGWLVWLWDQNVSPFSIVRLAGPLGPRFVSGWTSRRFSHLPPAEAQALHDYSFSIFKQKGSGEYALTYLLAPGAYARRPVIHRIQGVGRQVISRDDDGKPLKKELGLPIVFMYGENDWMDADGGHASAKKLNQASKEALDQASDEEKRLDRGSAKVVIIPKAGHHLYLDNPDSFNKYIAKEMKQTLAELRQQRAENEKRK

SEQ ID NO: 960 - protein, 178 aa, Unknown
  Kingdom: Fungi, Phylum: Ascomycota
MSSTAEYCEYGGTVKKCQEWLQSAHPDMYDRIWSAEALEAATASLSVEAQKRAAKDAQKKTAKAEAAEAKHADKIAKSVVTIKRIERNKKKFVTAVIGLEAFDLELKKVAKDLGKKFATGSSVTKVPSGGEEIVVQGDVSDEVEEFLLEKYKNIPEDNIEFVDDKKKKKAAAAAAGGG

SEQ ID NO: 961 - protein, 295 aa, Unknown
  Kingdom: Fungi, Phylum: Ascomycota
MSTAAQEEFNDLVAKNTHRETLHPEDRHDPDNHLHDDPTEEDVFRNAQIEAAMRSNTLTGPGVGPDIHLPPTSFDDGHSTGVKGVIADARSFEKARRSKWKSRIQTARRSIFGVDSVSRPQRTGTSNSNSSLSSSPSDGESVGTDEEAFLEEWRERRRKELEVDAARGVRNRRTSPSARMYGRFDEVDAMGYLDAIEKVGRETKVLVFVYDHECEVSAMVESALVPLVTEHPTIHFVKVHYDDIEFDPAAVPSLLAYHNQGDLFANMTGLIEMMPDEDSFGTTALTKILQQNRVL

SEQ ID NO: 962 - protein, 231 aa, Unknown
  Kingdom: Fungi, Phylum: Ascomycota
MPGEEAEEEGHIATTFERKYYHREGVFIKRSLRPSEFRTGYRGLHVPRLGKERLRNEGESLQFVRQHTDIPVPIVHRHFEEDGAYYLITEYIEGVSMSELPEEKKAVVFEELESQLSKLKALKSCHIGGPSGIVIPPHRLLQCTESDHWNLRPSNWDEYVFCHNDLSQQNVIVDPDTFRIRAIIDWEYAGFFPPQFEYPFYMRLGPSSAINGEADDSQDLLRFLRSQERAS

SEQ ID NO: 963 - protein, 816 aa, Unknown
  Kingdom: Fungi, Phylum: Ascomycota
MALRELKPLHDYEAQQSAFETFLKDFKTSPEQTITTAMGNITIDEDDLSDEDYDFMDDDNEQTREERRKERAARRTPQPKYKLMLQQLADRTIDEMTIDLDDLAAWERIDNAEHKLVESIEMNTKHYVEIVSRAVDKAMPAPSTDVTFKDDVLDVLMARRQARNREMEEVAERDATVDAEKFPAELTRRYTLVFKPRTLIKGEPTKALAVRQVRGEHLGKLITMRAIATRVSDVKPIVQVSAYTCDRCGCEIFQPITDKQFGPLSMCPSSDCKDNQTRGQLNPSSRASKFLPFQEVKVQEMAEQVPIGQIPRSLTVHCYGSLVRQVNPGDVVDISGIFLPTPYTGFKAMKAGLLTDTYLEAHHIVQHKKAYSEMIVDYSLVRRIEKYRQSGQVYELLAKSIAPEIYGHLDVKKALLLLLIGGVTKEVGDGMKIRGDINICLMGDPGVAKSQLLKYISKVAPRGVYTSGRGSSGVGLTAAVMRDPVTDEMVLEGGALVLADNGICAIDEFDKMDDNDRTAIHEVMEQQTISISKAGISTTLNARTSILAAANPIYGRYNPRISPVENINLPAALLSRFDILFLLLDTPSRETDEQLAKHVAFVHMNNRHPDIGTDNVVFSPHEVRSYVAQARTYRPTVPEAVSEYMIKTYVRLRDQQQRAEKKGKSFTHTTPRTLLGVVRLAQALARLRFSNEVTRDDVDEALRLVEASKESLNAEVGTGRRGLNASSRIYNLVKALADTGACRADDADDDEALGVELSMRKVKERVIAKGFTEDQWLNALEEYTTLDVWQTTGSGARLVFVTAGEDDRGDEDLMDF

SEQ ID NO: 964 - protein, 557 aa, Unknown
  Kingdom: Fungi, Phylum: Ascomycota
MAEPQPNIQSILAALAAQRPASTPTQTPPGAPTQAFPPPPGASQPGHYQSGPPGAPGYHAPPPGLPAPASSGNVDLSAIRPVNSGTVNFDDIVSKARALAGQKGATSYDRPLVYNSEARGQDRGFRSRSRSPRGNYHDNSYRDDRRGGYGRDYGRDRSHSPQRGGRQSSPRGGNRDRSPIRGGDDSSEIIEIESSLVGLIIGRQGENLRRIEAESKCRVQFLASTDGGPFRQCKITGPRARRVEVKDAINQIIEDSGMGALNRGGDKSRAPHDKGSGAGALREGEDHVQIMVPDRTVGLIIGRGGETIRDLQERSGCHINIVGESKSVNGLRPVNLIGTREAAARAKDAIMEIVDSDSRGEATGSRAGGGRPPMGGRDDGQPRPGAGGQYGGGGGDKITDTVYVPSDAVGMIIGKGGETIREMQNGTGCKINVQQGQPGETEREITLIGSRDSITQAKQAIEEKVDAVRQKSGGGGGGGGRGGRSGYQDHDRGSYSNQGPSSGTNSQPPAASGDDADPYAQYGGYQNYVALWYQSLMLQQQAGGQGAPPGAPAPGAK

SEQ ID NO: 965 - protein, 225 aa, Unknown
  Kingdom: Fungi, Phylum: Ascomycota
MTSSTSPVVTLVVGTEQRLFAAHEDILCGSPFFTHALRNTYPETSSRRIVLPDEEPEIFSSVLEYLYKGDYFPRLRHNRRRNSWELEPATEQDNGTVESTVYHRSVDGDLLKDTIIYCAAEKYGLEELKKLALRKQGLQSGIQCSTILNSARYAYAHTPDNDSKLRAHYLALIIRSRSTFKRSGTMQLEMYNGGTQLFFDLFVALCNHMDDLSSAQGTPRSNRHF

SEQ ID NO: 966 - protein, 313 aa, Unknown
  Kingdom: Fungi, Phylum: Ascomycota
MSPPAKKRRTTRATAQEETEPVTVEGQHATEPVSEDQDAKRDDDSLHPETEKPEEKPEPTTESSSSSSRAQDRMARFKALQARAKNSSETNLKEATRESQRLATDPSQLTALHRKHAIASHKLLKADVEDAGEDFERKRAWDWTIDESEKWDKRLKKKAGHRDNNAFQDYTQESNKVYKRQLQNINPDMERYAKEKMAAIEKAAASGGLDIVETEDGELIAVDKDGSFYTTADSTSFTSNKPDKEAVDRLVADMRRAEEQTLKKRKERMAKNGDDGDVTHINEKNKQFNQKLARFYNKYTAEIRDSFERGTMI

SEQ ID NO: 967 - protein, 627 aa, Unknown
  Kingdom: Fungi, Phylum: Ascomycota
MAAGEKRDDALEAPQVVNIPYWRQVIDQAGITDSVRNYNYQGSGTDEDPYVVVWIPNDPRNPFNWSQPLKWFITLVVGLATLAVALVSSAYTGGIKEIIEEFKISEEVAVLGVSLFVLGFAVGPLLWAPLSEVFGRQILFVITYGGLTAFNAGAAGSKGPATLLVTRFLAGSLGSSPLTNAGGVIADMFPASQRGLAMTLFASAPSLGPIFGPIVGGFIGEGPGWRWVLGFLAAFSGLFWIIGSLLVPETYAPVLLRRRAEKLSKMTGKVYRAKIEIDRGPVSLAQIMKVSLSRPWILLFKEPIVLLLSVYMAIIYGTLYMLFGAFPIVYQENRGWSQGIGGLAFLGVMVGMIGAVIYSLLDNKRYVRVEMENDGLAPPEARLPPGIVGSFAIPLGLFWFAWTNYTSIHWIVSVAAGVPFGFGMILEFLSIMNYLIDAYTIFAASVLAANSVLRSLFGAAFPLFTTQMYSKLGIHWASSIPAFLALACVPFPFLFYKYGEAIRKKCHFAAESAEFMRKLKEAERAREAQEDESNGSVTEDVNDENQGADDANEGPQYEGIRPGSRQSTRRLSRASTSASHAGRASRSLRRLTMYEGNPYDIDRVNTNEEQFTLSRSRSPKHNRRSLS

SEQ ID NO: 968 - protein, 245 aa, Unknown
  Kingdom: Fungi, Phylum: Ascomycota
MSGPQFSSKSNGTATEQESGGNRPVSAPPTAEPFKYRPLPASGTALAIGAFATTLTTLSLSLMEWRGVTTTNIHVANFFFVATFGLLITAQWELAAGNGFSYTVFSAFALFYAGYAAILSPWFGIASAYADNPVEFNNGLGFWVLLWTIFVLTFLIASLPTNVAYILIFLFVDLGFLMIAASYFALADGHHSAGIGLKKAGGVFCFLAGLVGWYLTLHLLIKDSIVELPLGDTSKYFRKSREAKR

SEQ ID NO: 969 - protein, 476 aa, Unknown
  Kingdom: Fungi, Phylum: Ascomycota
MTTAMRTGALALSLALLGQTARAHDHHEGESQIPEGETISQEPLGTIMWIHIFVQMLAYGIIFPIGMVLGLGKSRWHVPVQIVGTSLAIAGFFLGHAHGGREYVGNNVHASFAWILQLLLAAQVVLGLYLKGHWEKGINGRIRKLIRPCHSIIGKAMPVLSWTQLLFGGITALGFCQGEHVGQCAAHFIMGSAFVAYGIILTIILLVGQVWLRRSGRSQEFYDSAVIAAWGCVNTFTEHHWGTDWVKNDWQHTTMGIIWWCAGLAGVWLSRDRDGNPKRNFVPGFVIFITGWAMSAHPQELHVSAATHTMFGYTLMAAGLTRIIEIAFVLRDEQSLAEDGRSWNSFQYLPIFLLYASGFLFMGATEEQMLLVDQSSMDHVAYLLILFSVAFLVFLFAHMLIHLYDRNANPTVKGKEFDSHADENGRVRDAEEFELDGLMSDDEADEGRRMLRRSEDGVGSDSSPSTVGKNNQTRAR

SEQ ID NO: 970 - protein, 402 aa, Unknown
  Kingdom: Fungi, Phylum: Ascomycota
MRGGRFVCVALPLILCLAAIIALLYAVLAGVTHHSLYMFSVDLSNLTIDASEATNLIKGLDLNNLDLSKLDSKTQDLIKQYLPAGTTLEDLKNKLPDGTTLDDLKDKLPDGIDLSNLGGTIENLLNNNGKARRDLEARKDGVLTAASLGLGDKWQVSLWGYCTVNSNGNRNCTSPEWNWAAKHFNTSILDTFANQTGLNITLPQELHHALAVFKPVTKWTQIGFATSLVALAIEFVFGIFATCTRVVSCLVWLWAGITTALVIATATAATVTASVVVGAIKSAGHKYNAKASVNTSFLATIWIGAAFSVAAGLFWILTMCCCKPESRQERKARKGFNDGEKRFPGFHRGGYGRLGDDNEMHGGLGRSPQPSPGFSSAFNHGGPQYPQNARSDLAYEPFSTRA

SEQ ID NO: 971 - protein, 213 aa, Unknown
  Kingdom: Fungi, Phylum: Ascomycota
MKTLLLLGGITPDVTTLYYGTTNTVTRTGLAAVVAVAPTKPIVDGVVVGAILAHKVAKQLEDALKPTRVRLLNVADFLARHVKSVMPYVKMLGLIGPKVTMLGAEDPDFFIGQLQASGNELGILVPESEASLNEVNRGKMEEVAKGAANVTAATKAMFVHETKALVDRGAQAIILGNTDLGFVISREDVEAGVPLLDAATIHAEGVTNWAIDR

SEQ ID NO: 972 - protein, 692 aa, Unknown
  Kingdom: Fungi, Phylum: Ascomycota
MGLFSKAKRQESKPPMDSVIDHGVASSEKGASEPTVVETPLPAGARTPDEPCAHSVQGSRMSNMTLTGTYAESQARGSVTAASSSQPTSILCRDDPVQVETAKKRNCIRQFGHYINSRVCIKSIWEIISPVDYFWPITLRRYACLALIGAACVGIYFSNLYTDWIGKSMAITRTFMLPILIIVMGLEPIMFICILAASRMPPVVENLEAPTRNQTGPLHKNKLMDEESSSSISPSEEDTYHTALVLPCHKSDTKTLRRVFESACRTAFRPKDIFVVDNARSRHPENLEFRDWVKRQHPDINYMWSPIGSKNAAQLVGALAAKGYKYILTTDDDVCLPDNYRHPTHLLNENTRAVAFPLTATNAEGDNTLFLVSWQDCEYRTSGLSKLAESNTCGVCFPHGAGWFIDREVLIHIMETLHPTDFIAEDVNAGFCMMKIGKSIALDYNVVLATEVPLTLIGPGLNWFKQRVLSWEMGRHKMLFTLLRRVFSNNGQTTLTGVIAQKAFLLYNITTLVVDWIRVPVFVTMGYSAQFWIKVALFSLISIVPLILYNYVKCWSRPTYRVRLVAALTYPIYKQLYVLVSILGFIRAVLFYMGGYVRAKPVYKMLKDGDQECFWLDPRFETNPAWLADEREDQLIAEGLMPPRNRPSSWNMNNMEKRMSDGVSSVAKAAPKAVFVNEVAQPSPVLTRARSF

SEQ ID NO: 973 - protein, 405 aa, Unknown
  Kingdom: Fungi, Phylum: Ascomycota
MFSPASVAVRAGSRRVSGPSSLTALHRTRSARNACSFSTARSSSIYIGRSRPLQPAAPWETRARHGYATTTNPNPPFGKKNASNDKPSRIGLIGGRGFTGQAMIELFEAHPHMDLKYVSSREVAGQELEGYTKRKLVYEHLSPEEAAELERDGEVDCWVMALPNGVCKRYVEAIDQVQKTSGGKSIIVDLSADYRLDNTWTYGLPELTPRSEVESATRLSTPGCYATAAELGITPLLEHLGGEPVIFAVSGYSGAGTKPNPRNDVKLLENNMIPYSLTGHTQEQEISHHLGTSVSFIPHVASWFRGIHLTINIPLNKQIASRDLRQIFQDRYAGEKLVKVVGEAPHVKSVSSAHHCEIGGFSVDSTGKRVVVCASLDNLNKGAATQCLQSMNLALGYAEYEGIPV

SEQ ID NO: 974 - protein, 2236 aa, Unknown
  Kingdom: Fungi, Phylum: Ascomycota
MVRSDLDAAMQNGTLFRKNYAMLGAVFAASFAFELGFNDGMNKIWDSINRGRQWKDIRHKYVQDAEEEESHHVLLKKMDEEMSTQERQLCQFLAELPQRYKYRFTDSARRELIENLFWSLAGGQPEHNRLLFPGGKMPESLKLSDAQGAVEGAEYTEAARGKRCGHIFKPGEASYMCRTCGTDDTCCLCSRCFDSTDHTGHMVRIQISVGNSGCCDCGDDEAWKTPLFCTIHSEVEAGHDKGKGKEAAGLPDDFVGSMQMTIGRVFDYICDVISCSPEQLRQTKTKESILKDEEQSRLSSKYYGSNADECQDFCLVLWNDEKHTVREVQEQVARACRKTTSAASKDAWDTDAIGRSILVYRDDVPTLLQMSKVMEAIRITVTIRSARDTFREQMCGAMVEWLSDVSGCAAGHDNHILRRTVCEELMKPWRKGSLATHTMGLIDDEEEDDQEHESRMAFRGVNARVLLALQAAVAEGGAEFEVALDEDDDDDEIEVEMDGNESPSSVVGDENDDDDDDDVMMVDARAGGGDVSIDWPGPGDQALEEDEATMAGYPPPPPPPPVVPSRAGPRERDATPSDSDTAEPLIAPAIYAKVNVEIPKTPGKTEKAIPKPARYWMEAPAVYTQRGEVPPAEDVFERVRLDWLLLFDLRMWKKVRNDLRSLYISTVVQVPEFKRVLALRFASLYTILAQLYLVGDREPDHSIINLSLQMLTTPSITAEVVERGNFLSSLLAILYTFLTTRQVGHPWDVSPDVVLAFESGSVTNRRMYHFYQDLKYLFGAPHVQERIRSEPRYLMQFLDLVKLHQCIGPNVRAVVEHVEYEADSWITASLVTRQINLQARGIAEAFRNCPPDEIHYLQRAIRFTAKTVILNSIGAERARFKTSEIKEEVKFKTLNDFEFDTESDSHSVVKFVVEKDSISFHHALHYTLSWLIECARSLPASSIRTLLSFTTQELKAKPRLMGKLQFGRKELTAEDHLMAAFDFPLRVCAWLAQIKANMWVRNGISLRHQASTYRGVGQRDVSHHRDIFLLQTALVICNPSRVLASVVDRFGMESWCKGLFELKSEAQDDAQHLDVVEDMIHLLIVLLSDRTSLIAPEDEPNSRVLAMRRDIIHVLCFKPLSFNEITHKLPEKYQEQEDFHRVLDEMATFKPPEGVSDVGSFELRPEFIEEIDPYIAHYNKNQREESEMAYRKKMAKKTGKAIEDIVYEPKVRPIPSGLFQDLGAFTGTGMFAQIIYYSLLYPLVAQRFTPSVPFTRLETFLQVVLHLTLLAIAEDKTEENSMADDSFKSFVNIALTRMGRSNFMPEPNTSRTIGALLHLMHTKEEFKSLHPKIGLVLRRLKQKRPDTFDSAFVHLGVPIDRIDTASPANNSAEEERERKKKAALSRQAKVMAQFQQQQKSFMENQAAIDWGSDIDEDDDEDEPVEDRKHSWKYPAGTCILCQEDADDRRLYGTFALLNDSRILRQTDFQDADLVREASQTPCSLDRSAEDIRPFGIAHENRKMVEKLNSAGEVFLAERQTIGKGYPSNLSRSGPVASGCGHMMHYRCFEMYYEATNRRHTHQIARHHPEDTKKNEFVCPLCKALGNAFLPIVWKGLEQSYPGQLQSQIPFDYFMEAQMGSYSRLGDSKAKEIDDLGAPDLSTPSLPGSLIENIVRPQHSVPVEGLWAGFREDTDSRSSAVSTPAMSTPQSSAFSATNTPEPVLPVATPASGAPQAIVSEILFAYRRLRDTMRVNGLETRYPLPKADIGEGLFASDTLVQTVSYTIAATEIQQRGVEVQPGLTLLDKIPEQVLTQLRILAETATSYVLTGTMPHAGDSRVLTELQKDSARQHCQLFMSRYIGKEASFTTQPLEAYPPLLSSDPFIFLVECSYGLLPTQKVEISHLLRVCYLAEIVKVVYHMGRNMPSERWLGTLMNRQTQDPAMHNFADFALAIARFDIDSRGSQGAEVDEKQHLGFQQPGVDTLESWYMLVKKYALVFLRKSVILMYAKYGVDFQSHISPEPEAEELERLTETLKLPSFDEMCASLTHLAATCGWPESTSEMVAGWVKHQNLASEKQKDDGTGLPQSAMVSHPGIFELVGLPKNYDTLIEEATRRRCPTTGKDLTDPTICLFCGDLFCSQGTCCSKVDRSNGRKEPTRIGGCQQHMRKCQRNIGAFLNVRKCSVVYLFRMSGSFAPAPYIDKYGETDPQLRHGRQLFLNQKRYDSMIRSTVLNHGVPSLISRKLEAEINNGGWDTL

SEQ ID NO: 975 - protein, 495 aa, Unknown
  Kingdom: Fungi, Phylum: Ascomycota
MQFSCARVMALATLVLGSPSPEALDACKAISSAAPGRVAMQSSLQYNKEVNSYWSIALHDVRPACVVFPKSATDISAAVKILNKHEKVRFAVKSGGHSVTPTHSSVEDGVLITTSAMVGATFDKERMVAYVKPGGKWNDVIPMLEKSGVTMLGGRIGIVGVGGLLTQGGISFLSSQYGLAADNIVEWEIVMADGSIKRVKAEEEPELARALRGSGNQFGIVSQFTTNVYPIGKVWGGTRLYAADKASQIFDAYHNTFKKGEDPKAAIILSTFWSPFNVQFFIIFYFYDGPFPPTSGGFAQLLNIPYTTSTTRTQSYSNLLRENGELPDALKARISFHTTTVPYVPDRPDIYEEIRAKFGSLTQHEINQRLIPECSISFEPIPATVGKQSEKRGGNALGLTADDPDRMMLAIECAWNLSSDDDLFVRLSEELTDWIEEQIPEWTKGRDIYLPYLMNDAGKGQNATGTYRDFGKLKALQAELDPSGLFRTRTGGFSY

SEQ ID NO: 976 - protein, 357 aa, Unknown
  Kingdom: Fungi, Phylum: Ascomycota
MYSKFVLAGLGSASVAHAAAIQNRGNGCSVQLTVSGAIHDPVGQIASGQARVGTGIAATTFTLSDGTLVDSQGRGCWWTPPTYTLQCDEGQNPSTGFAVACDGSVSFNGQTTFYECISGGADGTYNLYLGPNGFICGEVTLSADSCHESCPKTSAAPPPPPPVKTQTPPPPPPPVKTEAPPPPPPTTKTASSPSGSCPTTLSGDYEFPHLIIPLDSSNPSSAPSSSLFGEVSSTISSVFNFDIPYSDSGKTCSLVFLFPEQADLETSSYTFSGSGGVEFWKLSSPAVEGKTSYDNCPAPSGSLGSATLAPGNSYVVSTFACPAGERIGFEMTAEGSTSFRYFQDYNPSPIGLYITVC

SEQ ID NO: 977 - protein, 2883 aa, Unknown
  Kingdom: Fungi, Phylum: Ascomycota
MAKHVTSTASHATFGSGTDFRDDSHFTTGGMADRSQVDCNQEMTSFLDLDSDSSGSSNHPSPIEHPTPLQPRPRKRVEFREVEERHVHDTASECDFFTSKIASGVTDDTDGPAAVAMAMANPSLEVPPTVGDAVRAMLDLSDPSTESLSPPGLVMSTSPSGSELNSSGASDRSRTSSDPSNGYEQERAPIYDDGLLAASPKEEDGHQLEQEVVKPGNPQHQELEGLLRSLSQCDKACVLRPSRGPFNRQLVALIAYSQRGLDQRQQTKPQFNNDIDTAQATSPTINDDIEACSSQVNKVRTAMGEWGGDHSQPDIWIPLESMPTGANGADVAKLQVWLETLDRNTENAVMSMQLDAPKPRPLESVMAAKRMPLPSPTQLSMLLVDNTFDNDESQNPIIEHTEDLAKFPLSAIQRLFFTASRNRSKVGKSSGSDQRFSQSILLQISSEVDPTDIEVSIEALVARHSMLRARFKVSGDSFAQVIVPDSSNDVFRFGHRHAVNDNDILKFIEQSQASINILRGPVFAADHIRTADGRELLYLVAHHLVVDVLSWKIILHDLEELLRSGRLPSQGSLSFPGWIKYQIQEIIDGLMKPALPFEIAPVNLDYWGLEKQHNTYGDTHRHMFSLPPGLTKSIQARCNRAFRTETADVFLTALLLSFHQTFSDRPGPTIWKQEHGRDSNNRELNVAHTVGWFTALCPITIAVGASTDFIQLLKLMKDTRRAVPRHGVPYFNSEFFSPVHTELANLPVEIMFNCVESIPQLHRSGGLLEPVSPPNHDVKSLISDIGPAVGRIALVELSVVIDADGAHVETVYAQTKHQARIQRWLGKFEETLIDAATRLKGMDPQLTFSDTPLIKTSYAGLAKLGSELLGELGVNSADEIETVLPINPMQEEILVAQALDINSYHVRGVYELNNPKGEPISQGRICDAWRTLVCKHVALRSIFIDSVSENGLFDQVVLKKISPNMLFFDSENIEEAVVNLPAMKFFRGPQPRHRLSVIRSSRRTLLCLDASQAIIDSRSIVNLVTQLGQLYAGQDFTVDCSLLTTYSSNISIGSSDHLQSMMRDLKGVKPCILPRLGDGSQQLQDSPVFELEMTRKKLNDFCRYQEVEPSVVVQLAWALVLRIYVGTDEVAFGCEHPGRDEDALPGITNAIGSFSAVFPCKVDLCPGRTIRQCLKALSLFSASVTGPQDLTTSRIEHALDLKGQPLYNTSLSFQHCGSSIPESNSHGLSSSLWSSSSTMDSALSLHAAFLRDNLHVSVSSREISMYQMRNTIRSFEQALNTITECPMQVVSDVDLFTDRDFAYLAVQDWEGFAEESKPQQCLHQVILQHARTRPNAMAVAAEDGGGMTYHQMSRFVSSLAMHLVNLGVRPGVVVPVVLEKSWWAPIIILSVLQAGGAFVCLDSRDRDGFETMAKQLDPHIIITAGEAAWTAGLSSMTANVIVVNNSFFSALPPQLSIPAQAPTPDHAACVLYSPATGRKTAPRSIYYTHASLSLAFMAQGPALKMDGTSRVLQLSAFGTDIALVEVLGTMFHGGCVCIPAPSERGHNLENAIIRMKVTWTYMTSVLIRKITPKNVPSLRTICLRTRHLEDDIREIWQGKANVLLAYGAQDVCPLAISVSEAVGEHKVAVISPPLMGKYWILNPENPKKLMPVGAIGELAVDSPALTPHKFTPGGGSLVARSNPSPAASSDKPRPRTLRTGHRVRYLDDGTIEFLSSVRDEIAIGGETVPRFEVESRIRRCLPENVDVALEAVTTSDSSKQVLVAFLEVRDNNLRSEFEKVSMTTEKRAAVVKKLLENPGASSTEAEVHFGHQKIAERHVPSVFIPVKAFPLSASLKINRRKLQKMVSSMSYNQLLQMSTTPSLDKHTTGMLLEKPLPLTRVEEKMRFIWAKILRIPAADISNQDSFPGLGGDRFQAMQLVKACRQEDYAISIKHVVNGAPLSKICRPFFDIGPNPREPSAFASPLHVHDQASTRVPPASGRSPSKVAGLPEIFVKEVLTPQLKQYRHNIADAAEASPHQVHDLEGYLYKVKTNLRWLVLDFNGPIRHQKLEAACLALANLHPILRTAFAVHERRVYQVVLDSFRPEFTRRTCALADLTGETRRIADYDQAAGYKLREPITRFYFLDAVHQGTLVVRLSTAQVDHHSIAHLVQDLAALFKDPGASLRPWSFLDYVRTVKFSNHQEGLDFWKSQLDGAWMTQVVSHATPPVPANKIKRLRKTFKVQSLAEFGLSFDTVLKAAWGIMLATLSGSSDVLFGEAIHGQNISRPTNVDISSMVGPVTNIIPVRIRFPAVHTSPLEIMQAVQEQRTSSRPYETIGGLDLVQKCTDWPYWTRFSTVVEHRPQALVDELTTLTMGNTTFWYHVIEPEAMVVPDLRAQTTMHGPEEVHLELTYSESHVPQSLADNVLMLLTTNIEMLTKRDPISQPLLKPAVVARQSFDSTQWVDDERRLQLQTVIQAAWTEHINPLALGIAESQVHRIRFYEVWGSLLPATFFADHLNRELPKLGIRGAEHLIHFTADEMIDNPTMQMQYDLIVSKMRDSGVITEPIKKVSVSPASVPSADQSPWLTASPSGLLAWRKSIRKIRNLEGRPSSRDLGVKASGWMRHKVSSSHDGTTTLGRTPIAEDDSQETSSPAATSRRSLDSPLRSTSRLSLPIPRREQRESPSSSSRQPKNNDTPSSAPSSLSHRALSSQLTPSRSGSLRSQNSPKRSSTINEAITAASSTTTNLLRPNSFKSKAKPSIPPPSPPKTLPTIPSRITTPSPLNIPNNPSLRQPPPPPTPTNIHPARRNQVYTSLLPRIDASLNNHRTLDPITEPIELGGREITRERFEQLEADRTNGLLIGPHGKITAELDATPARAAQEPEEGDIRIALEEEQPLRGNMA

SEQ ID NO: 978 - protein, 84 aa, Unknown
  Kingdom: Fungi, Phylum: Ascomycota
MAETHTYEFNVTMSCGGCSGAIDRVLKKLDGVESYEVSLENQKAKVVTGLPYETVLEKIHKTGKKINSATADGVEKSVEVPAAA

SEQ ID NO: 979 - protein, 528 aa, Unknown
  Kingdom: Fungi, Phylum: Ascomycota
MLPYDAQSVTQTTTGSEIPDPGSPPVLSQTCHCEERLAAVESELAELRSSVRELRHRTVSGITRTESSSQNPPALDPEHEPPRRASDDTAETATDPPVAPIRVIRKMYTWINGDHEGPQDSIDLPEQVKAKLALKGLGSRLIEVSRKSIPRLHFIQRALDKSVDGEYNLLSVTCLLAGMQVNPSISNTELHTSLYATLKSGLARVVLETPLSLPSLYAMLLTCMLNLNLGYSNTFIDAWLLSGSLILHLTLLLDFAAHRQAPTALWLTEDVKARILTWNSTCLQHLKFAIGVGQLSSVRMDLAAHYIDVVKSSDHFQGTDKEVVAELELFILLYRGIVEGDVLARRFESGHLQWRSNNLSLRYSDESMALRFASLTFTLLANRWELSQLRQEEIESAAGNRLYDRHIKPILESSQEIIRLVGNQTRQQSLLHTFDFLISAYAHVTLVEFSDHLVDIGETLRLMEEMQSLRKGVYVLEPVSRWATDMMRKRALDTVRSGADAQADALLGRDSCWPPFEALSSRMESTTE

SEQ ID NO: 980 - protein, 399 aa, Unknown
  Kingdom: Fungi, Phylum: Ascomycota
MSSSDTPSTNPPPAAAAAGAANTPSSASLSGKVIVLTGAASGIGLATAKLLASHGATLSLADNNAALLSTAVKDILASNPGASCFGTVLDVRSRQQVDAWIAETVDKYGGIDGCGNIAGVIGKCQGSQRTWEITDEEYDFIMDVNVRGLMNCLRAQIPHVKAGGSIVNASSICGLVGLPLCSVYCASKHAVVGMTRAAAKELGPKGVRVNCFNPGFIATPMLSASIDSMDKGVTPSSVAMQRLGKPEEVANLIEWLLSDGSSTETLIRISVCIHRKEGISEEDFHRYWAHEHGPLAAEWLKRCGIVKYVQYHTSSEHRSLAKKMADAVGRPVLDWDGMADFYVRRYEDFEAAFLDSEYMERIRPDEIKLIDMDTVRLTIGVDFVCINDGEVVEQHQKKF

SEQ ID NO: 981 - protein, 490 aa, Unknown
  Kingdom: Fungi, Phylum: Ascomycota
  misc_feature (64)..(71): Xaa can be any naturally occurring amino acid
MMDNNKISESVPPSGQPREVELHSSSMQVNVAKEPSLGSAEHDKASDDAPEHFEGGKEAHLQAXXXXXXXXNNVSNAYVSGMADELGFGPGNELSWMNTYFLIGTIVGGTASNMILTVIRPRFWLTGCLFVWSLFVLFFYKCHTAGQFYALRFCVGLCESGAWPGLHYVLGSWYRKSELARRSSLFVVSGVLGQMFSGYLQAALFSGMEGKGGMPAWRWLFIFDFCLAIPVVIYGLLTYPDTPHTTKAFWLTEWEKKRARERIEEEGRAPAGKMNWSVLVRIFSSWQVYAFTLAYAFWSLSCGSYIMQYFALYLRWTKDYSVPEINNIPTAIGAVNFVVMTSSGYVADKMGRRGPVCFAVGCVWIFAYAILSAWDVPHGLRMAAFILVGVYGCYTPLLAGWVNESCGADQQKRAFILGWMVSVGYAVTIPFQQYQMPSGKAPRFAQTHGWPSSLSWVAALTLLTGVVIPWYEKRVKRRAERSAAGGTAEP

SEQ ID NO: 982 - protein, 270 aa, Unknown
  Kingdom: Fungi, Phylum: Ascomycota
MVYAILPALIPDIEKVYDVYFAAFKNDRMGRFMVDLLFPHGTDSDEFRKTHAAGTLAWWHTCGVQYTYKCVDTETGEIVGMALGDILLTGRTEEERKFQSVGWLEGEQREKADKVLKPLHEAREKLFGGRPHIYVHVIGIHPSHQGRQAGALWCKWGMDLSDSLGLPLYFEASPSTYKLYEKMGYETLDDKIVHSAALMGTDAPVEVPLMVKMPRAAGGLTFKEWRAAGYPAAFGKSKDDAAAVQTLPRRGADKAVGQVVVVTEAREAAA

SEQ ID NO: 983 - protein, 841 aa, Unknown
  Kingdom: Fungi, Phylum: Ascomycota
MASHGGNNLPFGSELKPVYAGIAFAAIGGACLYPYIVRSIGQKDDQPGLLRSFILFFYSCFIKPHQGDAKGNQQDALESFYKKQAGAYDATRKVLLRGREDMLSLVAAQLEAKATETKSKGKPKRVWVDIGGGTGFNIEAMSEFVNVPEFFSSIYLVDFSPSLCEVATRRFERLGWKNVTVVCEDARKFRLEDYENGLPGSQTPLRSPALSYFTQRRPEHGGADLVTMSYSLSMIPDYYSVIDSVTSLLDRNGIYGVIDFYVQNKADFSFRNFTGGLVDRHVSFLSRTFWRSWFDVDRVALEPGRRDYLEYKYGTILSANCRNRGLGYIPYYIWVGCHKKPFSPSSLPHEIIERIDALATESPYLLPANQGDALSRAIERSAPEIRSKAFLTAVQNLSANLPLPSFFYQNHHWRIYYDDQLQKHKQFNDEYIYAFTWEDARVDERILKLGPDDKVIAISSAGDNIMAYLTQSPARVHAVDLNPTQNHLLELKAAAYTALSYEDFWLIFGEGKHPKFREILQTKLSPHLSSRAFQYWLKNVHVFQNNSGYGLYDTGGSRHAIRVFRWIARIFGLQGAVNQLLEAPTLNEQREIWRTKIRPALLSKVVCNFVVAQESFLWAALGVPKNQLAMIEGDHAESDLVKGPSPQAKNSRSHAIWHYMVNTLDPVAEKTHIGADNPYYYVCMAGKFSPKCHPEYLSPQSHAKLSRPGALDGLRIHTDELEEVIARIMPGTLTVAVVMDSMDWFDPGSPAAAAQITKLNRALAMGGRVMLRSSALNPWYVKVFEDHGFTPKRHGARIDGACIDRVNMYASCWICTKVENLPPPTPEMDNMGGNDMPALTI

SEQ ID NO: 984 - protein, 471 aa, Unknown
  Kingdom: Fungi, Phylum: Ascomycota
MSSNEKGNSDGIMPAPSRNSTSSNDGGTKVENAEDAFEVFKRGEGNVDFRTVPWWHASMIFLKLIFATGVLTIPSAMFVLGALPGAINVLGWQALNTYAAIIQGNFRNTHAGCHSIADMAEKVGGPWLREVVGVLFLVTFAIVAASGIFGSSVALNALSNHAICTNWFMLVATIAVFMLASLRKFEKIAWLTWAGFLSVYIAVFVVVVGVTTRDRPAAAPQTGDYEFGYHVIGHPTFVAGITSVATIFCSGAGTSAFLPVISEMRRPRDYNKAVYLCMGIVTASYLTFSLVVYRYCGKWVASPSLGSAGDVVKKVAYGIGLTGLLVSACLYVHVAAKYLFVRILRDSEHLQKNSFVHWGVWFGSSLSVSVVGFLLASGIPIFNYLLALAGSLTFSPLALGLPGYLWVFDHQHYRTGTVLQKITYWLHWGMILLAVFLTIGGTYGVVQQIIDAYANGEIASAFACADNSNSS

SEQ ID NO: 985 - protein, 508 aa, Unknown
  Kingdom: Fungi, Phylum: Ascomycota
MGNVDANKGWVVQKFGGTSVGKFPQKIARDIVKASLSSNRVVVVCSARSTGRKAEGTTSRLLSVYGKLRAVGAFTSSEEEQNDLIDEAKTLIQDICNDHVLATEAAVEDPKLKAALSERIKAECQELIEYIHAARRFNLEINSRSKDRVISFGEKLSCLFMTALLKDFGVDAEYVDLGDALHYDAAAQLDAGFYATAIQAFVAKIEACEGRVPVVTGFFGNVPGSLIDGDIGRGYTDLCAALCAVGLKAEELQIWKEVDGIFTADPSKVPTARLLSSITPSEAAELTFYGSEVIHHLTMDQVIRAEPPIPIRIKNVKNPRGNGTIVIPDPVLSAAHQLQRSRRDSAVSERYKKPKRPTAVTIKDHISVINVHSNKRSISHGFFARVFRILDVHSISVDLISTSEVHVSLAIHAGSTQVDAFLHARKELEECGDVSVLSDMAILSLVGAEMKDMVGVAGKMFSTLGEHNVNIEMISQGASEINISCVIDARDATRAMNVLHTHLFTFLE

SEQ ID NO: 986 - protein, 374 aa, Unknown
  Kingdom: Fungi, Phylum: Ascomycota
MVETRKHSGEEKEEENATTGDKHQTGHDSPDPKRTKVEKQSTIEESMGKANGDTDGKKGDASTEKSPKGDTETKDSSRGAEKDDHKSSNGSAEKPTAEKDVPSNILEKGIIYFFMRGRVDIDSPSSVDEIQRTHIVLRPIRTDAKLGEGPIGDAGNSRLLALPKKVFPQSGRDRFMLFVEKSGASFENLKKEFLDGNDYETKTVGSRHTPAATPVGEGVYAVTSTGRESHLAYMLTLPEELGKVQQELGLKEKGSFILSTKNPEYKGPANAQLPEGPDFSKKIMEDFRKRRWMPSEPEHLDFPNAQILLVGESSGIDKAVEPQDKDKKDPEEILEALEEEDLERMKHLGGDDSAAIFKDLEVRAKDYPKLQTTF

SEQ ID NO: 987 - protein, 547 aa, Unknown
  Kingdom: Fungi, Phylum: Ascomycota
MASRGRLTGLLRAPTRPVPAARLCCAAVQKQVPKAATRWIATSSPKLLSQSAIRNAKLTAETYPELKRDERFAQVTPEHVKHFKALLGESAVSDGVNADAEADLEVFNEDWMHKYRGSSRLVLKPGSTEEVSKVLKYCNDNLLAVVPQGGNTGLVGGSVPVFDEIVINMSRMSKIHSFDEVSGTLVVDAGVVLETADHYLAERGYIFPLDLGAKGSCHIGGNVATNAGGLRLLRYGSLHGTVLGIEAVLPDGTIMNDLGTLRKNNTGYDLKQLFIGGEGTIGIITKVSIQCPQRSSAVNVAFFGLESFEKVQQAFREAKGQLSEILSAFELMDARSQKLVQDVKGDKQPLDDEHPFYCLIETSGSNGEHDYAKLESFLEDVMTKDVVSDGVLAQDASQAKALWGWREGIPECLGHWGGVYKYDVSIPIKEMYDLVEDTRTRMDEAGLTGDTPDHPAIAVVGYGHMGDSNLHLNIPVRRYDPAVEKVLEPFVYEWIAKRNGSISAEHGLGLAKKNYIGYSRDETMIGLMKQIKQLYDPNGIMNPYKYL

SEQ ID NO: 988 - protein, 342 aa, Unknown
  Kingdom: Fungi, Phylum: Ascomycota
MPTASTAGMLSLNNVGSLTTTFTAPSSCTTAPGFVISGLAHPQLEGNLVYAVGLCGDEPDFPKDCLPNGEEVSKVWESLDTTESATVLNYYSPGLHCPDAWATVGVYAPGHHSNDSTTTAAAEPGIFSPTAFNNGRPGDSTSFPYADFIANMFTSALASTETAVVCCPSGFSVDPYAGCFSNFPVTSLADKTGCIRSVTGGEGISQERTTYTYEFWGDTTTATQNNIELPTETEFYSTVTISFDGSGFPDVTDGLLGPRPTGDDASELQGVAVVTPLFLVQDGRDNDGGDDENREDEDNQDEDNDDGNSDDNNVAGRLSPVAGVLAAWGLSVAAGLGVLVAW

SEQ ID NO: 989 - protein, 347 aa, Unknown
  Kingdom: Fungi, Phylum: Ascomycota
MVQNKTFVYKKIPTEFPVPGEHIVVEDRPIDLEAPLAPGGILLELQYASFDPYLRGKMRDPNAKSYAPAFNVDDAIVNTCLGKVIKSSNDEYAEGDLVLGFVGIAEYAVVPDPKARMVRKVQNPHNLDLGHFLGALGMPGLTGWAGLHKIGAPKKGETLFVSSAAGAVGQVVGQIAKREGLRVIGSVGSDEKLEFITKELGFDAGFNYKKESPKDALPRLAPDGIDIYFENVGGEHLEAALNAMKTGGRIPVCGMIAEYNIPADKRKGLQGIQQVLTKQLKMDGFLVGNPEFGPAYFMEHQQKMQEWIADGSVKALLDVTEGIDNAPTGFIGLLKGENFGKAVLKIR

SEQ ID NO: 990 - protein, 271 aa, Unknown
  Kingdom: Fungi, Phylum: Ascomycota
MSSHKSFFLLALCLAPGIYAAPERNCKRALQARATPVTVTNTLPTRSIVSPEDAQCTVTYTTALPSLCTNAAGVETGVSDHTYTMSFGCDGSAGSPCVLPASPEACPPGFKVTTTVCDTCAGGPVTYTLTVPDTAAATATGQSSSGKPHGASGSEHDISVPGEAGKPKVPGPAPSSVPEDAKGNAPASSPETHPDASSSEGEQPEGGDSKGDNVGGTGANSGSGSGSGSGSGSVSGSGETVGVSAASSVQSDILKAVEILLVSAIFVGINM

SEQ ID NO: 991 - protein, 798 aa, Unknown
  Kingdom: Fungi, Phylum: Ascomycota
MAPTCADPRQVVIALDPEQRRALWQLVKEACTHMKQSLQPTSDQQFGSVVPKDEVQDDRNKTSNTGNDDDTKRPPRTQPQKPDEDDDVEDVEQIKEGLAISRAAVCHLEEWASEFLPRLKEILQVKDDNKIIGERKKRQEELRKRAMDTADEGEDLMSFSGEVKINKSDDLHRLQELYKPFQNSLVMLPGADRREAVGCILLLLLSTGKYSAHSRALALYLASSLDLPTTFINNEEGEIAKSLMESGTADDAKKKSMSAEAEAAKRREENKVSRFWKVGVASVLGATVIGVTGGLAAPLVAGAIGGIMGGVGLGGVASFLGIFWMNGALVGTLFGAFGAKMTGEMMDQYAKEVEDFRFIPLHPSSDLQPHPSGGDKQSLPRNERESPSDDPPPPTDDRRLRVTICINGWLNSERDITTPWLVLPHSTEVFALRYELAALLALGSAMRDLVSSLAWKTLKSEIIKRTVLASLWAALWPIKLVTAASSIDNPFSRASNRSRKAGELLADALINRVQGERPVVLVGYSLGAAAIHACLQSLAQRRAFGLIDTVVLIGCPAPSTSSHWRTLRSVVSGRIFNVYSENDLLLGFVYRMHSLALGVAGLQPIKDVDGVVNIDLSDRVSGHLRYPDLTGEILSQCGFVGVRAKGDIEKDDVIRMKDEQADEQLIDFDGKGEEVRPKNERTESGESKFSDDLRELSISSPPPYEKETPPSLPRRPTRSISEDEGPPPALPTRPSSSKQEPLRRKPVAYREEVRRRPLTPETNASDDEEYRTISMVDNDSDDEHEEHEQKGTKRTLRH

SEQ ID NO: 992 - protein, 349 aa, Unknown
  Kingdom: Fungi, Phylum: Ascomycota
MPEPSVWLPAAHSSAARRHALIYFICGNPGLIEFYRDFLTYLRGLLDGGDHSGSTTAYDIFGKNLPGFQDEDHEPFSPTNPPFHLDVVIEKTYDDVISRRRDGGEEYDEVVLLGHSLGTFISVEIFQRHSVQGKSRAAKLSLSHGLLLFPTVTHLALSPSGKRFTFVMSTIPLLERYGHIWARLLLRLVPAKVLTFYMTRALGFTPRAAGTTAGWLKSRDGVWQTLSLARDELVMIAGEDRWGEEIWEAPQQQEEDGEQQQQQQQQQRRRFFMFYAKKDHWIADHVRDEFVERMRRRGEEGEGRKGRVPRTEIDEGGIRHDFCTKDDSSLEVAQRVSGWIGEIDQARRS

SEQ ID NO: 993 - protein, 585 aa, Unknown
  Kingdom: Fungi, Phylum: Ascomycota
MSIESRDTLVRDSESGSLHYDTTVSDTVPEETRTTAGVDNINLSAEFLQVAAAKINSDNSLYDPDNLLFTQEQPPPLELPEQIKSNGSGRDQRLRALPPLSIQDDVLPHTATNSALYETAWKDYCVPALPPILKYVVNSISTLPAVIRWSALALSASRLSRLQPQNASNAAQSPQLRPNRTHWIASQQFYCSATREIVSWEPADKRQDVSTMIQAILLLCCLESATGNFEVFRLHSEGIQALIKGGIQAILSVDLESGIRLLQAWAQTKMHSWWLRCHFNTPRFLLSDVSFRVEPQLHAYLSVKNTRRTSVMVNLCESYRLGLSLIIRQLNSIELHALGLVSQGTVAADELLSTIGLARDEDELRKQSRLLSSWLSHRADSDLPFDTASDTDAVTFPSSNLSIRPLLFNTHAAAMNYAYYATARIIQAASGVKSLCSSTLETSNNPKDETAHWSLLLLRIAAGLQWEKCLRLNTFSIGLSGLLMICSLRCPDPHVSRWIQSWVELHCSGENSEEGSFPVSQVRRILSLLNEERANGFDVVAVFQPNEDEGRKGKALSYQNQSLTSVRLLCRSRNGGIYTVRHRTM

SEQ ID NO: 994 - protein, 1455 aa, Unknown
  Kingdom: Fungi, Phylum: Ascomycota
MSDDKFGPQLPGIFDFTILFEQSIFSLLPTCLFIALAPLRAYALLRRQTVVPTGKHLWLKALAITIYTALQIALLALWCLPSTPKTKTSIPAAILSIFEGATIFVISYNEHRKSIKPAALLDGYLLLSLILSVAPARSYLLRSDIPRAIAGVYITALVAKASLLVLEELSKKDVIEGAAPETVAGVVSRGVFWWLNKLLVAGARNVLGVDDIEAIEPKFDSRQLLNRLERAWENDAKQGKWALMKTTFLAYKWQFAAGILPRLCFAAFTFAQPFLINSVVKYVGDPPGEHHKDVAASLIGATVLVYVGMAVSNALYHHLTYQLLTMYRGGLASLVYKKTIALRTTSIKESAPVTLMSTDIENIVNSGDAIHDIWASFIEIPVAIYLLSRHVGVVSLFILVPGFITSGAGALISPAMGPARVVWNKAIQERIGSVSNMLSQIKGVKMMGLTDFFHEKLRRSRIHELKLSVRFRWIIVQLNALAMASEDLTPVIIILAAIFWIKSDSGLSVAEAFTSISIISIAAQPLTNILISIVQLFGAIGCFTRLQEFLLLEEREEQREMAVSRFPSPPSTAGQATLRAEDGKDIDSVEKANDSDAIVAVSIEEASFVVGEDVEVLHDISIDFEAGAISMVVGRVGCGKSSLLRAIAGELAMKSGRIVSSFSSMAYCDQTPWLENRSIRDNILGQSPLDEKWLATVLEACALDEDVRMFPLGDLTLVGSGGVSLSGGQKQRVALARAVYSRKNLLLLDDVFSGLDNTTSRAVFQRLMGPSGLLRQSRATVILATNHVHFLAAADFITLLHEGKVLRSQVSYDSVDPSEWGVLDSDSDSYDSETEDRQVDDEKEQLKAQLSQKDALPEPKTEADLSRQTGDMECYKIYFKSLGPSVLAVFFAAGITHVAMQKMPQIWLRLWTEKGTGAKDYGYMGGYIAFALISTISGAFCLAYFVVIGVPKSGNRLHEMLLTAVTRAPFYFFTSTDNGITLNRFSQDMNLVDQNLPLSFFNVSILSLRALAETALVASGASYVGLAIIPGALALYLVQKYYLRTSRQMRFLDLEMKTPLYTQFTETLAGLSTIRAFGWSEAFLRDNHARLDVSQKPFYTMFAIQRWLQVVLDLFVAGMALVLVTVALHVPGDAASKGSIGLAMVNLIGFNQTLTLVIDQWTRLETSLGAIARLKWFVRNVKPEDREGECEEVPPEWPARGAIELTNVVASYSDGMESVLKGVSVSIKPGQRVGVCGRSGSGKSSLVLTLARLLELQHGDITIDGLSLSRIPRQTIRSRLTALPQDAMHLSGTVRHNLDPKGMFSSSTTTDIEPKTTLSPSGDDALIAALSKTAIWPAIEARGGLDASLSDLGFSAGQLQLFCLARALLSTSSIVLLDEATSSVDRRTDDEVRRAIRDDWAGRTVVEVAHRLELVRDCDVVVVMAEGRVQESGPPDELLARPTSAFRALWESQGL

SEQ ID NO: 995 - protein, 482 aa, Unknown
  Kingdom: Fungi, Phylum: Ascomycota
MPIGNPLRFPESRMLGATPDRSQTTVQCQFQSDSQPDLQTSPRNTSAVKMVTMKVLGLNCGTSIDVQRIKKVLGIDVALCQISSKPSSGDVSIELLSYTEVAVNPDLRAQILRLCRPNQADAGTTLAEICDLNFALGRQFFRAVRESGVDLDQVDVIASHGQTLWHQPEGDHRSTLQMAEPAVIAHDTQKTVVSGFRVAELAAGRQGAPLAGFFEAGLLSHPEKTRISQNIGGIGNASVLPATNLKTSMPASTYVAFDTGPGNVLIDAAMRIISNGELHYDHDGTLGIEGEGSINSAIVDRYLDSEPYFQAPLPKTTGRELFSDDVARKLVEEMQGMGMVPAAIVATITRITAESIARAYKRLVMPLLGEGKSIDEIYICGGGAHNPNILKHLQAEFPEAQVMKLDDAPMKLDPSAKEAVLFALLGFLAVSGRRVPIAGCAETTSPAILGVITPGANYHQIMKSVVADEDFGSDRVLGRIIM

SEQ ID NO: 996 - protein, 785 aa, Unknown
  Kingdom: Fungi, Phylum: Ascomycota
MHPFSVLTLGIFVAGYITARWDLVTRLYELAIFAWENGVVTRAAKGFVALSGLFLTVFIPVLLLARKETYLSVMVEHDGLMRVFWPTDVPKSDSPGVVVGWRNSVLDVFVVAILDHVDPRDVEYHLRAGTFFRSAPHPPARIYELCGHSAMHVLGVANSPDPSTADPSWVRAVTQPQLRVPKISCAKASSVQLIMYDRPRPKGMQYISLNPIALALGDKGSTLEDTKVDGDEDEEEKYERKMRAEKKKLVEKLKLHTVVKRIPSARDKALPKIVNQVNWSWELDRTLQKHVGRLGPRPKRSLSVSERMVESATTMRNVVVTQAWDIFTVYLFPIIRRTFILVLLGHRMVAEMLLILLEFRAKPGYAALKDISATAQQIEIRLQQFCYWPMQYLTLRQRKRNWASVTTSHPDYIRFYNSLWLVANDVIIGIAVGSYIIEHADWVASQISTLLRTYTVEALQRSISWLMGWPAGLKLNGELAAFLGDLFLWVIEYWSNCIEMLNPALPKVVWFIGFSSFAGASMPIAMFSDLLSALTIHIYSFYLASARIYHWQLTILQSLFHLFRGKKHNVLRNRIDSCDYDLDQLLVGTILFTLLFFLLPTVVVFYLNFAIARMVIISAKAGFDTLLSCLNHFPLFALMLRFKDPRRLPGGIRFELKDSTERPTPNSSIPDDLPTSTIYLKSIPLNFRAMFHQYFQMAHRIRKHYLAPRVLLCLITGKFVPPINRKNLYSLQYSMLPARRASVWEMWAALTAEDTEKKEGKFQMPYIPPLANGAPRRYGNGRGRG

SEQ ID NO: 997 - protein, 198 aa, Unknown
  Kingdom: Fungi, Phylum: Ascomycota
MFNPRFLVVSLGNPLPKYESLHSAGHFALKGLAKVLRQHAFTEVTLGRQKCLVSQGPKYTLVQSPTLMNVSGPFVARIWQEMARQTDPASLSLVIVHDELEKDLGVVRLTPWDRSPRGHNGIKSVKKSLSQDKYPQSPFARIAVGIGRPEARDAATVSNYVLAKMSSDQRTTLEETAPFDVAKRLVELEAEWRAQVEG

SEQ ID NO: 998 - protein, 229 aa, Unknown
  Kingdom: Fungi, Phylum: Ascomycota
MPTNADHDRKYKYAEYVPDAIHFTRATLTRDNRITPLLRIMTSNDKQLGKTEPRVFQSRWKSPLTGFENEPPLPNDKAEDGKSFVNPPREGLSSSYERFEDPLENGRRGGFDVHIYYFQGNKEQTQYAHELWERIRREFPELRIYKVWDGPVGPHPVAMFEVNIFTPAQFGAFIPWLSVWRGPLSALVHPNSTHIEGETLAERVVKDHTVRATWLGERIPLDTEPLMNL

SEQ ID NO: 999 - protein, 282 aa, Unknown
  Kingdom: Fungi, Phylum: Ascomycota
MATSSPAPPPPPPPQPPSEPNLTLEDHSEDTSPETYELANVHSVYSSIAPHFSSTRHKPWPLITRFLLSLTPGSVGLDVGCGNGKYLPVNRHVHILASDRSAELLALAKTPPLGPLERDGKGGGDEEGDEETKAERRSSRNKFTPAQLVVADNLNLPYRPSSVDFIISIAVIHHLSTRHRRVSAIAEMLRCLTPSPSSKCLIFVWALEQSSTSRRAWNQDSDQDTLVPWVMRQKGVPETTYQRYYHLFREGELEHDVVEAGGDVLESGYERDNWWVICTRKQ

SEQ ID NO: 1000 - protein, 556 aa, Unknown
  Kingdom: Fungi, Phylum: Ascomycota
MEARSLSSLNSLASNPPQYPVKPNEEKLDPLTLYILRVPGTRDVFLSPFKPQVKSVTAEDVASSLYYVHLRDPLEETQHPQADDNSRGRSSAQPSIHRKPLPSTARPPTPEATLEGAQAPLTSSATQLDQSAAHHDSRSGQRMTGTALSRPIAPTQPADPTDVSRVPARKPLGPRPMASSPITDFNQLHISSLNSNGHPASLPPRPQAESTQGCRSTEHRPVFDPGLNESVKTGSFSLDLIRRDRSSGGQWNVARISCQGAEISQVSDGAGWKRSPSPSKQGPRPAIDIIIENSGYAKFRHIPPPKMVEAGPAAIISALAERDSGRSSDHSSNVSLPFVDFGATTGEHGHGSLFSRQVTMGYTKSWTANVKEKLQKLEVEAISMTKSGHRRGDSTTSWDSFEPKSPPAEAGFESMRARGYTFLSPWNGRCEFRTGHAGRTLRLTQALDTGSSNGSPPPDLTEISELRFNLPTTEIISAAAHARDSQLLSQFGDVLRSRARSDPYRNEYEDDDDIDRPGRFDLSLGKERAGGGRRGNRAKMVAANIGVWWETWEKNF

SEQ ID NO: 1001 - protein, 289 aa, Unknown
  Kingdom: Fungi, Phylum: Ascomycota
MAKISISSHMAPRRAYIATSVCLLIAIVVAPWILQASWLQILLIYLAVNGFMLNGLLVFMALRHLQLIANRRLYNWPQLSTVDSPPADYFLFVLGSGGHTKEMLMMMDDGTSDFANLHRRYLISSGDNMSLDHMQDYESELRELCTQKGHESGAYDTRLVTRARRVHQPLLTTPLTALLSVLDIFPALLTSPTGVSLWPQRIYSNGPATGFFVALVAHLLRMFFLVPEDSMRFIYIESWARISTLSLTGKLLHYSGLADVFVVQHKELAERYGVRYAGEMVFNSRRMDT

SEQ ID NO: 1002 - protein, 394 aa, Unknown
  Kingdom: Fungi, Phylum: Ascomycota
MATDLELDSGRYSIVLVVFFVSYVVFEVPSNMVLTRVRPSLYLPGIMACWGAVTIGMGFTPNYHSLIAFRFVMGVFEAGFAPGILMLLSSWYKKEEQSKRFAVYISAAILSGAFGGLLAGSITGGMDGVHGIAGWRWLFLIEGSATVGFAMIAMWWLPDFPATTSRKKFSDAEKELAIRRLQAGSQSVRIDGEARMSPLQALKGSLTNWRTWVLVVGYMAIVGSSTLSYFYPTLNLGLGYSGRSAQYMTIPIFGVAFVSTALTGIFADRNPKWRGVILGCWMSVAMVCSVIICGVYNFKARYALLVIMASGLWASNGLALSYASVTFSTMPDEIRAVSLAFVNAMGNLAQIYGAYLFPSDDSPKYLMGFGVISGLCFTGVAAYLSLYFLLKRCN

SEQ ID NO: 1003 - protein, 251 aa, Unknown
  Kingdom: Fungi, Phylum: Ascomycota
MPQALKIGPFRGAAAPPSPPHPDFEQHHALRSDPDNTAKLSSPILLQRTVSYDAATKAPRRGSVYANMADKNTGNRRRRSSSILQVYHEPPETLEQINDQSSLPNLNANWTNAKGAWTIHIVLICCLKLFFDVIPGVSQETSWTLTNMTYMFGSYLMFHYVRGVPFEFNSGAFDNLNMWEQIDDGAQYTPTKKFLLSVPIVLFLLSTHYTHYDGTYFVINFLAVLAVIIPKLPFSHRMRFGLFNGGPPDDE

SEQ ID NO: 1004 - protein, 307 aa, Unknown
  Kingdom: Fungi, Phylum: Ascomycota
MSQRNTNGSRGLSWSASPLQPRRERRPGDELNTEDDDEVIGYHSSENSKPDCPASNRPPRLPSPSNESHLSERSGSPHEPRLGPRAAHDEDTATKALPFISRHALAQRLARIARQLATTTDEELPVDTLLLTEQVNQVELTLLGVPPPSPSHHPGKDPSLSQTSSLSNTLASKTRLAPRSQASPSGQAAVSATAAQLSEDLETLHHNLRARHEEATHIQAILLSRLELAAQRIIFLQRLAEDLEHQLRESDDELGHLRILLKALEIQVPEHPDEDLRRCLVRVQEEFWAVRKRRETLRRKISEDVAG

SEQ ID NO: 1005 - protein, 681 aa, Unknown
  Kingdom: Fungi, Phylum: Ascomycota
MPSPHPLQPLSIGETNLARDVIRAAHPNTVLKFRVIYLEEPSKAILAPFLDAEQAGEVTSTTPRPARQARVHFDTAQAGKPPQSHEAIVDLHAKKIHAIESVRADAQASFTVEELDDVRIICRESAVFQRRVAKFNLPPDFDFIVEPWPYGGLDAADDPNRRHMQALIYAVDTTKPDCNFWAYPLPIIPVIDAETREIIRIHEVSTGGGNDPLNIPEGELVNVSIDHMTPAEYVPELLPGGLRKDLKELNVVQPSGPSFSVEDSNVINWQKWSMRVTFNPREGAVLHNVRFDGRNVLYRLSISDMTVPYADPRMPFHRKQAFDFGDGTLGDACNNLQLGCDCLGVIKYFDGVLVDHTGTARETKNVICLHEQDNGINWKHKNWRSGRSVVTRRRELVVQFIITLANYEYIFNYIFDQAGAVTVQARATGIVSTVNIDEGKTAPWGNVVSPGVLAQNHQHIFCVRIDPAIDGHENTVVQTESLPMQIDARTNPNGNAYEVRTTPITTSGGFFANPMTDRTFKVQNLDKLNPISGQPVGYKILPPVTQLLLADPKSGQAKRAKFAQRHLWVTKHKDNEFYAGGRYTLQSSTEIEGVSDAAERNDDVVQKDVVVWSVFGLTHNPRVEDWPIMPVEILELHIKPADFFTGNPAQDVPGRKNFTSQLAQAQRPEDQASCCESKPRL

SEQ ID NO: 1006 - protein, 638 aa, Unknown
  Kingdom: Fungi, Phylum: Ascomycota
MVFPGLLTSADRSSSSRSKSSAEIDFQSEFISDDAQLPCVPPERPDLRELNNSLEALAAVFPDIQIEVFRELLSHFDGESRLALVADALLKNRVGWVQGRWKGLDAQGPAVPRGDTFRSKEYKQAVASLAWREFKGLSRSTINAVLAETNYYYLDARQTLVGLSAQSWRFNISSLLLRRKPVATGEAENHPLIVWRSTGRGSIIPTIRTTGHAELDRELYDALVKPLKERERQEREAKDRVLAVVLNNEEAEANDATHECTCCFTTGPFEEFTHCNREGHMVCFRCVQHSIKEALFGQGWQSNINHEVGALRCIAVEGNGCTGYIPYEHIRRAMLEEGQGPGILHRLDQRLAEHTVVASGLPLIRCPFCSYAEVDDIYTPPREAPLRVKADSIYQLFFIVVCIGTMPFFFSTLVISSLLCLILSTRQTFGDYIRAQWRQALTRHQRRRRGLRFSCQNPECLRSSCLSCHKSWSDIHVCNESSLVALRTQVEQAMSLAVKRVCPKCNMSFVKNAGCNKLTCPCGYKMCYVCRADLTEEGYRHYCDHFRPDGDPRPCAECDRCNLWESEDTEEVLRQARAEAERKWRDAEKRELSDGERAFLQTGFASQAADYSIERLILRGRIPSMAEFLDVVVETIFA

SEQ ID NO: 1007 - protein, 410 aa, Unknown
  Kingdom: Fungi, Phylum: Ascomycota
MNPSRGSNIPNFVVSGEPQQPHVLSNRLVLTPIAPGNQRGSLWSDSILAQSLWTADIEFRATGPERGGGNLNIWLARNGDKDVGSSSIYTARKFDGLALVIDTHGGSGGMIRGFLNDGNIDYSQHHSVDELAFGHCLYSYRNLGRPTQIKMRQTRETFRVEVDNKLCFETDSFSLPPGNKIGITAATPEDNPDSFEVFKLTVLSEGAGSYTGGNSNENANNINTNHDSHDSHRSDAGRSKQRSEQVDDDEAFEDSIPDEDPDIFQTSKTQFRDLHNRMQATNHQIAALFRTISKFQIAEGKNHEATINLINSLNSRLAGLDQLGELSQRVSDLEKEMRSMRNDLGRKIQANERNFKGMLGDHHATLSQTLIDSMPGHKRLFAVVVGTQVLLAAAYIIYKRRKANSPKKYL

SEQ ID NO: 1008 - protein, 604 aa, Unknown
  Kingdom: Fungi, Phylum: Ascomycota
MTVCKFYQQGNCKFGDRCRFEHPSRNQPQSNRFGALGSGASRGNNASLGQPDKYRLDFDNIEKDLTSEVPQWILSAYGPGREAPRQLFGGYPREQSFEEMRLHFLEGKASGNEQAALNQAQELYMDAQKQMQNAVRNLNDAVQYVVSAENEHPNRHDICREGTQGAPFGEFLVEKRRGPFASNAPATSNPFSTNSTPAAPSAFGAAAPQTSAFGQPSAMGAKPNPFATGTSAFGQPAQASQGSAFGQAPQTQGSAFGQPSTLGAKPNPFGTPAFGQAASATPGGAFGQPSQTQGSAFGQAAQTQGSAFGQPSQMGAKPNPFAANTSTASPFSSIGNNTASANETAGPFGQNQAKPNPFASPSSNNNAAKPNPFASPSNNSNAAKPNPFAASSTNNNTTASPFSQPAQQKPNPFAATSQPTAGAANPFASATNQNNAFAQTRGDSMQNAPPSVQPNTASPFAQAGQTGNAFGQPSAANPFASGPANQRAGTAVQAVQGAGPYPPGSSKQHPDGYITRDGFGNLSTFKGQRVIQKDGKPGVNIGGQFVKIWFPDGPPGYNKDTALPMEDYDPETLERWKAFEGTGQFEDGIMPELPPPREVTTWDF

SEQ ID NO: 1009 - protein, 487 aa, Unknown
  Kingdom: Fungi, Phylum: Ascomycota
MGATNTLSRWTLAVARPWAAPLTVASLCRQASSSAFSREAKNDSSKERVVVLGSGWAGYAVARSLNKNKTSRVLISPRSHFVFTPLLASTAVGTLEFRAAIESVRRLGLDQFHQAWASDIDFNRKTIHLEANLNPDAGSRTVAPLQKGPEFEVQYDKLVLAVGCYSQTFGIEGVKEHACFLRDVGDARNIRLNTLQAFERASLPTTTDEQRRKLLHFAVVGGGPTGIEFAAELHDLVHEDIEKLYPGLGDFVSITIYDIAPKVLPMFDQNLASYATDMFSRQGIKVRTEHHIQRIRRDGDILLLNIKEEEQEVGAGIVVWSTGLMQNPLVSHLTEKPIDGIGQLAKDPKTGSLITDGHMRVQVRNSSGTNEALPDVFAIGDCAKVDGTSLPATAQVASQQATYLAKRMNKGDIEDGPEFKFRNLGSMAYLGSWRAIHQSSADELKGWPAWVLWRTAYLTKSMSIRNKLLIPVYWFVTWVFGRDISRF

SEQ ID NO: 1010 - protein, 94 aa, Unknown
  Kingdom: Fungi, Phylum: Ascomycota
MTASKRVFFIAHGGRVQGVGFRYFAQKRAKEYGVTGWCRNTPDNKVEGEAQGDDDAMSKFLKAVDEGPSHAKVVQLTTEGRDVVEGESSFEIRH

SEQ ID NO: 1011 - protein, 279 aa, Unknown
  Kingdom: Fungi, Phylum: Ascomycota
MFLPFALLSLLAPAAIEAAVGRTPPCAVQAPKKEFLDTLHGFRVQEANATAMALVGRAQAQVNTYVHIIAEDRTYQGGYVDKNTIDAQIKMLNSNFASTGFSFVLRDVDYTVDPYYARLRSYDDEWYLKKSLRKGEYKDLNLYYFVSMFTRNTGWCWYPTDVNNGDSNFVRDGCVMHVGTMPGGSYSPWNQGKLTSHEVGHWMGLLHTFEGGCGGGDYVDDTPAESSAAYGCPTGRDTCSQPGQDPIHNFMDYSDNACQSEFTTGQINRMWSWWNYYRA

SEQ ID NO: 1012 - protein, 501 aa, Unknown
  Kingdom: Fungi, Phylum: Ascomycota
MDKDQIEARRRSIADDVEEISKTHVEVGRENIHSSLPPHESYEGHHRFDPNFTWTAEEEKRVVRTTDIRLMTWLCVMGTTIQLVCFLAAEFPVQFLTKRYGFKRVLPTLMCCWGLVSTFQAFMTGKSTFYATRALIGLFEGGFIPGVILMATYFYTTKELSIRLAGFWATLNVARVISALLAAGLLEMRGIHGRPGWFWLFLLEGLLTVVLGLISFIWLPTSPVGTKTPLWRKPWYTEREEAIMVNRILRDDPAKGLTAIKEPLTVQDIKEAWSDSSVWGLFFIGLIAYIPATPVQAYLTLTLKRVGHFTTLESNLLTAPSAALQIITMFTLAYSSEYFNEKAFHCFFGNLWQLPMFVSLLTIPDGGREWGRFTLITMIAGYPYFHPIVSSWISQNSFSVKKRAITAATYNVIVQMGSLVGSQIYRRWDAPYYKTGNTVCISILALSLVTFIVQRQWLIHLNKRKEKAWNSMTPEEKVLYQTDQEARELDGNRRLDFRFAY

SEQ ID NO: 1013 - protein, 496 aa, Unknown
  Kingdom: Fungi, Phylum: Ascomycota
MKPGLLQALALASSLTATSAISLQKRQDGAPKVMHFDVEKRTVSDPVSHDRRRLGRRDKTLGLTLNNDQTLYFIKASVGTPGQNVQLFIDTGSSDLWVNNPSSRLCTSRGNPCSQTGSYDPDKSSTAKLVSQNFNISYADGSGASGDYVTDTLQLQGQTIQNMQFGIGLDSSTPQNILGIGYETNEAQSANEGDPTYPNLPAKLVADGVISANAYSLWLNDLEANTGSLLFGGVDQDKYEGELVTMPVQKIAGGFFEFFVTLTGVQWGSNTLGKDMALAVLLDSGSTLTYLPNNIVADIYNQLDVAFDRNSGTGYVKCDTANKDLQLKLSFSNPLVITIPMDELVINLGDNNMQFEDGTPACLFGIAPAQSGTHVLGDTFLRSAYVVYDLDNNEISMAQTKFNVSSSNIVEIKDAVPKASDASSKVAAASGLPDQGEQGRAGAVDSSGSLPFPTGHLGTGNISDDDNVAAGTLSAPVYMAVAAATASFLFLGAFMA

SEQ ID NO: 1014 - protein, 528 aa, Unknown
  Kingdom: Fungi, Phylum: Ascomycota
MATRTETLTVVGEPVERPSAMTIPFEVLETTLTHESRISQLHTAHKFSRLQKTSIVLQLSGVNLCSSAINGLVVIGLPIISADLSLPESLAFWPTSATSLGTAATLLLAGSIADAFGPRIVDLVGCALTAIFMLGAAASSTGNQLVAMRAVQGVGVALHLSSSVALVTQAFPRGKGRNLAFACSGLSQPLGFSLGLVLGGVLIDTAGWRAAWFLYAGICVALFFVGLWALPHSCDQLSLRERLAICRTEIDWVGALLASAFMAILCYLLAVLSADTSRIRNGDTIALLCISVLLVPCFSGWMHRQKLRGEPALIPNSLWANPSFASICIITGLSFCAVNAMELFSNLFFHNVQGLSAIESSVRIIPSLTMGVITGLLCGFLVDRFRAIWLISISSAISAIAPLLMAVIDPEWSYWRGAFQAQALCSLSANLLFTVGLSIISEIFPENTQALAGAVFNTSSQFGTALGLSILQTISSSVTKQSPSDDPRRALLDGYRASFWTICGFVASCVFISALGLRKTGRVGVKRE

SEQ ID NO: 1015 - protein, 466 aa, Unknown
  Kingdom: Fungi, Phylum: Ascomycota
MSTTTGPVYGLEVPPGDILIPAGMDFPASFRITMAAVDPTQEPEADDEGNVPSVPRSTVRLIKQAFPELDDEEDDEIDEEYMKALMGESDSEDEDEEEANGGPSDPAKSKKGKQEAALKKLLEAAAAAEESDDDEDMEDAKPNGVKKGKGKAVDEDDEDDEEDSDEDDDSEGGDLENFVVCTLDTERNYQQPLDITVNRGEKVFFAVTGTHTVYLTGNYILEDDDEDSDEDDDDYDLSPDELEYAMGEDMSDDESDELDGLEDPRVTEVESDEEEAPKLVETKKGKNKRTAEEAEALDDLIAKDDSKLSKKQQKKLKNNKGEPVAAEEAKKSDKKVQFAKNLEQGPTGSAQGKSSVGVKVVQGVTIDDRTIGKGRTVKNGDTVGVRYIGKLQNGTQFDSNKKGKPFSFKVGKGQVIKGWDIGVVGMSIGGERRLTIPAHLAYGSKALPGIPANSQLTFDVKLLEIK

SEQ ID NO: 1016 - protein, 633 aa, Unknown
  Kingdom: Fungi, Phylum: Ascomycota
MAVGTISKGPAAVDEEARAEVDVLNSRLEKTTQLTKKIQASLARLDASGKSVRDVAGPLSGETKRLQVLGNNVDAVLVAIERLRQPADSKNDEEQIIRAGVDKAGLSNYLASIKRLNKSLSSMQASNIRANQAIMEDLGRLIKSGNTQLENHFDRLLRGETPRSVEPLHFITKDQPFPVLSQDKLARLGLVYSYVASTQQSGANSSVARIYADVRGPYMSSSLANLAAASINTAKKKNPGAIYRAGTNGIGTYTQAMEGMFLAEYDNICSIFSREDWGVVFQSTCQSALTELARTLRELNAHIKSHLNTDCYLAYEITEIISSLSGKMDTRTGELKASLAAALKPVRETAKSSLAELLEETKRKIGDMQTIPPNGAPIPLVAETMTRLQAMVEFLRPISSIMISLGDGGWKSAGASQNRSTDVIPSLASFDIGADGREIFAHYCEDTIEALLTSLEYKARSAQKSKSVQGVFVANSVVIIQRMIRDSDLAPLLQSRVEMLEQWRKRATANYTDICKDLSIHLFDTIHTNRTHRPTSGPADSAHVVKGLSSKDKDKIKEKFTQFNNAFDDMVSRHKSYSMEREVRAMFGEDIRQKLQPLYDRFWDRYHEIDKGKGKYVKYDKSSIAAVFLSLAS

SEQ ID NO: 1017 - protein, 1413 aa, Unknown
  Kingdom: Fungi, Phylum: Ascomycota
MSSNAHGAPLEAEVALPIEAQSFPEPSQGDALSHDSICDDKHDTAAIQDDKTNSTPPFLHSPPDSNNAPKSDASDSELSDLEDDPTLDGTSLPCLQPPAQGVPAEAPAEPNEEPEDIGEVLPDHWSGAVPVFKPTMDQFKDFQRFMLKVDSYGMKSGIIKIIPPKEWKDAQPPLDDLVKQVRVREPIKQDIMGSNGTYRQVNILHGRSYNVPQWRQLCEKSEHQPPARRGERRANADQPKSARPKAAAPKPTNPSTPKKRARGRPAKARGRKAKVKEEERPMTPVSPKAEPADLKEKALTSIEKDLGEDSTLHEPAPLPRRMGGLKPQGAKTQSVSARRKFSRREGSAMIDEESFKDFDYRLDTTEYTPERCEELERSYWKTLTYAQPLYGADMMGTLFDDRTEIWNLNKLPNILDVLGTKVPGVNTAYLYLGMWKATFAWHLEDVDLYSINYLHFGAPKQWYSISQADAKRFEGAMKNIWPADAKACPQFLRHKGFLISPQHLLQNYNIKVNKVVSYPGEFVVTYPYGYHSGYNLGYNCAEAVNFALEPWLEMGKIAKKCECAQAQDSVWIDVHAIERKLRGEETEYEETEDEEEDEEDEDEDDDLSGLPSPPTSHGLKFKEARKRKRGPGEKGPRVKKIKLRFKTKAEPPCCLCPNDYAGLDLLPTEDGRKAHRTCALYIPETYIDLEGDEEIVYGTKRIHKDRLSLKCLYCRSKRGACFQCSQKKCARAYHASCAAAAGVFVEEEEVPVFGEDGTEYKEQAFEFSCRFHRTKRDKKMDPVALEDDARIRKAAAALKVGDLCQMQLYRGEIFAGFVVENRSDEQMLLLDIVPTGQRMEVEWKWLLLPDPADFHLPKASSKAIPLPTSQKAKDRLNTKRADDMPRKDDVFGPGLTWAEYNYEEVYNKEQAKVDFEKQDQVWHYLGKTSTEARAQYTEDPAKPRFNPKGSFLDTLPKPPPKPRPMASHLQYRQYQGAGASQNGNQFYPGSHAYHTAGTGLGKPYMYKPKADAIPTSQFLTQRFVPNAALATPSVSGTTPNGQTPYPGPAQFAKQTFEVKSQHAHLQQPVASLGQQQMSSKWRVAIPGAASQAAQHQHTASTQQQQRPQGKPSWQVHSSIYQKYPFFNSHHNRDSSKYRTPYSPAGGFTNGWEGSYDIHVLSGQADRTSATATVSGPGIASQWSAQSQMLSQTLSRPHGSGPNGAHTQQAYHVSSRIATESMSPIGSSGLSNAAKPPPPLKQAVLGLANTALKATKTAALVPSKQTPVPLPPNIMAAMRTSSASSPQSAASPTTPVLSRSSPLSAKSPRLLTGTALTPSPGASKISTSPVPIPTFSAVTSDQRTAQAKASAAPHAPAKPPGSLEQMTANKHPESDVKIQAFPDVPAESMEFVERLMGNLRRVSQHNGTSADDNH

SEQ ID NO: 1018 - protein, 759 aa, Unknown
  Kingdom: Fungi, Phylum: Ascomycota
MLSPHMDLARNQDHPERHHYHQQQQQPEQEQQHQQQQHQQQRRQQQQHQQQDQQQQQQQHQRQSSVDSSTEAEAIAAANDAIRFQSGFTSRPDLPDRNVTVDSMEDAYVRFIFYCNPAVRLSVNTDTLREAFRNPPKSGGKTFHPFTIYELVRRFYAHEIRTWTDLTIMLGVEPPDPSKDESSQKISQYGVRLKKWMNSMHVKAFFEYLMDRPNEYWTNIPTDPNPVAWPVRDGVAFEDDMALRAVVPEIRPKRGRKRPDPDVGPAPATRRRRKTPPSAVDNHNHGTQAWSAHPDGRPQMPTDANRPTNNAGYDNLQASLARWPQSAVTPTTRGTFWDDALEPRSAITPSKPRQSYPRRGAKNVSSAWKTGPHDIGGKLRGRPPINRTPVESNPSSNQHWTPTSDASPAYPKAPEQYSYGHAQYQPTTQPPLGNHVPPPVSLPPAMQHQHATNEGARPARPSISLQVPERQGGSVRLATPPPPPPPQAPPPDVHINGQPSGQASERVNVERPLAPPGTNASDPNQGPSNRWQRFAKEATDAYEQAASVPGTGCDPPDEMPEFYFERMEDRTNVDALLAYFVRSMTDSEWLDAEGNPGKPAGIEESTAMVNSMLQNMYKTSTSPQAFLINLAALAGSMMLVTSRPKCARMGESDGTHVYKCDWEYRFGHVKGSFTMSQYVPSTMWKPSEAEAGGGGSQGHGPGETGAGASGDGEPEVPLSADDWKRKYQALTEEMYRRNKEIHDLRTRVMSSLGREWMET

SEQ ID NO: 1019 - protein, 1470 aa, Unknown
  Kingdom: Fungi, Phylum: Ascomycota
MPHAKQISHAHIGFDDTFPDALISGLLSLPPQPAQRDDGDHSSEHRLKRRRVDESPPPICVCEGYVSFTRRSGRGTPLSERRHDVHQQLQLHYSDRARVWQLRGKALGKDHYSVSTKDENMSQNWRILGETARLNGPMKPGDVWAQRSVDIKRDHKATSITFHVQVFWDPASSPFMPYGSKAQRHLASFLLENAFPDPSSPESGPHQWSPMDFYDAVHVPPKHDPESESIHVPHLDTNLYPFQKRAVQWALHREGVKWSGAMHGIVSLPTKASPTTSALFRRVTDVRGQEFFVSDVLRLATRDTAPFAQAETAVSGGILAEEMGLGKTLEVISIVLLHQRGTSPRSSAEPYHNLAQSGATLIVTPASLRQQWLTELAKHAPTLRVHDYKGCKNLKEAEYDNAVEDLAAYDVVITTYAVLSSEIHFAMAPPERSRRQERKYERKESPLVKIGWWRLCLDEAQMIENGFSQAAQVARAIPRANAWAITGTPVKDGVQDLFGLLVFLRYEPFCSHLQMRQALISGKKKPFQTLFKSIALRHTKALVRDQLKLPPQKRYVISIPFTPVEEQHYQSLYREMAEACGLGLDGGPLTDDWTPENHVEEMRSWLNRLRQTALHPEVGAQNRRALGSNRARPLRTVDEVLDAMLDQSEATMKADERAYLSSKLTRGQLFENSPRVREALKIWLEVREEVRAMVVEARESLRHAIQESKTTGRKTVNALDSQEDDDSSDDESDDPETRGRVGECRRRLRFSLEMLHKAVFFCANAYFQIRDNPEMTDPESEEHKRLKALEDAGYEEAKILRREILEQSHRRATRLMKGLAKKANEQSFAEIPELTVRSEKGIETSRIVSDLEALYDRLNEQANIIDEWREHLIQLLLKPLLDEEDEAEFTGEELADSTKLQDELIVYVTALRAAIADRGDAISGQSNELIKHETLTSMRLAKDGNGPAPEKLLELLDVRARINPRTEGFSMRSALSQFRTLTVMYNRDAGFATQRTVAEYTIASSHLESTQALMKKQTKAALALESEIEDFRAAMNTRVEFYRQLQAVSDSVLPYDGPTGEMIALGMHRTENDLLKRLAQARAKHRYLLNLKDAGAKSSEPRMCVICQSAFTTGVLTVCGHQFCKECMLMWFKHRHNCPTCKRQLTSHDLHDITMQPRELKVHSEGSSIGSSANDQSPTSAQKSRPGGARRTGIYSEFNADKLAEIKKIELDGPSFTTKVDMLVQHLLWLRETDPGAKTIMFSQYKDFLVVLRTALSRYRIGFSSIDDTNGITKFTTDPSVEVFLLHARAHSSGLNLVNANHVFLCEPLLNTALELQAIARVDRIGQQHETTVWLYLVSGTVEESIHELSVQRRMQHMRRDNIHVPSNGKGKDRSKEMTPELLDAKIEEANTLEMEHASLSKLMSKDRAAGELVDKGDLWECLFGHVARGKQIATPDNRLQEQAVIGYLAAEAAQARITEQQAEDAARPS

SEQ ID NO: 1020 - protein, 557 aa, Unknown
  Kingdom: Fungi, Phylum: Ascomycota
MGAQYGPMELLKKQLAPSKLIFHFIFWTFHWSIFAYGWWKQAADPRLAGLNTLGYSVWISRGAGLVLSVDGMLILLPVCRTVMRVVRPKLRFLPLDENLWMHRQLAYSLLLFTIIHTAAHYVNFYNVEKTQIRPVSALQIHYEQPGGITGHVMLLCMLLMYTSAHARIRQQSFETFWYTHHLFIPFFLGLYTHTTGCFVRDTALGFSPFAGELYWKHCIGYLGWRWELVTGGMYLLERLWREVRARRNTKITRVVRHPYDVVEIQFNKPSFRYKAGQWLFLQVPSVSRYQWHPFTITSCPFDPYVSVHVRQVGDFTRALGDALGAGAAQAKLYDGVDPMGMYEVALQNGQQMPGLRIDGPYGAPAEDVFENEIAVLIGAGIGVTPWAAILKNIWHLRNSPNPPTRLRRVEFIWICKDTGSFEWFQTLMSSLEAQSNEAARIPGSDGVEFLKIHTYLTQKLDMDTTQNIVLNSVGAAMDPLTELQSRTNFGRPDFKRLFNTMRAGIIDRTYLNGLEGSMRTTVGVYFCGPSVAAREIKAAAKAADGQEVQFRFWKEHF

SEQ ID NO: 1021 - protein, 377 aa, Unknown
  Kingdom: Fungi, Phylum: Ascomycota
MASSSSPVVDIHTHMYPPMYIKMLESRSSIPLVRSFPQSPDPRLILLSAEVSSLEAALSDATAKPPGRPLTSHYASLEQKIHFMDTHGIGISVVSLANPWLDFLAAEEAGPMAKTVNEDFSSMCGKHPGRLFFFGTLPLSASLDVITESVNHLTTLKYCRGVILGTSGLGQGLDDPKLLPVFQALAEAQLTIFLHPHYGLPNEVYGPRANAEYGHVLPLALGFPMETTIAVARMYLAGVFDKIPSLRMILAHSGGTLPFLAGRIESCIVHDGQLVREGKVAKDRRTIWDVLKEQVYLDSVIYAEVGLKAAIDASGADRLMFGTDHPFFPPLETDEQGEWESVSWNVKAVTKAVGDASASSQGIMGANAVKALRLTEP

SEQ ID NO: 1022 - protein, 132 aa, Unknown
  Kingdom: Fungi, Phylum: Ascomycota
  misc_feature (124)..(124): Xaa can be any naturally occurring amino acid
MPNTLAKTRKQIAKKRGTNNLVLHEKSRNTLRLHKAHVRDQRLEKLASARNKKEQPIADRVAYFQVNIKEKGGEPVDIPTVQELIEGYIAFAEEEYSEAKKERRPGRPASAKEDLMKMRLETLXKGAPAGIL

SEQ ID NO: 1023 - protein, 956 aa, Unknown
  Kingdom: Fungi, Phylum: Ascomycota
MSRLPAPSAPGLSELTDSQHNARNYGSSIAVPGASLKSLKRAVPPPAVQSESKRSTLADRAVEYPTKSSVAASSSVPHGSIRAQSIANISQPVLRVLDKTATPKKILRDDFRHQLRDIDCITCIVRYASRVASLESAIGLCGEPTTAAFIFIQYSIQRHQHSISNREYHYLLAIGMAGGLPRPWEMLQSGTDLKARRGFGVCSIWLRQDQYRRQHPKRRPEEDGLTFRRLSPLHNDALIGCSTIANQKLQQLKQPSGIQPPRQALNASSSFAKSFGPGRHAPPERPPTRSGRPMHARSKSQAPRPRTAHGHRLEEPSEADDGNAFDVDGRVGDMETQFKELKEMVNSTLTQRKGQEEAMDLVKMRVSELEGDRKRLEARNESLLSDLDASREESRHLRHEIEKQKWEYQRQLDDLNKNHKDIVEDLSRQHREAVDDLSRELDHLKDEEAKEHEQKMEGLTRHYQQELQDEREKRDREIQELRMRMGNDRQDTDLAMQRKDREIADLKSRNRQLDEDLERERSLKSSLQTNIAELAASNTTLEAKINSLKSHIEFLESDSKAQSDSFSNMEARLQEALRVADEAREKLIKEETERRVLFNKYQELKGNIRVMCRVRPVLDESEGDQAKMTFPDEKTSAEIVMAGPEERSSLGVVSRKSYPFEFDRVFVPGTQNEEIFGEISQMVQSALDGYNVCIFCYGQTGSGKTFTMSSPDGMIPRATHMIYDTITKLKEKSWSYTMEGSFIEVYNEDLNDLLTRNHGSEEKPKKLEIRHDENRKQTHIVNCRSVRLDSPAKVEMMLEEAQKNRSVAATKANERSSRSHSVFILKLVGENSATGERCEGTLNLVDLAGSERLKHSQAEGDRMRETQSINKSLSCLGDVIEALGKGSGHVPYRNSKLTHLLQYSLGGNSKTLMFVMVSPLEIHLKETLTSLRFATKVHNTHIGTAKATKKIKGGDL

SEQ ID NO: 1024 - protein, 406 aa, Unknown
  Kingdom: Fungi, Phylum: Ascomycota
MLRRSHKKSRDGCRECKRRHVKCDEARPSCRLCVLSERTCTYTNPAPSRTTAADRGSVSSTPSQGTTGSPVNQSDVSSIGATSPNRFVRPDLPGDLTAGSPRDYAAAPITGEVNLDHAELLIHCFKDEDIFILSDKVDDYQSSMRLAFDIAHQYPYLLHELLAFSACHLAAYHPNVSRYHHLAFDLQTRAVALFNASGQDITPENCVPVLLFSTIIGQHLFADSLRPRDFAGLASFIQRFTHCLAVQRGIGIIYQAAAPVLMASPLERYLTAGIDAQLQEPIGNDCAELSAMIYDSPRLTAADKEACIRATVILQLGFDAMALRPDEPTHLCFKWVIGVQPALKMLLETMQPDAMVLLAYYGLLLHLCRNAWPVGTAGAYVIGMVTEHLGRDYPWLAYPRRRMAES

SEQ ID NO: 1025 - protein, 331 aa, Unknown
  Kingdom: Fungi, Phylum: Ascomycota
MMASKRGTLWTKVLPLAAVALLLAGVAEASVGDKLPEFRQCLDVCKIENCGPGRDHTPIPLLHRLLFWTCGSECDYACQHIITTSRVEQGLPVVQFHGKWPFYRFLGMQEPLSVLWSLGNLYAHWHGLHQIQSRIPESYTMRPFYEWLARVGMAAWTFSAIFHTRDFQLTEELDYFAAGATVLYGLYYTPVRIFRLDKRTPQNRSVLKVWTALCVLMYICHVGYLKLVRWDYTYNMAANVTAGIIQNVLWSWFSYERYRKSRQGWAMWPGFVVAWVMIAMSMELFDFAPWFGSIDAHSLWHMMTIAPSLLWYKFLLKDANDDIAGTARHKA

SEQ ID NO: 1026 - protein, 473 aa, Unknown
  Kingdom: Fungi, Phylum: Ascomycota
MGPKTGLRQRGNKLHNFVVGEGGDEEYQTALVTQDDAELQSNGVAGGEPRRTSRQEVANDVRLSMPQPRQVVRHLRERSLASQQVAPSPVRSRHASPRPAPSRTETSDHFNGLFAPSDLGDDFMRSEASTPHPALDAQDENAAPRRRSEVSVQKPPPRWSSGHQDLVEETAKFVTNDDGFMQVVKSGKKYTPTALRDGFSRDNYYEREATDRYADDRVAPLRTAERQAGLPIRTEPRRLTKAKEERVFVSARAASPAHEPEQWTPGRQYEVRRSPQRHVEAVRPPPSDVGENELRVTAKAKGDGTDTYGGTVNAEEPTQYSSRDGSRLRKRHRENPDYDDQVLSSMSFKDLRNESFDFDPSKAALSGGASDGIQDLPTKLEQRRHRSEEEQRQFFAAMPMQEWEESGDWFVDQFAALMKKMRDARREKRRVVREFEEEAERREEAVRARTEGIERKLAKMRQDGLKVVGDVSL

SEQ ID NO: 1027 - protein, 1457 aa, Unknown
  Kingdom: Fungi, Phylum: Ascomycota
MTTNEQASTTPPPPSPPQDVSLTNSPGKEDAKPAGTVSSAEQSTSDTRATNAGNESSYLDGVTMEASHMPDDSVSEDAVREHLQDVESSFLPTLSPIPTGVNTTEGGIDDTYLFDSPTKKEPQPQQPQQQQQQRKSPSIDPSDHGNTTSSLENLDSSPTAAAAARTISRAVSMASTAIHHPTGASGNDGGGDEGGDETFSSSVNAESTDQELSLSRSHSLSEKLDAGSTPGFSLRSRRPKYLRSRHASQRSSTSSFATNPESHEGSDVTVGLGADYALQSGGAVPALGMPRNLSSTLTRSISMGSVASGFGEEYYDHPANQLETLPEVVSPERTRNSDQMKTPKPSRQTLNSAPTDTVIARHVSNVHVPESLAKEYRFKSGLETPRRPSTFTSQTGTTGRSGKNLTLKEQSSTIERLSKENFDLKLKVMFLSDRLDKLSEEGIKEMISENVDLKTNLAVLQRDNKVLRRRVKELEKQRKDEDERPSTARSGTSSTDQTARLYDEEAQEREEELIYLRERVEEYAVEIERLRRESLNRESEKRKLSDIVRSLGERTGENLGREEEADVWKDLLEQETARREQADEDNRKLRDEIFRMKQDMASTQGSMHHTTNIYNITKRQQRDREAMGQPGPGLSAEVEGSNASLSAATTIVEELRREGEQLRHENAELRREVGAQTSMLTSRNREKERLYQEIEDLKMAQRRGGPALSAVDSILDRSASRAGGHERSQSRGSAQTRRTSADDEAEREELENKLAEVRDRMSEVKLQNQELQRELENCMLDFETAINGKRDAEENALNLREELENATNDLVALQAERDEALREQGDMEIEFENLRREAQNEIDALEYEADQRNEDIQRLQDELNDRSENFEALQEEMRKMSEAVVRLEDEQDNKLRRIQELEQELESSNKELEELESKLVEANDKNQRLSIQQESSQGEIAFLREEQETDKIRIGDLEAALANAEQSIREEKERAKEIDNRLQQERHQREVVANQEKEEVQQFVNELNREASTAKDEVRRLRKNLSSREVEATEWKERLMELENNLREALGDLNGTRSSLLKSIAKMQRELENTIRDLDTSKASLNEKDRIIKQRDELLESHALESRKLAELIEKERMAHRNTKSQFETFQKNHQHLSRTASTQDVRIAELESTRGQDRKRISMLEQAARDQLTERNQLLLILWQKLSAICGREWTNDNALIDRQVLPSLEVIANRLPGFSRNLLAAVKAIEGIISGFQSKIKAVERDLSRDYQNLENNLDVRTKKLDRLETMVRNSIATGPVSAQDKSNRVLKLEEYCRQLKVEIATLRTANDVRSRSSYSTANNAEAIIPGDPGSPSPSVPRGPGDRDRDRVRTSYGTKPIRPATVTRSSTASGAPSSSGGGLMDIALSDENSSAHNNDNRWLFRLRDMEYKLKMEREGRNQDRQAARQRLSGLESENRGLRERARRVAEDEGQE

SEQ ID NO: 1028 - protein, 760 aa, Unknown
  Kingdom: Fungi, Phylum: Ascomycota
MSSGDIIDHSPHQPEPAPPVPTASNLILIDNYDSFTWNIYQYLVLEGATVHVYRNDKITVEELIKAKPTQLIISPGPGHPKTDSGVSRDAIRHFAGKIPILGVCMGLQCIFDVYGGEVSSAGEWLHGKTSPLTHDSKGVFSGLEQGIPVTRYHSLAGSHVTLPEDLEITSWIAKPDGSPGVIQGVRHKTLAIEGVQFHPESILTQSGRGMIRNFLLMQGGTWKENLNLQPAQKASSATSVTPKKSNNILQRIYDSRRAAVAVQREIPSLRMSDLQAAYDLNAAPPQIPFVQRLRQTPFDLSLMAEIKRGSPSKGIFAMDINAPVQAKKYALAGASVISVLTEPEWFKGSIDDLRAVRQVLNGMPNRPAILRKEFIFDEYQILEGRLAGADTVLLIVKMLDDELLKRLYDYSLSLGMEPLVEVQNADEMTRAVRLGSKVIGVNNRNLESFEVDLGTTGRLRSMVPEGTLICALSGINSHDDVLSSKKDGVDAVLVGESIMRAPDATKFISQLCAGTDPAPPSSSKDKLKVKICGTRSAEAATQAVKSGADFVGICLVPGAKRCISDETATAISEAVHSFKKSTPDSTDDSISLKSATDYFTASSARLKSNRPQVVGIFQNQPLSEVLELQRRYNLDIVQLHGDEPIEWANLIPVPVIRCFKPGQVGVGVRGYHTIPLLDSGSGSGKLLDVSKVEEVLRKDPELRVFLAGGLNPDNVAEAVKALGPLGNRVLGVDVSSGVEEGGKQSLTKIDAFVQNAKAIR

SEQ ID NO: 1029 - protein, 732 aa, Unknown
  Kingdom: Fungi, Phylum: Ascomycota
MDTSIDRDCDWVWISGWQACAICQERRTFTPPRKDIDLANARSKPDLAGAHLLANRIGWDRKLGIMPVARDKRRLPSFEHLDPPSHLQVPPIEQPIMKSIPVRFRIERRLPPSQGNDVIQESFEGSKLIAPDLHIPLFYPHRPKRLSPDMALHQYDYILAIGTIFAFLDAWNIGANDVANSWTTSVSSRSISYLQAMVLGSILEFAGAVGVGARVADTIRTKVVDVSLFEANPPVLMVGMMSAILGSALWLTFCTKIGLTVSTTHSIMGGVIGMGIATVGVENVTWVNFKSGDISGGVVSVFLAWVIAPGVSAAFAILIFLVTKYAVLLRSNPVMKGLMLVPVYFGITASLLTMLIVWKGGSIDVDDFSTGTIVGIIIGVGAAWGCIVGIFLVPWLYRIVAKDDWQLRWWHIPQGPLLLRRPDPPAQPEGAAGGIRDFYAGHMTREELDALRNRNSSGSDVETTTETNGKEGKRVDSENGQEDNCNVIPRELDMPEEKKLVGPRPEGKWHDGAVMFWFFKWLFLRGVDQDIVNMQSKRTRLTGDLAAVHAHVKHYDNKTEYLYTFVQVMTACTASFTHGANDVANAIAPYATIYQIWREGGLAGSKAPVPTWILCMGGAGIALGIWTYGYNIMKVLGNRLTLHSPARGFAMELGAACAVILATRLKLPVSTTQCITGATVGVGLCSGTWRSINWRMVAWIYMGWIVTLPVAGIISGCICGIILNAPRWGLPN

SEQ ID NO: 1030 - protein, 416 aa, Unknown
  Kingdom: Fungi, Phylum: Ascomycota
MPKATTPTPPFPALGGTALFSPFQLGHLKLEHRVILAPLTRMRADRESAGVHVPGPRVVQHYGDRASKGGLLLTEATDICHNASAYPGVPGVFTKSQLDGWRKVTDAVHAKGGFIYNQLWHTGRATSTGMRGGVKCVSSSANPMDGTYLDGVKCADDPPRPLTVDEIHALTQEWAAAAKRAVEDAGFDGVEIHCKSSPLQDRHTSANGYLLEQFLHDNINTRTDEYGGSVENRCRFTLEVISAVSKAIGADKVGIRLSPYGFFQGTRDSDPNAHWSYLCKQIASLPKDERPSYVHMIEPRFDEVLDEDAKLAQLPNSEGQDKKEKNSLNIFREILLPAGVAFLAAGNFDRDNALPKVKSGEADGIVFGRHFIANPDLPRRLRDGLELNKYDRSTFYGADPPEKGYNDYPFYTESES

SEQ ID NO: 1031 - protein, 152 aa, Unknown
  Kingdom: Fungi, Phylum: Ascomycota
MKFSLVALAAFLGAAAADKAIVNNDCSTSVYVQSYPYNGGNPGPLTEVKPGKSFSENLRSSGSTIKIAKTRTLDKPLFFGYSFSKNPDYAYYELSSEWGNPFASSRNTLSPGAGCEAFNCAPNDAGCYSTPAHKKVYGCPQPVDLTATICKK

SEQ ID NO: 1032 - protein, 1808 aa, Unknown
  Kingdom: Fungi, Phylum: Ascomycota
MLQRLADGSARQLVQYGIDVEPRYATMDEMKEAIAVITKELGDEDLISTDPEDLHAHGYSSWSTTNPDNLPVAVAYPRSTDQVAAIARICNSYRVPVIPYSGGSSLEGNFSAPYGGVSVDFAFMDRIIKLNKEDMDVVVQPSIGWQDLNQKLADMETGLFFPIDPGPSAKIGGMIGTNCSGTNAVKYGTMKDWVINLTVVLADGRVIKTRRRPRKSSAGYNLNSLFVGSEGTLGIVTEATLKLAVIPEDYAVAVVGFPSIRDAASAAASVMQAGIPIAAMELLDDVQMRVINLSGATAPRKWQEKPTLFFKFAGTQAGVKECIERVRQLASSRGGSDFEFAKDAQEQKLLWSARKESLWSMLALRKEGEDVWSTDVAVPFSRLADIIEVSKEEMDRLGLFASILGHVGDGNFHESIMYNKKDPKERAMVEQCVKNMVRRAIEMDGTCTGEHSIGWGKKDSLLLEVGPETVDVMRTLKGALDPLWIMNPGKIMNVPWMEDDVAEAGHHVGYVAPAKKASTSRLGIDRRGEGEGSHGGKGGKQWDVELGGVAMRTNAAHADDSSGTMAAWPERLPRPLRASRGQRSRAFDNLPKFPTSLPENWQSWPELTVRIHELPSDVSTTMVWENLQQYGDIVYIDVYQNPRSVSFSARVKFSPPPVQAFWEAERFKFSHPDTTLHPAGISVTIRPDTGPPAGWVSSTIDEGRSYAGRISVLLQGVAIGSRTGPLQATIAECWYHEQQQPDFRLELNVHDKQLCVHFHTPIQTSKGSSLRSYRMKIEVSQLRRVYRTSSLEEQETYVVPLAFPPEYWWRREDIPSMMYSRHVWGEKEAWYRASFMADNFDGLKYPVSVSSNVEEPGYVDLGRCTTCQFLVAPGQGENLGYLREALEDLNVKMQDAEDFEVVYKKQPPMWQHLDHSDTPATNASAMLEMWSEQVHLPFEVRYQLEVCISRGYLHEHNVSRALLEKMASSDPIKVQDWLEKVADRARPVYDPMASFIDFDVIEAPEKRRTPEFCYIVRKAVITPTAIYLNSPSIETSNRVIRKYNHVVDRFLKVQFVEEGERGRLRAAAGQNNDEIWKRIWRTLNQGIRIGDRVYKFLAFGNSQLRECGAYFFSPTDHVSCDDIRRWAGDFDHIKVIAKYAARLGQCFSTTRVLQGIPNPRIVPIPDIERNGHCFTDGVGKISKLLADFIAAEMPGNAGERPSAFQFRMGGSKGVLVVSDDAKGKEVHIRPSQEKFKAQFNGLEIVRCARPATATLNRQTITILSDLNVPDRAFISLLEQQLRKYDESAKDDAVAIELLTKFVDQNQTSLIIAELLRSGFRTNKLREPFVLNIFSLWRSWSLKLLKEKAKIHIEKSAFVIGCVDETGTLRGHSAMSEGTRVKDTKKLPQIFLQTVNPNTGKTFVLEGVCIVGRNPSLHPGDIRVVQAVDCPKLRHLKDVVVFPSKGDRPVPNMLSGGDLDGDDFFVIWEPTLMPQIWNWRPMDFSPAKPMQLARDVNALDLQQFFVQYAMNDVLALIAISHLAWADQMKPRSSICLKLAEMHSRAVDFPKTGEPVAWDWKEMGPKRWPHFMENKGRSYDSTQVLGRLYDNVTKEKIAFEPDWNHAFDRRVLERYELEESSLAKARRLKADYDRCVRRILAQLNLGTEFELWTGFSMTKPVVGTNYKMHEVLGQEAETLRIRFRGLCEEAAGGSSQELIDPFVAAMYKVTEEETTKTLRHLDEGASSEDEDDDLDWNCEGRRQLRANKMPLITFPWLFPEVVVRIALGDQWVQKKPWYSAFGKPARTEEPIEVSLRPPHIRFGSGNACSA

SEQ ID NO: 1033 - protein, 593 aa, Unknown
  Kingdom: Fungi, Phylum: Ascomycota
  misc_feature (215)..(215): Xaa can be any naturally occurring amino acid
MQPDPEKATANGGGEEVQGADLLTSSSTDSCVLEPIATRPSRPSMALYDDDIASNLSRAMSTEIETEAEREARDPITHTRTGTSIGSTASRPPDFEVIFEENDPENPKNWPLWYRAWCLLVVSYSTWVVVLYSTSYTSATPGLIEEFGSSVTYVTLGMTTYLLGLAVGCVVLAPMSELYGRRPVYLVCQAAWLVLVIPGGVANSLTTIITMRFFXTSAVFGAAMISNGPGTLVDTTRPEVLALAMSIWSIAPLNGPVTGPLIGGFVYADLGWRWTAWIVLILGGISVAMLLTVKETYPPKILKCKAARMRKEMDDPRWWCRYDQRISSLELLKLNLSRPFILFFTEPILWFLNIWISVIYAVLYLCFVAYPVVFTQHRGWAPGISGLAFIGIGIGTLLAIAAEPLCRRIVNSQRRDPETGKVRPEATALVMAIGASLTAFGQLVFSWTCLPASIHWAIPIASGIPFGAGNTLSFIYGSHYLAGAYGIFAASALAGNALVRSIFGAVLPLAGPKMYASLTPQWAGTLLGLLEVALIPIPFVFWRYGEKIRARSPVIRQLREDQERADAKRARYLARLERREKKHGISTHHDAEK

SEQ ID NO: 1034 - protein, 142 aa, Unknown
  Kingdom: Fungi, Phylum: Ascomycota
MPTVPARGGPGGKGKSRVGFGGGKTFKRSTARNRKILRDNIYGITKPDIRRLARRGGVKRISATIYEEARQALKQFLEKILRDCAAYVDHRQAKTVTVTDVIYSLRRNGRTLYGFDNDGIAKGRNPKRLSSRPDLAARYDSD

SEQ ID NO: 1035 - protein, 169 aa, Unknown
  Kingdom: Fungi, Phylum: Ascomycota
MASIARQAMLAPARSFAARGVAARPMMGVAGFHASSRRCDILPAGPQRIKGGVNDPAPIPTPSAAHGSYHWTFERLIAAGLVPLSIAPFAAGSLNPTMDAILCGTILLHSHIGFQSVVIDYVPKYRFPGLHKAVWWLLNAATLTVGVGLYEFETNDVGVTEAVKRMWKA

SEQ ID NO: 1036 - protein, 483 aa, Unknown
  Kingdom: Fungi, Phylum: Ascomycota
MEVAVTKKTKGDESQDYTIKPQAATPSVDTSTWPLLLKNYDKLLVRTGHFTPIPNGSSPLKRDLKSYISSGVINLDKPSNPSSHEVVAWVKRILRCEKTGHSGTLDPKVTGCLIVCIDRATRLVKSQQGAGKEYVCVIRLHDKIPGGQPEFARALETLTGALFQRPPLISAVKRQLRIRTIHESKLIEFDNDRHLGVFWVSCEAGTYIRTLCVHLGLLLGVGAHMQELRRVRSGAMDEKKQMVTLHDVLDAQWMMDNTRDESYLRKIISPLETLLTTYKRLVVKDSAVNAVCYGAKLMLPGLLRYESEIEHHEEVVLMTTKGEAIALGIAQMSTVEMSTCDHGVVAKVKRCIMERDLYPRRWGLGPVALEKKKMKADGKLDKFGRPNDATPAKWTSEYKDFSMPDASAAAAAAAPAPVTQVEETTVVATPATPGDDADKKKRKKHDGETPDEKAERKRRKAEKKAAKAAKKAAKGETSDDDSD

SEQ ID NO: 1037 - protein, 347 aa, Unknown
  Kingdom: Fungi, Phylum: Ascomycota
MSPVGKKTESIEKPASRRERGVLAQRAYRRRHASKFQTLKEENERLRDAIKRIGVVASGEGRFNTDLDNVIALAKNVAASGEDGSDTASQRDRAVSASASSSRKCPRSNEQEASPSTPGYRNIPTSSGILVGGQMGMRSFSIPSNCITYLGDTKSDSLAGCMYRAVLSIAIQRWYKHFQRQSRSQSPDRPLLQHSNGTPFSVQNSADPPSSSVLDNAFPLLHLPTSDSPVPQCIFSRPPSEEPGDLSPTCAHDVVKRCRINEPEGWWRASDGIETYLRQQAMTPEAMSIFEEVMRGGGTKQQIHETKSMLEGLARNYKCFGDGPRWNAVYVTVAMDMFRKDILGEEY

SEQ ID NO: 1038 - protein, 320 aa, Unknown
  Kingdom: Fungi, Phylum: Ascomycota
MTRYDDPDSPTVQKKRSHENDLPSSSGSSSSDEPSRKKHRRSGSSKRNHSTRKNGDPEVAPNGAGAGALKSRRNSLGKAARDPRDEPPKKRRVSIAGEVVATRSPTPVVDFDGLSRPSRGTRERREENAEQAEARLQKMRGAVRTLLECVGEDPDREGLLDTPSRYAKALLSFTQGYQDSIEDIVNRAVFREGHNEMVIVKDIEVFSLCEHHLVPFTGKMHIGYIPKDNVIGISKLPRIADMFSRRLQIQERLTKEVAHAVMETLKPQGVAVVMEASHLCMVMRGVQKTTATTITSCMLGCFERKSKTRNEFLSLIGVNR

SEQ ID NO: 1039 - protein, 330 aa, Unknown
  Kingdom: Fungi, Phylum: Ascomycota
MASSLSPDQSTGAGSHPSPGNPSTFGPLIQNLSDKRSKREAPSKRRGPKPDSKPALTRRQELNRQAQRTHRERKEQYVKALEDELLRMKDLYSKVSRDKDSLLEETRHLKNLLMLNGIPFSPQQSVAASSIYGSEDHTAVSNAFSPSPSQFSNPSQALTQGPSSVGSHGSGTVDPEQAGIDFVLKLERPCMVHRQLIDSMVKTSNGPPCGHAMMASCAPPEQNQETPFNTRWTAGEADMQTWDLSKGDLARLLDLSSKLELGGEVTPVMAWKMVTMDPRVTRLNQSDFDALSTRLLERVRCYGFGAVMEAWEVRDAMENVIAFRNDAMAF

SEQ ID NO: 1040 - protein, 144 aa, Unknown
  Kingdom: Fungi, Phylum: Ascomycota
MLPRFFFLGLAAAAAAAYEVVNYPDPSIPCGAELGLCPRPDLYCKPDDTECADLTRCPGTCAYKNTFAYCGGFRLPGPEPCEEEERERCLDDPRNPASCGMACDGPGVCLSEDATECHDDGDCPSGQWCYEDGKGQTGYAKVCM

SEQ ID NO: 1041 - protein, 707 aa, Unknown
  Kingdom: Fungi, Phylum: Ascomycota
MARATTPSYDWDAQDAMFEGGYDSSAPLPCHQDSGKSGFARDQRQRLRSLSSSFPWPRPKSSLALNMDADYASNCTNEVIIEDEAGPSGHNAGVSNHGHQVLGFKSMVRRASKSIKDMVHRRPSSAADEALGLRSATLRPTTSWTGKFRQRNKSIQYSRSFYGLDYTDEPLSMHDTQPKDIYAPRPGTSLGPPIIPEHTGAAAKASAALQNEYLARSLQNKWLSPTSSDDENDCESGVGIAVSVPDVEVDDFDVCESPENISRLDFISQLPLELAIHVLACLDALALSRASLVSRTWNKICANQHVWRESCLREMTTTYATSGAVKPNTGFGIPKNLPTSDWREIYRAKHELNQRWKLGKAQPIYLNGHKDSIYCVQFDEYKLITGSRDKTIRVWDLHSLKCRLVIGPEEILDESDMLYNADGSIMHNATGTDSRVISESKPKMASFTIHHNASILCLQYDEEILVTGSSDASCIVHDIKAGYRPIRRLQHHTAAVLDLAFDDKHIVTCSKDISICVWDRATGALLRQLKGHTGPVNAVQMRGNTIVSCSGDYRVKLWNIDTGKNIREFTGHTKGLACSQFSEDGRLIASAGNDQTIRIWDANTGELVHSVTAHEGLVRSLHVDSVSGRLVSASYDTDIKVWDMETGRQLLDFPHWHSSWVLSAKCDYRRIVSTGQDPKILIMDFGRGVKGIEALESDNPDERGNFI

SEQ ID NO: 1042 - protein, 208 aa, Unknown
  Kingdom: Fungi, Phylum: Ascomycota
MLSQSLRQSIYITPFVKSPEGITKRNSSSQDMPADLDDGSDNMINLMLVVLGIVFLALILVSMLFVFRRIRRNRQLQGHTLPSYYDAAGTVKNPRGLTIETTHPNGRSSVLVIGRDGQPMLPNPNSPPHSPDNVPEIRITFPDEQDEQGRHQSGRVLVVRVGENATVGLEPVHEEQLPAYEKEAKAGFYSVDMDQIGGLKEKDRNLFQ

SEQ ID NO: 1043 - protein, 767 aa, Unknown
  Kingdom: Fungi, Phylum: Ascomycota
MRRAVLGERRVSREIYTRFGRILVSFPCGLISRPLTVPGLDTLRALYLTYTAYTLSPILCSTFCLNEQRFTSKPDTNDSHLRLTYTLVFTKCINFVADFLRLVTPKIITAKLPNEKAMASSEQFLIAFLRSDNIKDALLPHLDIQDLTSLRASSSAFCNLLTKRLFTRITVTFSSSTFTRPCRVAALSRIGHHVEHLTFSFPHSEATFLPPLVHPLTGHEINFRYTPHTSMGSALTRPKYANSELQQILTDQYPPLFHAATNVPSFIYAMKMLPNMRHVTIRCPGQDPSERYRRDIVDYALISMRIALERAPLTNLNKLSLSSVHPGAFNYLRHVNGIGAVPSAGRRWKQIKKLHISVEAWDFYGSSPGLDHLKVIDDYIRTFSPSLEKFAFTWVGRKGPCPVALRADPLFSPPRSSRKLFAEVTSPMSPLPSPPCRAPMHFPKLRYLQIRNATMNAPQLKELISSHSKTVKEFDFENVVLLNNGNWEDALAPLDRDDSWSRSSLTAASECSFVTISSAESLPSPSAAVAAASRELLDVDLGGFSFSDEDREVIQGLSEDLMAAREASVSVTTKLKKKRRRRRRHRHEEEVTPPAAPPSPAASHRRKPSKPLLKSSFEILRPSTPTPLPSVTVPILNSDPHPILLQPTVYQPSGKYAVHSSKADGISNVQRNLQQEESHRLMAEDPAARTSALQKAREAVLSKLGREFGGGGRRHRVTAEAVAACRLMTSREFLGGGGGYCAADVVLEDRRGLETGSVMVPLMFARA

SEQ ID NO: 1044 - protein, 445 aa, Unknown
  Kingdom: Fungi, Phylum: Ascomycota
MSALASKKVLLLGAGFVVKPTLDLLVKWGIATTVACRTLDSAKALVAGSKGATPIALDVSDDKALDAEVAKHDLVISLIPYTHHATVIKSAIREKKDVVTTSYVSPAMMELDQQCKDAGITVMNEIGLDAVKTIEEVHKEGGKLLSFESFCGGLPAPEASNNPLGYKFSWSPRGVLLALRNNGKWWEDGKVREVSGVELMTVAKPYIVYPGFATVAYPNRDSTPYKERYNIPEAQTIIRGTMRYVGFPELVKTLVDIGFLDETESDTWKTPVTWREATKTLLGASASDDATLAKAIESKTTFKDAEQKKQILAGLRWIGVLSDEKTIPRKNPLDTLCASLEAKMQYEEGERDMVLLQHKFGIELADGTKQVRTSTLCEYGSTEPNGYMAMAKLVGVPCAVAVKQVLEGTLSDKGILAPMSSKINDPLIKELHDDFGIYMKEEIVA

SEQ ID NO: 1045 - protein, 1613 aa, Unknown
  Kingdom: Fungi, Phylum: Ascomycota
MRARSQEAVTPARHRNRATRACTQCRRTRVRVCGWVKCVLDPKSSICVPCRNSDQDCVFDDKDGRKCRASVKTVEAALTERIRALERQLEEQRGEGRSANGETPESASHFFPNEAFGDQVSRSTLSPGTASSGSAVGTVNDGQQSVQDEKADLDEPASAVVTKIMPSAIRFDMASGRVRYFGSTTHMNVLTKVSASKGPARRQESHWPIALILKDLSPTTHDYLMDLFWEFSNSVIRLVDREAFYRDQESGGLEYYSTFLHLAMLGTGFRYADKSRPDIQRLVLSENVTSTIHEKTKALGRQEIERPGGIPSIQALQLLSGLEFCCGNDDTGWMFSGICFRMVYDAGLHIDHSCLGISPRDTQIRDMVLWASLTADRLWSLYLGRPTTLKLADISPNCLSYVFDPSDPSDPAVRQKPLVTRVYEALLQMMERVGQLCDLRGPRPTRSADSCLQLAAIGQQLRDWYTELPRDLQWSDSPGPDMPLSYFLLHTQYHAALILIHRQFIHINDTDVTDGLDAHFKSICRATCASSAESIAVILEEYRARFELSQVYGTAVQHAGTAATAMMGEVVLQADPVERARLVRILSSLRITVGLMSKNYRGAGLMVSIIDRFIRSTTNRASSSSDCEGTGTQVFPHPSGPQVPPVATVGHEDQMVVAYGPAMMANPLHQRWRLDAWSALIPSPAGHLSPTGLPAVPSSFFEGIMEEDLNFGDMSGSFDLSAWGNGPMDGYSCLPSINPVPIFRLHGPAAQHSAALLKLTMLKPNASEQCKAVDPYPKNDRTGKDLEVQLVLAFILGLFALLSFCTLRPRWPSLYAARKRRLDRDVALPELTDSFVGWMPRLWRITEEQVLAAAGLDAFVFLAFFKMAIRLFAIMAFFAMTVLLPINAKFDGKDPFGIPPIWKNGTRNDTNNHIFFDFNSLPAIDDVDAFKGGNKDRSSDRDHWYLWSHTVFTYFFAALTIYYINRETFRVIRYRQDYLGTQSTVTDRTFRLTGIPESLRSEDGIKHLIEKLDIGQVDSVTICRDWAEIDTLVEQRNLTLRKLETAWAKYRQDQEAQKKESGSRQRSNNVNARSSEPDEEAGENGQLLQDNHDGVETERPHVKLRYGFLGLRHRKVDAIDYYEEKLRRLDEKITEVRKKDFKATDMALVTMDTVASCQMVTQARIDPRPGQLLTKPTPAPSDIVWKNTYSPRGIRRLKSWGVTILITFITLIFFIPTAALSSLLSLCAIEKTLPSFANWLSQNTTIYSLLQNGVPTLIISLLNVAVPYLYDWLSNHQGMISQGDVELSLISKNFFFIFFNTFFIFATSSTIVEFWANLPKFVKDTSFMAEVIAAGVRKLSIFYANFIILQGIGLMPFRLLEAGTVALTPIYRLLSKTPRDRAELATPPIFQYGFYLPTALLVFNLCLIYSVLAGGFVILIFGIVYFALGYSTFKYMVLYAMDQPQHATGGAWRIICYRLLVGVIVFEIVMIGSIASKQAIVPSIAILPLLPLTVWYSYYFKRRFEPLTKYIALRAIRADEDPEDAAALDDDFEAESVGRPSQGLLRRGSTIDEHREKGLMFVNPSMVVALPQPWIYDEPPPTVPNEETETDDDGPRLILPGLGEDNVWSAGGS

SEQ ID NO: 1046 - protein, 309 aa, Unknown
  Kingdom: Fungi, Phylum: Ascomycota
MPVIAVAGGTGGLGRAIVDALNAAGKSKVVVLSRQSSEEKEKEIGAPIIAVDYSDVSGLAELLEKNNIDTVISTISNPTGPEPEFALIDAANKSVVTKRYIPAIWGIPYKRELAPYFPPAGQKLDMLAKLEKTSLDYTAVYNGLFLDYYVHGVPSYLSPITFAVDVAHNAAAIPGTGNEPVVFTHTSDVAKFVAAYVESSKWEKEAYIIGDKLSLDEFVKLLEEVKGVKFAVSYDSEEDMRAGKVTELPSHVHAYPFLPKPIFQGFMGGMGLMVADGSFDLKADRTLNSEFPSIKPQSVKELLIKAYKS

SEQ ID NO: 1047 - protein, 136 aa, Unknown
  Kingdom: Fungi, Phylum: Ascomycota
MSSSLFMRRAAFGARAFSTSSPRSIARISIVGNLGDTPELIATSSGRELIRYAVASNSGPRDNRQTSWFRITSFAEGAQRDFLLSLPKGTTVWVDGNATLNTYQDAEGKTRSGLNITQRSFEVVKRPQGAPSEQAE

SEQ ID NO: 1048 - protein, 784 aa, Unknown
  Kingdom: Fungi, Phylum: Ascomycota
MARYLNPAKIGLLVLLELYTEEAVPSDAILPVLSFISSYIIDHHPRSPPSDQQSRWNRAENTVNLVVSIKDFEKLLGSYPFLRGMPGRRLWDQFLDKLWAINSLHELHSFFDGLQSLVAKTREERKRETGMTSPEPEGGMKLARNSPLGAFIRRSQIEFQRLRFHDSAELWKDFVRYRQPTSQQRKRRTPRMAFDNVLLEGEQHNEWDSVSTSCLASVVYGDMLSGGQTSTLPVSTDDIDALLEFQIEQMQKFGNRVPMEIKHQFHDLLRDSFVVPSTTHYLSYLDSWRSGDYPLAYDYLHRYFDYTGHNKDRVYYQYGLLNLAVLQADFGCHKEAVAAMLETVSTARENRDMSCLNFALNWLFNFGRSHPSMIKELESNSVLGSAKESLAFLRVKAKETGMFSLWSSVLLTEAKTGLENGDSVATAFEHLTRSSQLIIEKNMKTMFGSQMSLATAMWDRLGLAQLATITTEVFLRCHARQAVFEDELRLTCKLALHKADRGKYDEALQTLESIDENSLRSRKPGQYWFKYRGIVKLLRDLRHGYLDGAKQLLDQLMQLKNDELEPGLAFLIDTLHIDYLTRRGDLQAAFEKVENLLSQLRDETRDVDYRIRLLLLKAKLLNECGRPQRGFSIAMRAASLAWRARLMTSLWSSMSALCTILITMNEFCSAVEILSAILPRAIECDSDDLTAGLYVCLADANMGLAGEAEAKSARKTEYLTRALGAVEKAFDYYSGIEDAAKQCEMMAKKAVIMKVSGDMVLAADYAAAYVSLRKSAAALSLGGR

SEQ ID NO: 1049 - protein, 119 aa, Unknown
  Kingdom: Fungi, Phylum: Ascomycota
MSVAAGKVDRNIWSMSAVKMRITQAKLEKWAAMVAAKTKALSLTDPKEPPPPQDASMYDPSEVPRGPSARGQWKMLACHPGFGGGDQWMAEVMGYIQLSGMLKVSVVPQVLIALNSRGQ

SEQ ID NO: 1050 - protein, 1374 aa, Unknown
  Kingdom: Fungi, Phylum: Ascomycota
MASSNAVEGGGPATATRSRRRQRPKSSDSPNQQPKAKRQRLPLTEQTFVNPDVPQEMTEAKNDKVVKLDPRPNGIENSSRQQHNQIQFAVRRESSGRPKKPKHGDRATNKGDGSLLLTSTNAYNVSRLPALPDKIRSDWTAHQHADISSFGYALSLTQTHALVWPYASTSPSPETFTFTLPSTSKPNDPLPVGSLVSPPAASSEPGLVVVMAGSGKIVYWETISSAATFAFINKDRSGVEGVVSGMSTGEKVVAITNAESAGFVLTFNTGRLAFMTVRDSHGRPAISVQFLQAGLATSSSGIFGSIRQALSHLSIRGDVAAVRADRSSRVGERNIVALSKKARLQAWRLHRSGLYESLGDSDAREDIIAAIHEYDQASRDFPAESFEALDFTYVPQGLEPKYLELTRLSSAISQDDPQIQHLVLLGSFTKRTTARYVLVELVLEPGRCHVGMIRPLTSYATPSPVPSDPQVGRPRIYLPRPALVAYAVFDRAAVIASVAVPPESPESQLQFDSHILPPAFEDVVDFREDGHDILGSGIEEIPALSHSNEENRLQRQRSKNPAAILLVRGAGTVRIITTDVDKLASDQPPKVSAKSKMEQAVFFGMKADNPLIFDARSETKFSREETAAAALEVSHEILSSTTSHLAALPPSMEDNLRARSKAMERLMNHLQAINANLDRKTRWSLLHNAEKMYVAVLMWRLHEDFTAARPSNDKTDILKYIVDSINEEQKSTLSTQIGENDPIRHWFINDVHSIQYLVAWAYELIKTFWKEKSLKEKFLDEAKLTVMMHEAVQINVRAHLGAVAFRKNNLAFYGLEGERLQNGILIDGYEDLEEPWTGCHFVANNLKRLVDLSTGWCETHPHIGKQKTPTEPDPKIMAKIFDELPALIEVMLSAAQEYARWGQAQSDPQTKERAASFSKLYSEARYTLTTGLAEMEKWDEAARIAEKHDSLDALAVILLGHIWYLEAAREEPNISPVQAQTLKTTRSAKMTKLEECFAEYGEPFAFPAYAHLLESHGVDAVLGFELDREGFKTRFLRSRPELARISWIHDVQQEKNVEHAAQTLLDLALTKEQQVWNKKVELSLGKLALLAEQSDKSSNDFRVNADEARKEQKLKQVDQELVAIKIQQSLYNAVSRCTYAAVDDKAAFEFVMDTHGKEIPGRQKALNQIFADGVKRLLNHEALDAMTLIDLLTLLRLDESTSELIFNPFWLALKVADSVCHTDEVKEAKRLIWRRAFLRDDWAKVNNTQNKSDKDIVEALADTEIFDLLVACIERQDKNAPFTPMQPQDALGAFTEAPDRRFRDFSDESFKNKYLENMRWEDKQLQAHLDKRRLANWVQATFEEAKTQVRLDADEATWEGAQAAEGDEHMMNGV

SEQ ID NO: 1051 - protein, 68 aa, Unknown
  Kingdom: Fungi, Phylum: Ascomycota
MDPTVAKMGAAASVATAADGYKEDNFRVYYADQRLEDGSPVWAGADGEDRTDGSCISIDLAGTDEARP

SEQ ID NO: 1052 - protein, 781 aa, Unknown
  Kingdom: Fungi, Phylum: Ascomycota
MAGMAKILRSIVRNDAMRADPDAIYGWRVFALVCCACFGGMLFGWDIGAIGGVLNMPSTQERYGYLDSSPKHKTLQDQNIVSTLQAGCFAACFFTGWAADRYGRRRCLMATGVITTIGVVFQAASAAKGTLAVMYVGRFVAGIGVGAASTLTPLYVSECAPRAIRGGLTAFYQLFITFGIMFSFWVNYGCLLHVAAPAQFIVPLALQALPAVLLFLGMAVSPESPRWCARQDDWEKATAILVRLRNLPADSEYVSSEIQDMAEQLDHERRLTGDASAKTLFREMWLIPGNRKRAIISVLLMICQQMTGTNAVNYYAPQIFKNLGMTGTSPQLFATGVYGVVKTAACAIFLIFVADSLGRRRSLIWTSIAMFIVMYIIGIYGRTQPPVEGAPVSPFGYVAITCIFLYAAFFQFGWGPACWIIVSEIPTARLRALNVALAAGTQWLFNFVIARTVLTMQETMGTAGYGMFFMFGTFSVIMGTFVYFFIPETKGLSLESMDELFGVTDASPKDIDADMERGKTPSVREHEDATARYGRLNEKRHQLTSQAEIHPIAEQDPERLDTRLIGTTVMAPTKYAVALFPGFQALDVFGPLDALNFLSKKTPLELYVVAQTLDPVPTRLEGSDLTIGQSVVPTHTFDNVPDDIEVLLVPGGIGARDIELSQPVVDFVKRVHPKLQYLLTVCTGSALTARAGVMDDKQATSNKRAWDWVLTQGPKVNWVRKARWVTDGNLWTASGVSAGMDMIYAFIAEQYGEGVAKDVAQSGEYVRNTDSTNDRFADLYT

SEQ ID NO: 1053 - protein, 277 aa, Unknown
  Kingdom: Fungi, Phylum: Ascomycota
MGFVSGFTGGVTLTLSAAYLSILAHQRTREHQSALLRASAIDVHELIDPRKEQPLPPTRSELAAAERAHSVEAVKDRWNQEVENAARWVQHTDWDDVRATAEASVAKLWSNIFSEAGAEAEKAQAKLEPLEKKAKAKIGQAEENIASAAKGAFEKAKQTTREAESAAILAASKAKHKADAEAAKVEAAVEEKSTQAKGWFASALDKGKEMAGVATTPVGVADVEIATDGLKPLTPVQKALRERYQRPEAKHNTTVEQALKERYTPIDKRDNTVLRGI

SEQ ID NO: 1054 - protein, 303 aa, Unknown
  Kingdom: Fungi, Phylum: Ascomycota
MSDVEDVIDGELPSIDPYETLDLERLATADQVKSAYRKAALKNHPDKVADDQKDQAKERFQQIAFAYAILSDPVRRKRYDTTGSTSESIVDAEGFNWSDFYREQFKDAVSEDAIQKFAAKYKGSDEEKDDLLVAFEQCEGDMDQVYETVILSDVLEDDERFRKIIDEAIEKRDVPAFKAYVNESNKKRTARAKQARAEAAEAEEYAKELGVADKLFAKDSGKKKGKKGGKDSSEDALAALIQKRQQDRRQDAEDFLDGVAERWGAKAPVKNKKGKKRAMEEEPSEEAFQAAAARLSNGKKTKN

SEQ ID NO: 1055 - protein, 337 aa, Unknown
  Kingdom: Fungi, Phylum: Ascomycota
  misc_feature (284)..(284): Xaa can be any naturally occurring amino acid
MAIHTPIERCLRAMSYTYGDFDRLSDEECKSWIPPPVPGTGDHSSRRLWMDSFGVLNFLSLFLETSQGRYLILAERLARTVHEVLGRTRDGAHRLPGATEGRPLLGGLRSGRAPEKEDGQVYRELVMWMFALDRLGRAAGDARWEVLAVELGEAIHPRFTVHKLSGGMRLVGRVSCDMEDVLDVEGEEGDAEMGWAVFRIVREGTKRMVLGREVDELERVIGSEQQQQQQHMQKRRGGEGMSIWVGSLWKGNEIGRKGVERVGGVFEGLFEGVRQTLDEAAEGXWRREDGESCGGGDGRGDGEGRTAVGGEVGDGRGARRGEGGGGCCGCECCVAER

SEQ ID NO: 1056 - protein, 867 aa, Unknown
  Kingdom: Fungi, Phylum: Ascomycota
  misc_feature (821)..(824): Xaa can be any naturally occurring amino acid
MATGVTYDGVESTEGGNIFQGLSFWVSKRVPMRNDVLSKIKSNGGAVVPLEKNAKFLIADHARKDAPPGSFSWRFITDSVQHGALQVEDRYRIGPDPNKPRPAGGGRLTRAGRVAFTPADKATLAKWVLSKPAAGRQGNELYMELEKLNTRHTWQSWRNHWINTLQKLDDHQLKVLAATAPDEHASQGTPHETAEEVASKTTALPDHLAVPQRPVHAAPPQRARVEFSNKDDAIIAQWQLLHSLEAGTSVFKALEQEHPHHSWESWRNRWNEKLRHYSLEKLQEMADTLEEELATSSAPVVANPKAEKCGIAARPTSKRTTPGQGGSKHNTPTTLQTHATKIRPTKEVAAKQPVLSPHTGVTSKKTQSGPVDVDTRSLEEEHKMHQRQPSREPSRGEGAPGIERKRSTDQADEEEDVTAESQDEETDDDPQRDQFYRDLISFNDCEPEEFDWPVLQGPTGKHEVDLYELAQAYDAQRAALEDIDWAEVARQLGWTPEVDTWIVSALQTCFHERLVDFLEAMNDFYPELNIPGAEEDDQEPKTPNTSMRSSPPVRHQSPKRSRGPDHISSAASVKRRRRLEGAEVPSTPDGDVGLSRGFRQKHGISVSPSVLRTSTQTSQQLPILQQTPSRPRTRDTSPLRPLEMVGETLGMGGRREQETSSDDEMPSLIDILRRRGSARTATARRRTLPASFSKPATQAPQSRRSTPPINTQRPPSQPLSSPTETASEWLTRHLRSGYPKRILDIALHHTTQTPGPSADHIVDSLANDNGIPVDLPGVWLCHEDRTLEQLMATNLSEQANSALELAEQNRLREAQRRLIEXXXXKRKRSGGGKPAVLTAEEKRRRQLELQRMMEEEEEEGEGEEEAS

SEQ ID NO: 1057 - protein, 364 aa, Unknown
  Kingdom: Fungi, Phylum: Ascomycota
MPPSSQHNKRRPSLKSCRAFAKQWVQLNWQDILGMAVVGGISAAIYVSPVPVTRTFPITFTHSGDVVFPEWAYPYRGWILPSWLSGLVSIGVPILVYLLAVPRVKSVWDLSAAIMGTIWSVLIATLFQVTLKQLIGGFRPTFLDTCNPDLSNLTNAVNATGLDGSGFQRLFYTVDVCRQTDKWQLKHAMTSFPSGHSTAAFAGFGFLFLWLNAKLKVWADHRPAFWKLAATLIPLLGALMIACSLTIDAAHNWYDIVAGSMIGILTSLAAYRASYAAIWDWRYNHLALQRREAFLYSAGSEDEDGYKEHTVTRSVGWGGQRDWLGESTGLYSATTGMRPGRQEPAQGTGGQANIAGLNGEGDIV

SEQ ID NO: 1058 - protein, 2039 aa, Unknown
  Kingdom: Fungi, Phylum: Ascomycota
MAAAEVDVGFVAGNLGLDLPAVQAVTTNPTAELVATLLQAVQKKLHEYDELYSSKLQVDIEYEAAVRSAETRSQTSKSTVDKALKDTEEARQKLKEEEDKRQAVENELRTLKAKEAEHDGEIKSLHDKIEALEASNRTNLSIIDSHNKRDESLTEELTKQHQRNVELSRELTASQQAEQNAKGQLTSAKYRMEALQQQLEHKTRNEEWLEQELKTKSEEALKTRKEKGAKIAELQRQNEDAKAALEAAKRTEDQLRNRVNTAQAKADEYMVKLQTQEGQFASTIESYKAELESQRRLVDMSDQLSKKHQQRVRDLDAEKERLRDNYESELHRVRVELEQEREASKAAEEKIHELESRIEELQSRTDEMPPPGSAPQTPRANGSFAARAASPFGTPGSVRSKSSISATQAIEQLHHTKLQLANEKRRTRQLSEELDSMMNALEAKAPEIQELRQESSKLEIEIARMSELSQQSYEERDVAKRAARKAEAALANAQSEGRILRSQLRDLGTQIQMLVFNIYALEKGTEQLTEEETFRLKQLEKGEITEEALQDMSDTHQFITRKLVVFKDIKSLQAKNEELLRITRELAEQLESDEALAAKHQAKEDHDQVEKLQQELMHMTDEARSIKNTMESYKTERDMFRRLLSQRGVGGEENMMRMSLDGRLPLASIESGEQTEALNEALRKVQTEFDGFREAQDGVRKDMRDQIDRLTTDKNALQTENIRLQGEVHLESERRAMLQTNYVALQNENAELQKRSQALSESAARQDIKTQQIAEELIEAKGLLQSVSNENANLKAEKKLWKDIQDRQSKDNESLIEEKNRLNNLVATQQSLENERNLADAEARRKAQARIETLEQELSDVQRKLSAEVEETKKLQLRKEFEAKESQKRIDDLMASLSQIREEHIGAKTARDHLQARVDELTVELRNTEERVGRLQPRPTPRPGTTDNAQQQQLETEIAELNEEVIELKRELDMANTHLESAKQQAEQYKELSQGNEEALEDLRAAQEQYRQEMESLIEEKDTKIRQLTQSMEDMSSELSRTNTELSTLRDSQGDIARKYQDEKAILEEEVNRLKEDSARHLEAARYHQQDLRAQAEIASKAQQDYEQELVKHAEAAKLLQQLRTEHNTVKSEIATLRAEAESAKVALAQGESSWEDRRQQLEQEVAELKTRREDVNAQNKLLHQQLEGLSAQVTALQQSRNKQSEDQDEAMSPVAFGDATDGLRELNNYLRREKEILEVQYDLKTQEAKRLQQQLEYTQSQLDDARLKLDQERSQSSQNSKGSMTHQDLMEKLNELNLYRESSMTLRNENTLLKDQIAESNKKVEEMRSRVQPLEAEIENLKTQKSFLEDEMKQIQEDRDRWQKRTESILTKYGRVDPAEMEELKQKVTDLETERDTLKQGEQPLKDKVAELESTLETERTNWQASRQKIIEQAKERSRKQTVEKNELQQQLTSVNSELETARNKSEESGKQISELEAQVQNFRKQVEELRQQAPAANPEPTAPAPVPSGEATVSAEIVAQLEQQLADVRKELEAVNAQKLGAEQQVANLRSEMEAAIAERDSQIQQLQANLSSANEGQGAEPQAAPQTNDAQQAPALTDEAKAALEARIAAAEEKAAEYEKKAAEIEENMAATLKQRSDKMKAQMNQRLKEGKDELAEEKLKFEQEKAIWNAENGVKNNAATAPPTEAQGPPPTPSTPAKPENTTTPATPSAAGLPDLSQFDDATVRQLLSSNQIVKSIMSQNIKKRVDTESAKLKAEWEAKVNAARDQAQQLEAKKSALRINMAEAKSRGANAKLGVVETAAKETPDKPVGEVWEIAKKTPIPPAPAPNAAAGAKSAAATPVKPTVAPAALSTPAQQSTAPAPTAPTQNTPTQTAPATPAANGTTPKPQAVQGATTPAAGAPSAQPNPFAPTANVTPADTASNPFAVKTEGSSLPAKPQQPHQAGQQGQQTRSGIPMPRGGGGGARGRGGHYVAPGQRAASGTQEGVAASTRGGRGGARGGRGGMNPGAQDFQPGAKRPRGDSEVGGGAKRARGAH

SEQ ID NO: 1059 - protein, 101 aa, Unknown
  Kingdom: Fungi, Phylum: Ascomycota
MSNGRAEPIQHKAGSRVDFRPEVHGIDFNNFSDADFDFVSCFLPLCTSTGSWCPGEQPEMLTPQQQYKLTAWYVWGVSENNPQVYTRMVVSDGEDAIQLRP

SEQ ID NO: 1060 - protein, 254 aa, Unknown
  Kingdom: Fungi, Phylum: Ascomycota
MSSNSNTSGGAGVGAGTTDMETLTSVASAASKTIFGDSSDKKEPVSGRSGDVSKGEPYDAGNLDPDDQKKFETLPTPTPGTENKNPLHVRDDPVAAATTSDEPAPKGDTSAGQTDPKPQPTDTSDKPEEATKSEEATLPEQPKGPGPKPVEVLAKEHGGNAGAAGKEEAHKEEGKAAETEEDGKNKGTGEQVVHASGLAADGGDFDASKPGAGREADRLMEEHGIDHGEKDGKSGSGSGKRSLKDRIKAKFHKS

SEQ ID NO: 1061 - protein, 545 aa, Unknown
  Kingdom: Fungi, Phylum: Ascomycota
MLHNSSRDRSVAEAIPVARHAQYEGPPKPSIIEEIALRRVKAGKLVAGVAAASNSDMFKGDTSGLPKAKRWDSHLSRESLDRKPCTLKLAAKHLKKPGLISLGGGLPSSQTFPFASLGMTVPVPPHFSEEDTMASGQTVTIGKYDVRDRPTDDKTTYDLSIALNYGQSTGSAQMVRFLTEHTEIVTKPPYADWAVCQTIGSTGALEQALRMFCDKDRGDAVLTESFSFSTALETIAPLGVKAFGCKIDDQGLIPDAMDEMLSNWDEKSRGSRKPHVLYTVPSGQNPTGATQGTERRRAIYRVAQKHDLFILEDEPYYFLQMESYTGRPTPSRPQQEDVSSFLSSLIPTLLSMDVDGRVMRMDSFSKVLVPGSRMGWITASQQIVERYQRHAEVASQGPSGISQIILHKLLDETWGHEGYLRWLMNLRVEYTRKRDALLAACEKHLPQDIVAWTPPAAGMFMWLDIDHKKHPNAATRSIEDIEAEIFDSCIDKGVLVARGSWFLTEKDKPLPGLHFRTTFASASDEQMDTAIQRFGEAVRASFGMK

SEQ ID NO: 1062 - protein, 473 aa, Unknown
  Kingdom: Fungi, Phylum: Ascomycota
MMTGRQANKLVALGTFVHCHSRQAVEFMHNSVVCVDENGKIVRIEKETGEGRLHTKAHAVLEELGWHREDVNWHVCEPGQFFFPGFIDTHIHASQYPNAGIFGKSTLLDWLETYTFPLEASLASLPKARQVYTACVRRTLAHGTTTAAYYATIDVAATNLLADLCLSIGQRAFVGRVCMDDKGLNPDYYRDESAEASIQKTKEVIEHIESVDPSFDIVAPILTPRFAPSCSKEAMTGLGELQREKNLAVQTHISENKGEIALVAKLFPDSDSYAGVYDQYGLLTPRTVLAHAVHVTTEEADLIASRGAKVSHCPCSNSSITSGAARVRWLWSRGIEVGLGTDVSGGYSPSVLEAARQAVLVSRHVAMGVEQEGEEKEAAKLTVEEVLYLATRGGAKCLGMEERVGGFEVGKEWDAQMIGLAVVGEDGEKTGEGNVDMFGWENWEERMAKWLYNGDDRNTKKVWVKGRLVHERK

SEQ ID NO: 1063 - protein, 397 aa, Unknown
  Kingdom: Fungi, Phylum: Ascomycota
MSGQPPSPPPDDLDLSSTPGYRGHTQIVLNATLIAFSTIFVGLRLYARCFMVKRPGLDDLLAVVALACLVALSVMEIRLVEFGSGTKIQYVSQSRLKGFFSALTTQSLLYFWGVCLMRLHIAAFLPNLHNDKRYLRLVYGVAGVTLLSTLIFFFIKIGNCKPVSALWLPPYMSQGQCMSEKTTDIMMNIHSVLGIAIDISLVALPVWVIHTKMMFSGRKFRVILIFAIGIFVIVTGLVRFVLIRITPFNVDATYSMSTIGLWTDLEGHVGLWCGCFPAFQPILRALFNSLGLSQLISSYKGSQAPHYGQSKPTSGSRGWNRSNAIPLSSRPQGTNAASDDASSQKGIFPSDSDLAAGHGGAAHSGIVKNTQVEVFYEQRDSSSAEHKDADWNQDRLK

SEQ ID NO: 1064 - protein, 136 aa, Unknown
  Kingdom: Fungi, Phylum: Ascomycota
MAPKYEAVRTDGAPLPLPQFSQAVKYNGMVYCSGNIGAVPGKAFELVEGTVKDRARQALRNISAVLEAAGSRLENIVKLNIYITSMKDFALVNEAYDEFFTWDPKPARTCVAVHELPLGTDVEIECTAHLDQTARL

SEQ ID NO: 1065 - protein, 391 aa, Unknown
  Kingdom: Fungi, Phylum: Ascomycota
MFSARPSTNLEGPGDPDHSAVTKNVSATTCGAEVRDRSASYAALSNTLVVITGVFVITRFAYKIFFAKLPLGMDDWFVLATMVAACPSAIITVNGVTANGLGRDIWTLTATQITHVLRYFYIMAWLYFTQVTLVKLSIITFYMRIFPAKGVQRVLWGTFIFTVLWGLAFVLTAIFQCQPIHYFWNKWDGLHKGTCLSTNAISWSNAAINIALDLWILAVPLWQLRELHLHWKKKIGVAFMFCIGTFVTVVSVLRLQSLVHLAEANNPTWVFYDVSVWSTVEICVGIMCACLPTIRLVLVRLFPVLGGSSHRSRGNQYYEYGTGPGSGNPSRNPGLSARGTVGMVTADRRGSDPESSASGIVFEKTYDVQFSDDEAKLVQMRTLDAKGRTVK

SEQ ID NO: 1066 - protein, 205 aa, Unknown
  Kingdom: Fungi, Phylum: Ascomycota
MSTSPVPLHQDPQCGPSIATPDYGHGVFTVSCSTVISAPPQKCLDIVLDGSAYPDWNTFCTAVTIDHVPSPPDASWADAPPELQHLLTQDSALFPGVDFKFDCVMKEGAAPTKTALHVSRLEVLHRGGHAGYRVAWTMRGSPHFVLRTERVQEFIPTEDGSETEYYCYETFGGILAYVVRLVVGSQVADGFGRWMTGLKEKAERP

SEQ ID NO: 1067 - protein, 445 aa, Unknown
  Kingdom: Fungi, Phylum: Ascomycota
MSEPQRTPSKGHTRNKSSLKATRPRSSTKGPLDIDNDPLAAASAAPSTPSQLTPRTHGGPRRSTSTARSPSSPAGASSPKPRLGEFRPKDFSFLLRPEIYHPLTPLNVPAAFRNSGKQPSPEAPINELLAKGHFRAAAIAAVQELTGTGHRGQVIPHDAPRIFNLLYTRLACLTLIDATSLAAQEVKALEDLNNTRTYVDETTGEHLVPWELRVLNVRLQALGFGDSRRAVMSYHELAREARDNISKAMTRHDNYARELWKARLHDLGIKVAGALIEMDDLAGAAHHLASLPNRGDNKHALSKALLWLQLGDADQARECAKECTGGVEEAENTEVLIQALCDMADADYEAALAKWERLQDLDDEMIAINTAVCLLYLGRMPEGRTILEKQIESGRTSHTLLFNLSTMYELCTEKNRVLKMKLAERVAGMEERPSGWEKSNMDFKL

SEQ ID NO: 1068 - protein, 615 aa, Unknown
  Kingdom: Fungi, Phylum: Ascomycota
MLATAARQHQLRTPDTNGAHANNPAPSRDRGFVQNTAQPTSRTAQTFPPSYSYISEPNLATTLPTRLGHSTHNDRDVMLPPLSTVARGHGMRGDSHHVQKSMSAPSWPALSPIVLPPTAKTDSPSTMDLDTGSNSLNSAASPDRYGDGRAPSVNLDDPDVRLAAEALGDLRADFVSSPPSSTATLPMSPPAAVSQASRTQSPQPEPLFSLLTTSHPFLATTIGGASSAYGGAKNYSPRFKSGAEYVENYLTPIANTVGSVGRVTGVEGSVRWFLGAGRRNTSSSSDVEIPGNSKKRRKVDKEGERASNKRLDQETEKHLASGQRELLEQEMYPPTPKGDRRLSLASTVDTLPAYDDMRSPAYTETAESQRGSTSNASSNAAWQSRLVMSTSGLGVAMSDESLKSLKYCLRWLRWANDHMGGVIGNLKNTLDQYDNHQDNGAAQLEETIRQEEAVPADETALMTPEQAEQSRTELANRINVLKGDVLKTLQDVINTVSKYAGGALPENARILVRRHLTSLPQRFRVATMVEDNGQGGQMDSESAMRDGAQKVLVLAKEGLDMVAQVSGVLDGTIVSAEEWCERMGKRKPRTDELPQQQGESPLLPQTEPEADVKMS

SEQ ID NO: 1069 - protein, 371 aa, Unknown
  Kingdom: Fungi, Phylum: Ascomycota
MTNIQLWWDDWFALLAWITGAGWSGVIIAWTLTGGLGQKLDTLSISPEEAIRRSLIYTFNAELLYAFSLVFSKYAILGLYWRLFKTCSIRLPIQSLFVLSTVWIIIRTFMTVFHCVPTQAFWDLSITDKVCNIDNARFFFGTTMTHLFLDVAILALPIVQVRKLNLRKGQKLGVIGLFMFGVVVCVAAVVLIVSSTSFNKDSPEMPYDINTIMIPATVEVNFSIVSACLPMMRPIVQRFMHGSPFGSDNTSSGGGPRGGGTTSTVAKLRTLSQAIELDDNGSTQNFADRHFSSHYWANTETGSSASARGGCRDNNGGPDQSNPYPKPLQHGLRTVIKTTAERASRTEHSPTVGGIMITNEMTLSYENAQVN

SEQ ID NO: 1070 - protein, 356 aa, Unknown
  Kingdom: Fungi, Phylum: Ascomycota
  misc_feature (300)..(300): Xaa can be any naturally occurring amino acid
MTVASNRACVWVGKRKIEVQQKPVVPVGDGDVLVEIITTGICGSDCHTYASDQVSRQLVMGHESSGLIKEVGKDVKDRFIGQRVAVEPGFACMACEFCLNGNPNICVDLKYCGMEPTDGTLCQYFTCRSSMAVPIPENVSWEEAGSIQPLAVAVHLARRASLTAHKSLAIFGCGPLGLLVLAVAKAYGVRRVCMFDIEKSRTDFAVSYGADAGLVPPKLEAGKDSLMHAQEYADKMIKELGAGHGFDVTVEASGAAICAQMAVCFLKAGGTCIQAGLGKPLVSVPLFLITAKELNLRGPXVRFTPGCFEDAIDLLARKKVNLKPLITSTYPLTKSAEAFEAQLARKDIKIIIKNQE

SEQ ID NO: 1071 - protein, 311 aa, Unknown
  Kingdom: Fungi, Phylum: Ascomycota
MPDSDSDDYTKANRYTFKNNDYDGEGLREKLDRDGFVKIRASLRSAYIIRLQAITEAVEQRARQGQWPHVRTVGKQFPPWDPADAVSRGVWGVQHLLKPTCPFSEEYADLYFSEGLLRHARALMSCTDDDLVMELFNMLIRPEKDFELRWHRDDIPPEATAEEELERLNQPSWHVQYNLSLYHDTSLIVVPGSHKRARTEVERAAGPYDELPDQVRVQMDVGDIVFYNNNILHRGAYDSTKERTTLHGSVGHVNGSKHRARNVLQHGVGDWVKDIDLSRLSPELRRRAEGMRDRLIKLGSESGDVGYSLHG

SEQ ID NO: 1072 - protein, 365 aa, Unknown
  Kingdom: Fungi, Phylum: Ascomycota
MIHRASYLPIHRHVTSSPSLVRHIYSPRRLAAIASPSPRPFSVASPSSSSKMKLLYPTSLKLDTKSIDGFSVSLHPYDVTQKIPEDLIDAEFLVTWANAAENLKDAAPRMKNLRWIQSLAAGPNDVLSAGFDTSKIAVCTGSGLHDHTVAEHTLGLLLNAARRFYEMRDYQLQSKWPGHLGGPQPDRPAGRFTTLRDARVTIWGFGNIAKCLVPSLRVLGATVKGVARSAGVRDGVEVVSTDSLPSILPETDVLVMILPGDDSTLNALNRDRLALLPKHAWVVNVGRGTAIDEDALADALDQGSIGGAALDVFVKEPLQEDSRLWKTPNTIISPHAAGGRPQGAEALIAENLRRQLAGQPLKNTI

SEQ ID NO: 1073 - protein, 580 aa, Unknown
  Kingdom: Fungi, Phylum: Ascomycota
MMDFLKNNGAFAPTSFRLQQLAQDAYDMPLRAFVNTHDSHPSLGHLCLLVFEAVLEVVCVSLPGYIVARLGHFDADKQKFLANLNVMLFTPCLIFTKLASQLNAEKLTDLAIIPAIFLVQTFISWVVSILVAKLFGFNKRASNFVTAMGVFGNSNSLPISLVLSLSQTIQGLHWDRIPGDNDDEVGARGILYLLIFQQLGQLVRWSWGYHVLLAPKDKYEEYQDEITEEGNYRREAEVHEEHETQPLIESLDGETEDGQLDHDHHSVDSQGYDPAGRTPVAGASHASLTELNQSNESLPRKKLANNPTALGGNHPILNGVNSDMMSFPRINNEDDAEQPELENQGFISRMKYRFRHKVAVTKRNIRTSAQRIYEQMPVSVKKAVSFFNRAWEKTYGFLWEFMNPPLWAMLIAVFVASIPSLQQLFFEDGSFVKNSVTSAIQSSGGVAVPLILVVLGANLARNTMAKEDEAIDPEEEVIGTRLMVASLISRMLLPTAIMAPILAVTAKYLNVSILDDPIFIIVCFLLSGAPSALQLAQICQINGVFEKTMGRLLFQSYVIWILPSTLLLVMMALEVVEWAR

SEQ ID NO: 1074 - protein, 300 aa, Unknown
  Kingdom: Fungi, Phylum: Ascomycota
MSASQPAPRGPGEPIYRVEPLTTHTHTILLLHGLGSNGEKFGKQLLETGTTSSGLTLPQLLPGARFLFPTSKRRRSRAFGRSMLTQWFDIANLQDPEFRKEKQLKGLAESAGELLALVQKELDTVPARNLLVGGLSQGCAMSLAVLLSLDHPVGGYIGMSGYLTYQSDLQDALAEDEEDAQGDLDEENPFSAPEVAVRERPHPSVQAQTFQRDLLALEPLEEPARDKTAYGTPVFLGHGVKDEKVPLGLGSSAARVVRFAGYEVRWRAYEELGHWYQVPEEVDDIVDFISSVVGWPVSPS

SEQ ID NO: 1075 - protein, 458 aa, Unknown
  Kingdom: Fungi, Phylum: Ascomycota
MLPFTSAGLLWLAAVASASPIVARQAIDCSPSSTSGLKAECWDALGMEQYINEWVAANGTAADCDNLGFAQCYLQFNGLTTLTCDLITSSTCPPPSSTAVYSSDQHFYTLWNIYAVYQFFNQYSSALSNGVSLAGQTVDKIVATVAPPIASQQPASTLMNILSSTLGVVSLFTGVIPGGGGPAVSLIHGGLSQALALSSRIPATLVKPSQSANDRFIQLGDIGSSLSTLVVQYQANLLDAVALVQRNHTVFAAACSQGGFSQRITTSLTIQSSELYRQLQLFTLSTALKANGIVAAKSTGVDALKVAGETSEISCAALTTPGDFCNQWWLDGEGNTYSFHNPGDTQNTHVDLTRTIVEEGWATLDQVFKVEQCAGAAPTFDPANVGVTCIASHGFCEWNYQPTLAETKAQPQFKNCDNDPNWGTLCSSFEERILVPESYLGPILLPDRNGFAQMCKRR

SEQ ID NO: 1076 - protein, 216 aa, Unknown
  Kingdom: Fungi, Phylum: Ascomycota
MSWMESPPVAATIWGCAMSVFANVCGQLITAHKTNAAYAIDWIPVFRYLLFTLVSTAPNFYWQDMLEKSFPQYIQPHHPKKTDEKNPPAPKFSVRNTITKFILDQTIGSILNTLAFTSFFGAMRMAMEPSPRITSPFKAASYWVSPRAIDFEKVDMGEVWAQSMEQLWPITKAAWKLWPAVSLVNFTLVKTVEMRGLVGGLAGIGWGIYMSIVARG

SEQ ID NO: 1077 - protein, 799 aa, Unknown
  Kingdom: Fungi, Phylum: Ascomycota
MIGSLWRASSTAMRPHLLVMPSMLRAAMQRGRIPIQAKARSLTTLSEVLSGMAEGRPRSQTNVSPTEQAFEAEREERKSRLQTRKKPAWQPLKTQRPEQSSDLKPVKSADPDGASETSAVQRNERFRAIFKATDEHTVALAREKLGTSPFVPDVRKYPNELSCDLSLADAMQVAKVHVAQDRIWAHHGQRTPSLSMILNAMQEMAKKQDDGAPAMEAMRVLLPEKVDLTLPSRRLEYVESATGLLAKLNVSIDHPNPDRGIILRGRGKLLARAADEMIQYNKDIKIFHLGKVSTFDYVTRQLWPNLQDDQDHLIPDDDSRKAGGESMDNIWMHREAEIESISYPYERIPKPDTWTKSSFNQYITSLIQKRLKTSAIRRFYKRATDTDGVRVNLMMEAFEDPEIRHCITPVVLNQALSFMMWRGGHRASAERLFEMAQEWGVPMDTTTFNIILGGYVANRSTAHFYRVLRKMRNELFVPNTRTWLHVLQLAESDDARRNIIVKMYDHGAFDDPAARREIASIMGAHDLHVALRTGQTLQQFCLDQADRYGPDWFTTSALTSIVKEFLMFYDDVTGAHKAKFQELQMLFERQPDDGIDSHRKAIQAILTTAVRRKNWDIALWALELRAKLGCVPDPDLYTALVDLAVETQAPHVLGALLIHGTATDMLSWNSKRKIQRCMIGDYPSAFWRLVRLQCFDNAMINGLHDRGWFSGRHPIEVVEDAIKSSIGKRAKPVETIEDLVAREYREADVPWKELWQKREEGAKIPELRPLKIEFRMGVTLRRWVDTRLADPARRDQPAW

SEQ ID NO: 1078 - protein, 216 aa, Unknown
  Kingdom: Fungi, Phylum: Ascomycota
MQAPSVSLPLVLFVVLLLLAGSSTAATVTVTAAPAIPSDEPQFKTTHLFTSAILNSTNLYRAQHNASAVSWNDTLADFAADYLSSPASDGSQGGCKFAHSGGPYGENLAMGYANATASVEAWGEERDEYDFSKQGFHEDTGHFTQLVWKNTTDVGCGRRLCGERGWYLVCEYWPRGNVIGEFDDEVGRKEGAAVAVRPGAWMAGAAAVVAMCMIVC

SEQ ID NO: 1079 - protein, 597 aa, Unknown
  Kingdom: Fungi, Phylum: Ascomycota
  misc_feature (590)..(597): Xaa can be any naturally occurring amino acid
MAAAQDGEQVYATLLLSDSYLPGALVLAHSLRDAGTSKKLVILVTLDTVSGDSITQLKAVYDQVIAVPRIRNDHPANLYLMNRGDLHSAFTKINLWRQLQFSKIVYIDADIVAYRAPDELFDIQHAFSAAPDIGWPDLFNTGVMVLTPNMADYHTMVAMAEKGISFDGADQGLLNMHFRNDYNRLSFTYNVTPSAHYQYVPAYRHLRSTINMVHFIGSNKPWFAGRGAQGDSPYDDMVGRWWAVYDRHYGAQRSTDNTTQPNTKYVQYFTKGEWQPSVAAGPTATGEHDQGRHDPGSSADVVNPPSSQSPPSAPGRIVSASGHGQSPAAGVSAAHDSRALPSSSDSASHATGTHAEVRSEPHRSGQQDEGNQAAPPPPPPPAEEPKQVGSHSWDAQWHPPPVDSKPEAINFPRTHYEMSRDAAPFVPPARYPSPPKNMWYEVPKEPPTPTRPRAIFPWEHNQPRASRTFAGEPEPSVDTRDFAPPESAAEAKNEPPTPSTPTIKITSSDPWNSFSRLNAWDDVPEIGRYVEGLQKNRRGKSQGSGGTSPVGLTDFPSEVERPSLPVTPAPIHRRSYWGEEAVKPGDEKPXXXXXXXX

SEQ ID NO: 1080 - protein, 341 aa, Unknown
  Kingdom: Fungi, Phylum: Ascomycota
MSTALVSADDALEPTLQTLLDQRSLRWIFVGGKGGVGKTTTSCSLAIQLAKHRRSVLLISTDPAHNLSDAFSQKFGKEARLVNGFDNLSAMEIDPNGSMQDLLAGQGEGQDDLNALGGGMGGMMQDLAFAIPGIDEAMSFAEVLKQVKSLSYETIIFDTAPTGHTLRFLQFPSVLEKALAKVSQLSSQYGPLLNGFLGSSGQLPNGQNLNDMMEKLESLRATISEVNTQFKDAELTTFVCVCIAEFLSLYETERMIQELTGYGIDSHCIVVNQLLFPRAGSECEQCNARRKMQKKYLDQYEELYAEDFNVVKMPLLVEEVRGKEKLEKFSELLVKPYEPPQ

SEQ ID NO: 1081 - protein, 1310 aa, Unknown
  Kingdom: Fungi, Phylum: Ascomycota
  misc_feature (292)..(292): Xaa can be any naturally occurring amino acid
MSDKRGIRIAIDRGGTFTDCVGEHNGEEIIIKLLSEDPSNYKDAPLEGIRRIMGHFTGRDIPRGEPLDTSQIDSIRMGTTVATNALLERKGEKIAMVVTKGFKDCLTIGNQSRPKIFDLAIKKPDVLYEQVVEVDERVTLEDYAEDPYRNITKAEAKAGTAEAQGKHLIQGLSGETVRILKRADEGDIKSKLQDVYDSGIRSIAVCLMHGYTFPDHEKLIGKVAKDIGFQHISLSHELMPMIKLVSRATSVCADAYLTPAIRKYIDGFSAGFEGGLGTRSVKEEKGSRGARXTKTPVIGFDMGGTSTDVSRYGEGRYEHVFETTTAGVTIQSPQLDINTVAAGGGSRLFFRNGLFVVGPESAGAHPGPACYRKGGPATVTDANLYLGRLLPEFFPKIFGENEDQGLDADASRKALEELTEQVNKDTGKNLSVDEVAYGFLTVANETMTRPIRSITEAKGHDSSKHRLATFGGAGGQHAVAIAESLGIRQILVHRYSSVLSAYGMALADVVDERQEPESMTWEDKAVSSLKERMERLKEKSRASLRDQGFEDKEIAFEEYLNMRYRGTESALMIIKPNEAEAKEFGGNDWDFGQAFVKQHRYEFGFTLDDRDIIVDDVRVRGIGKSFRHNERTVDQQLKEIKRKDVSEQKHGSQQVYFEGGRQDTPVYKLEDLSVGDVIKGPAMLADGTQTIVVTPTASALITETHVIIDIVDDRKDESHDTSEVDPIMLSIFGHRFMAIAEQMGRALQKTSVSTNVKERLDFSCAIFDASGGLVANAPHLPVHLGSMSTCVRRQAEIWKGKLQKGDVIVSNHPSYGGTHLPDITLLMPAFDAKGEKILFYAASRAHHADIGGISAGSMPPHSKELYQEGAAIRSEKIVSQGKFDEKRVTQLLYEEPAQHPGCSGTRSLGDNINDLRAQVSANQKGISLIETLIEEYGEQTVQFYMVNIQKNAEDCVRKLLKDVHKRFEGKDLSAVDFMDDGSPIALKVTIDPEKGEATFDFEGTGPEVYGNINAPEAITYSAIIYCLRCLISEDIPLNQGCLKPVHVKIPPKSILSPSPGAAVVGGNVLTSQRITDVIFKAFEACAASQGDCNNLTFGFGGNQTGKDAVKGFGYYETIAGGSGAGPDWNGTSGVHCHMTNTRITDSEIFERRYPVILRDFSIRPNSGGDGQHRGGDGVIRDIEFRIPLQVSILSERRVYHPYGLNGGSDGACGLNLWVRKVEKTNWERSLRGIHAGEEEAGEKEYEERQINLGAKNSAAMEAGDRIIICTPGGGGWGRKGEESKAKRRDDHTQGWKKGSGAARDDAALQA

SEQ ID NO: 1082 - protein, 563 aa, Unknown
  Kingdom: Fungi, Phylum: Ascomycota
MQAFEKYRPASHFIAPHSWSNDPCGAVYVPETQEYLICYQWNPGTTEGGNCAWGMAKSKDLVTWTDCPPAIWNGSSYDQKGVFSGSIQSVLVEGKRVLLLFYTSVSALPIHWSKPYIHGCESQSLAVSMDYGQTWTRHQANPLLSTPPKGQATTGWRDPFVSQWPSLAKLMGVSKDTSFMMLASGDRHKGPQLPMYMSSDLQSWQPVSTILDVKSGEKMSPTSSLSWGMNLECASFFSFGGREYLIVGVEEEDTTRCHNGHYLLWLAGDLVMDKEGPRFQITAHGILDHGILYAAHIFRDAQGRLLQLGWADEAANASAVSSQGWAGCLGHPRELFEISRPISEDHRNLNEWVVDEKTGTMTTLGIRPAPQVDQLHIGSGNTRLENLSKVHSKNIDIQARFAGISGNERFAFNVLASPDMTEVTSIIFDLSASSVTVDRSTSSAQQVGTHTPEVAPIHLLPGEDLEVRIFVDNSIIEVLVNNRLSMTTRVYPTLPDSTRVSYDFGSYDQEKVTIEYWTELKEAWPERDSGRNTFEELHPLRASPMKSEDIKVSGLQTVTEIRA

SEQ ID NO: 1083 - protein, 1225 aa, Unknown
  Kingdom: Fungi, Phylum: Ascomycota
MSQFSANSSKNPTPAPSPPSESPPLKPHLDSTAPSPFPSHNHHQSRPITPPHAPDYALKSESTPSFHVRSVSASGSPQRTYQRSSSRPLSMIQTYQPPVMDIEDTIPELQPIFSFLNSHSNKLYQEGYFLKLDDQNTQGRPNPDRTWTECFAQLVGTVLSLWDASELDAAGEDGEVLPKFINLTDASIKMIESLPTRSNEEQPLQNILSISTAGRNRYLLHFNSHHSLVQWTAGIRLAMFENNTLQEAYTGALIAGKGKTVNNINVIMERSRFKTEEWVRVRFGAGVPWRRCWCVISPPDEKEFAKLQKELKKRSPYDRSAVPVLKGDIKFYDTRKDGKKQKKAQPIASITDAHAAYAIYPQAKSLIDASTLLKIEGHVTIHSDPPSATEGFVFIMPEVRPAVSGFEMLLRFLFPTWDTFGLYGRPGRLVASTLDSRSLMYAMPKHKRYGYLEILDVTALITEDGSSSWNEKEWRKRLKEATGARMNAIEDGTRSHSRSDSRRSVRLSYGGGNGASAPKAKVGFAEERGSVRSSRSFSLGGPQRADSGPDVRNQPSMAAAQPHHARNSSDPSIMASAPPPLNDYSGNASPYSSSPQRNQQIPLRGILQDRMASGEAMSSSEDETGPTPPGHDFDGMGRMRTPEPVQRPPAFNHTNSAANEQKNKAYHSPALRRANSRLSSTTLAQLANAGGVALPRDASQEENSYGRYSEDNRGPSVQPQHAAPGGTSANDNRSREALSPPGQGQGRSGPAYPAPLNIPNHQTRGPSPSNAPPSPYGHGPNSPAYPPSEGRRSPYPPGHGPPPNGPQSRPHPDGRGPPPQGFRPSPDSRPGTSASQRSMQTGGGPPHRKPLPDRAGGPAPYSNQGPIDTNDILDSYGDDPGPARQHPYRGPPGDRTGPGGPQGNYGSYGPDGAGGERPRPGVLKTVGGAEPPVQGRPEVDIPNFGPTINYGAALRKPAPGGPPMPPHAQQQRPYSPGGQRPNDAQHRPRGAPEFEEQRSRPWKPAGMTPGGPQPGVSPEQYVQQRAAAAPQYAHARSPSSDALAELHGQASHPQHNRRRSSFGMLDDGRNQIRDMVNRPSSQGETSSHMSARDQEYMARMTGQPLINVGGNQRQNAPVGPGLLSHIDARERERQQMRQGANQQAAQQAMVQRQQQQAAMHQQIMMQGRNLSPAPGYGPPGSFSRPMGPPSPREPDQHFMPPQGQYQQQQQQPPSGHYAQYQGQAF

SEQ ID NO: 1084 - protein, 1346 aa, Unknown
  Kingdom: Fungi, Phylum: Ascomycota
MTPPEPVDENHPLRAIRPVLAGDQSSSESVIPLRSTKEGHAHQTGGGRFLRDPATQSLSGRRSTSQSPFRLEMPALSPAQLAFSAMQYLPVPVMILNNLKTVVQANEAMARMLDLLPEGVEEDPSVILEKLRGQTLSQVGIDMLQDGRPVWLTWDTFFDAMVDEMGIRGAMSDVRRGSSSSGASTPTIDATPQPSSPEAPGATPGQNAVVEVVISRKTIVKPKSSNKPNDASNQHIYAKMIISIWEVEERQPFFTLTFTSSQSRPSSLVQSRKSIARPSLLEAADRPSITNSNTSSVTSSRDSNSPSFHSPGVVTMSSTPFPPMGPPAMASQSSTPSLLQKMMLIKDAILDNTEMPILAMWKDGSATFPNKAARKLFGELQDHVSSPDGSFLIESWQLWNEDFTHQLQPEESPIAILIKTETPFSNMRIGTYHPEGHKVVFDVLGEAIRDDSNGEFLAGVITCRDVTTMTEEIVQIKERDEEREEHFRLICDTMPQMVWTATPDGMHDYFNSGWYEYTGLTQEESMGLGWQIPFHPDDLEAARPRWLHALETETAYEVEYRCKSKDGEWRWFLGRAAPARNKETGEIEKWFGTCTDVHDNVQTKIAAAQTREQLLSVLKHGKVTLFTVDTERRVTLLEGSLIWDKAEELSKTNRWFIGQNMYAVFNRLTEQLPEGERPEFLQPIEEILDGKTLEGVREHRIDDQWYRTRFIPYHTQGVVPTPDTTAGVIGVIMDVTEIRRREEALQRQSEEKRKAVANEAAAKEATRLKSQFLANMSHEIRTPITGVLGMAELLGATQLDEGQRDFVDNIQSSATSLLTVINDILDFSKVESGRLDIEEVQFSLSLIVKEVGKMLQFAVERKNLDFRSDIDGDIKNDMVVIGDPGRVRQIITNLLTNSIKFTNQGYVRFSVDKERETADSVEVRFTVEDTGIGIQEEVRKRLFQPFSQGDASTARRFGGTGLGLTICKNLLDLMRGRITLRSTLGRGTTATFWIPFHKPSSPQTTKTVQAGVLPDRLQSELSLSCTSSEHDQHGRNSPVSSDIVASPTTSRSRQNPREVTDHVEIPKVERSKILVLVVEDNAVNQKFAIYAITKMGFQVKALWNGKEALDYLMGVIDGKNVKPDIILMDVQMPTIDGYKCTHILRHHMPYKALVHDVAIVAMTASAIYGDREKAFKAGMDDYVSKPVTGSIIEHMITRWTTMRPRKGISSAATDISTSDCSEVSEHCENAEIPGTGIEDNAFVYGEEAATGFDHNSPITPRPLATNGGPEPSPFDSIGSELGPHQQQQVRRQEGEQEWTSKLQENKMLEAAGGPKAVRASQKQDEEDHRERLTEENMSKLENAQPR

SEQ ID NO: 1085 - protein, 512 aa, Unknown
  Kingdom: Fungi, Phylum: Ascomycota
MAYLPTSPLDSSCSSDPSEYSRLIQEAPQLPNTIVDYRTKLVEFYFKDAASILTVFDGNLNPFRSVIGRLWTSSNLLYLTIKSLSAVFLSNIYPQMASVGVSLRLEAIAILSGLKHSELDEKALLAIFMIGGTASWFDADDIGQEHFSIMITNLQRMHASGQIVSASNNRLFFKDLIVCWRMFLAFIDDDDISGEDDDNLHLGLGAQQQPPLHGLDQHSSLEIPTLHVPHPLTGVASEVQRYLIRIGRLVRRNRRLVHDRILNWTNRAAVKELDAQLKEAERLELELFKLRTPSAEEIVDTGDTRTPTWHLATLANVYRHVGLLLLYRVFPDLRATARIRLCKRLSTQSLRLERTECGDGVTNDMHDKANDDVAWLRCLALRIVAALRSIPIESGTKDFHPFLLVAASSDLPIMARSSTANDYGNQHSDCSFSPSHEGSDCYTQELPPGTLDVHDARAFILSHLQALQFALPARPIKRCVDIVKAVWDSQENNECPFWMDVMIQNNWETFMA

SEQ ID NO: 1086 - protein, 429 aa, Unknown
  Kingdom: Fungi, Phylum: Ascomycota
MSSLNLPLPPAPSPPHAVLTKNDLAKSQEAYSELLSSAKAYRTALAALSTAASTFGSALEACARLKEARSDPIGPPGATSMSASFTTKGANTADTLMSASGVHHLIANHQQILSETVYRSFEVPLLHDLDRWQGVIDDEEETYKNKIKAQTKEIKRLEKEGLKLHKQRRRDVARFRAHLVNLTSKLDGLTSTHSDHARALLRESQETSGRIVEASCSLVRAEVDIFESLARKGWTGGGLEDLLEKGQDLFATEHNLGNHGASGVVGHNSGETAKLFSILPPKSILADSASDTSRPGITHTRSDSLLVDNERYQSLTAVASDIRPGDAESVFSADFNRPRGARPFSPQPIRRAPAGVTFDELGFMGGFGEETHEERGTEDEEDRGDEETMRGDDERERLGEGEDGTRSPESLRERHSPEFITDESSPDGS

SEQ ID NO: 1087 - protein, 1901 aa, Unknown
  Kingdom: Fungi, Phylum: Ascomycota
MDRAKKRELRAQNEKAWDRVQDIFPVSKTLDSSLKKNTAFIKRLRTAVTPATLNTFLQEIRSLSLRKYISEIISACYEGLCKLKTPGEIDAGVEIVSALHQRFGPEEFTEQLAWLLGKGMSTPDKSFLKTLSPEAREREEKERLVRQRALLRVVTELWLVGVLRTLDDATKPEDASMGVAGKAGDLKPRSTSNKTGTTEPFPLEVLKDLLGHDREHANLPLLVIFVKAFSWDILGVQPSRSEGQKVIDEDAAGVEAVPEDENVDETANTASGTDQPFTPPEVADRFKSILRRYFEDVKGHIVRDQKSIQSQARRNAEAYVKSGEVFEDRQASYEKQLKAQERLVSNAQVIADAIGAEMPELKEVDDSLGTSNTSVGLLKTGEYLRSISDGAGIWADEDERRFYENLVDLKGKVPPILLEDGKKKKADGDDQVGKKVDGEGAEPLKSNEAADDQSTTIANKTIGAQVDILLARLPELTNEEVIDQTAIDFCYLNSKASRNRLVKALTEVPKGRYDLLPCWARLTATLGRYMPDVPKGLVDYLDAEFRSLQRRKEKDFLGQVRLSNIRYLAELTKFGVVPEHVVFHCLKVSLDDFSRMNIEILCNLIENCGRYLLKNPDTSPRMASFLETLQRKKSVQHLGHTERMLIDNAIYFVDPPERPAIEQKERTPMDQFGDSIGKNQRHVGFTRDLYDIKTNHRNAQVVRILEKVFSKPGKVKYGSIHLLAILLSAIYRYHPEFVVRVIDNVIESVCFGLEQNDFRFLQRRIAEVKYLSELYNYRMLEHPVIFDVMYRIVTFGHAGPPVPGKFVPLDPPDDFFRIRLISTMLETCGVFFNRGAAGKKLDYFLSFFQYYIHTKISLPMDIEFAVQDTFALTRPQWKLAASLEEAAKAFQLAVAQDQKSAGVDKNADAEDAMSVPSSDDELADGDDLDHDEDGDDSSSSGEEENEVWTPSSFKVSPPLTQEQDNEEESDRGSSFDHDDEAIVVTRQEEAVDPEDEADFEREYAKMMTESLESRKFERKQQFDVPLPMRAKVRDGAGMGGDAAADQAPSSTPTMAFSLLTKKGNRQQTRTVELPSDSTFAVAMKNQQQAEKEEQQRIKNLVLNYDLQQSEEPESSERPSTFHHNRVERLAYDLSGASKALFCLATHEFFLELREAGHHDSVSKKNIEDGLASERSAAILTNAQIVYTVIVGVVMLMACLEWFLWLAAFLYCLVKVFQKSEHWSINMLCILVGTAFVLLRCIFLPIMIVTLPLPSQVVQYWPVPMVAFLQWFAFWSFAILLTVPWLFCIYQLVTNQLGRTKRIKQVLDDVTAPKVVIVMPCYREEPDVLVTAINSVVDCDYPPACIHVFLSFDGDQEDELYLNTIDKLGVPLTLDSYPKSIDVVYRAARVTISRFAHGGKRHCQKSTFKLIDKVYQEYLKRNDNLFLLFIDSDCILDKVCLQNFVYDMELSPGNSRDMLAMTGVITSTTRKHSIITLLQDMEYIHGQLFERTVESGCGSVTCLPGALTMLRFSAFRRMAKYYFADKAEQCEDLFDFAKCHLGEDRWLTHLFMIGAKKRYQIQMCTSAFCKTEAVQTYRSLIKQRRRWFLGFITNEVCMLTDWRLWKRYPILILVRFMQNTIRTTALLFFIMVLALITSTKKVDDLPVGFIAISLGLNWLLMLYFGGKLRRFKIWLYPLMFIMNPFCNWYYMVYGIFTAGRRTWGGPRADAAVADSHTTAREAVEQAEEKGDELNVVPETFRPALEARRAVLRSEPQLTDGIIRKKSVVRPPDTVDGKFSARRRTAAGVYAYSDETDGRTGTPGGVGSSGTTCMLTEPQQSPWAQASRESTESTAVPRAGGRMEDFMGDEDQRKYAIARRAQRSRERARNMPTSAVGTPSRTEAQGVNWDRKKKREQQGSSMV

SEQ ID NO: 1088 - protein, 1552 aa, Unknown
  Kingdom: Fungi, Phylum: Ascomycota
MLPEIQAHRPMAAAPHQQHSFNVPAHGQASCHQGHQDVRSNLSFPIRTSRNSDSVLTNTAYAEHRLRRKTPNGTIDVAYDASPLQGTDGPPPYKQMALLPSSFLSPHPYDTSAQAFGGSTLPTQVAQTPRGDLYEEHMAPWPRRHPRSLALITNAGVQPQLWRQQRELLEEAPRAPPQPVLRATEYNVRAFCPPPMPSAAMMPFGQVEWPITNWQGDDRQRFTPGSTFPIPCTPPVSELNSFAEYASPILDVWSTQPLPSTVGPLYTSTARIPNRFEDAHRSAISSSAFPQAGFRDKVLAQAHSDYMELLSFVQHKRKIRQAESGQPGRNVVNLFLYPKPPNPSYRVPSGFTGASKSPLYAFSSDSAGHATPRSFTSPGHCAAGERSDMSSVYFQDPGAYQNELSEANWRWGSESLRMLTDRRDGNALENASSSLDILTNLCEQSNWKWSEGMLLGGCLLYGLERYTEALKWFSRILTIDQGHVESMTNAAATLYCLDRQQEAEQYWLRAVRMRPSYLEAAEHLVGLLYRKRSKDAIEVVSFVQAALRLLQTKGHTEASSVPTTGYSDSHGIYHRAAPPSIPDGVVTGHDPFSLDAHGFGSSGYALPGRDNGRILALIHAKATMLYGLKDVNRAAEAFEEAVIISVGRDIKDVNHLVRHIRSVLTPPDNSSHFRRSISDTLARPLLLTPERARQTARLAFSGAGELPGLVLVANGPSKRAATQTTSNSLLSLAKIFQDAISHGVAAPHLLRRPPGIGDILCLYYLSLSLQESPSTANNVGILLAGVQPELSSAVTQVTESDISTVPGVTPGSGLALALAYYKYGLRLDPRHVHLRTNLGSLLKDIGQLDLAIQMYEQAVACDGTFDIALTNLANAVKDRGRIQDAIAYYRRAVQSNPDFAEAVCGLFTALNSVCDWRGRGGALLPDRTYDRWHVDETGGLIDAHAKRQSSGLTHRVTQIVKTQLQDASRWGLHTLQDDSIHDLVEQLHSLFDGERRELAQALRQWAGEPWEGSRIVRLVERACRVLQRRWYLDRRERLSSKDFRQHSAQTKGQYRRPRLPSSLTIPPAPTVLPFHTFTCPLAAADVRAISQRNAVRISCSTMKSTWLPDHVYPPPPPPSPQLNVGYISSDFNNHPLAHLMQSVFGLHDPRRVKAFCYATTFSDGSVHRLKIEREAPVFRDVSSWTPSELAGQITKDNIHILVNLNGYTRGARNEIFAARPAPIQMSFMGFAGSLGAEWCDYLLADLTAVPISTLRPWRANTDLSDVLSDESESSNGEWVYSENIIFCRETFFCCDHAQSADEAERHVTWTAEQKRRWAMRKRLFPSLDDDTIILGNFNQLYKIEPTTFRTWLRILDKVPKAILWLLRFPEPGEQYLISTAKAWAGEEVAKRLVFTDVAPKSQHISRARVCDLFLDTPECNAHTTAADVLWSSTPLLTLPRYPYKMCSRMAASILRGAMPKTAEGDEAARELITSSEEEYEASAVLLAGDLIYDTTTGVGVGIGRLAHLRKLLWDNKWTCGLFDTRRWVSDVEDAYEEAWRHWVGGGKGDIFL

SEQ ID NO: 1089 - protein, 1415 aa, Unknown
  Kingdom: Fungi, Phylum: Ascomycota
MSSKAILKSINDAIRQQQYGDAVDKAKAFLNKEPKNYQGHIFLAFALDKQGILDEAEREYQAATELRPHDPQAWQGLIKLFEKQGAKKLVDYQQVAIRLAQIFHEAEEMHKCHELVDKYVDFVRSNGDATQYADALWIRLPESPLYPILEGRFPHPSKTYESVAHILEEFEKKRINTLVGERRTRLGARLDEVKLEVKREVYAQSKLEHIFRQLINWTSDDDVRRQYEEKLLRYCYERLLASPSGDSKLQEQDKVLGLANDMVIIRHPYKLAWDIAIDWKDEKEVKDWDVEILRAYCTFFPDSDMAKIITAYLTSTLSPFPKEATKPAPEELSEDSEDDEDGGVPTAYVPLTDEERLLMITEGITTAESTLAYRLAGEYFLSVGEYETTVEFMRKAKDLLAKERRKSGLPFLNTEDAYSLALGTALVYYQSPRHHQDAKALFDKVLERDTKSTPALIGVGLIFEEEEEYDQAIDFFARALARDGSNIRVRSESAWAKALKGDWQDAKDELEYCLNLLEEKGKTDKQLLADAQYRYGSCIWNLEPSKDARKRRKGECAYAYWLKALHNDVNHGPSYTSLGIFYDDYAKDKKRSRRCFQKALELSSAEVVAAERLARSFAADGDWDRVELVAQRVVDSGKVKPPPGSKRKGISWPFAALGVAQLNKQDFHKAIVSFQSALRISPDDYHSWVGLGESYHSSGRFIAATKAMVNAQRLEEELGTDMSGDAWFTKYMLANIKRELGDYDEAIELYRSVMETHSGEEGVILALMQTMVDNALTSVDKGLFGKAVELAADTITFAGATSPEIRQTFNFWKSVAEACSVFTSVQSRVADFPAGEVKTIVEASPQEAFDNLSSVDKVRIESVFSQDIDRGDHQGSLTRCAHAMVLCHKQAIAISASDLDAQAIGYYNLGWAEYRTHVCLASDNNRKTSSPYLRGAVRAFKRAIELEAGNAEFWNALGVVTSEVNPSVAQHAFVRSLHLNERSPVGWVNLGTLALLSGDTKLANEAFTRAQSADPDYAHAWLGQGFVALMYGDSKEARALFTHAMDISEASSLPTRTHYSASLFDHILTAPPNLTVASLIQPLFALSQIRGLRPQDLAFSHLSTLFLERTHDSTRAVEYLENICTAAEADYEKTESADSLAKFTLARTDLARAYLAAGSYEKAMECGELALDLSSDDSGSELTKEQRRQARLSAHLTVGLAKYFADSFDEALTFFEAALEESNNNPDATCLLTQVLWAQGSETSRERARAALFEVIESNPNHVQSVLLLGVIALLDNDSDSIEAVTEELLGLRTNDKVTDIEQSHVGEVLRAIATLGEGKTKVDLVTQVQSDVMLHPYLPHGWSSLSEVTGDAHAAQMALKVAKRGIPPRGLLDCQDLARAHAGTGSVADAQRAILLAPWEKCGWDSLEVAAAGL

SEQ ID NO: 1090 - protein, 460 aa, Unknown
  Kingdom: Fungi, Phylum: Ascomycota
MRLRSRHSPLLLLAVASAVTALTSEGVEIRDNSLSKEHNPRDVPNQNAPVDGKDGVPHTGPFVPESDATEKPGTPELKAPSEQQGTTGLKGGVTEKEKERHISEVATGGKAATQPQAPKEAPPLPHSEEKKLRDGPGGLDDTLVPEIAASKDTAYEVLDGDNDEGGSQESLEANPKTPSDSGTSSLDGHGDEEGLLQPFHSFFLAFTMIMFSEIGDKTFLIAALMAMKHDRFVVFTAAFSALLVMTVLSALLGQVVPSLISKRLTSFAAAALFFVFGAKLLREGMKMDPDEGVTEEMHEVEQELAEKEKELGQRSPHALEMGLNGRASRSKSRFASPPRSPSQSPSRGPASSAESLKSVLQGASNLFSLLLSPAWVQTFVMTFLGEWGDRSQIATIAMAAGDDYWMVTLGSLLGHSLCTGVAVIGGRAIAGRVSLKVVTVGGAVAFLVFGVIYFVEAMYG

SEQ ID NO: 1091 - protein, 547 aa, Unknown
  Kingdom: Fungi, Phylum: Ascomycota
MHLSRSSRRALKALPKSTVSPVRRPTRGFATSCRLQYFNYDQSHAAIPKVKDTPNFIDNQFKQSAATEWFDIHDPATNEVVNRAPQSTEDELKAAVASAEQAYASWKATSILTRQSIMFKFVSLIKENWDRLATSITVEQGKTFADAKGDVLRGLQVAETACGVTTQLLGDIMPVAKNMETKTFREPLGVVAAICPFNFPAMIPLWSIPLATITGNTLILKPSERDPGAAMILAELVERAGFPKGVVNVVHGGKPTVDFLIDNPTIKALSFVGGNRVGEYIYTRGSAQGKRVQANLGAKNHAILLPDADKNHALNAIVGAAFGAAGQRCMALSVLVTVGKSKEWLGELAQRAKQLSVNGGFEEGADVGPVISPQSKAKIEGIIGRSSSEGASIILDGREQLPSKYPKGNFIGPTIIGNVSTDMECYKTEIFGPVLVVVNVNTLDEAIALTNANEYGNGVAIFTSNGGSATHFQNNIEAGQVGVNVPIPVPLPMFSFTGNKKSISNGGHYFYGKAGLNFYTQLKTVTSFWSCTDASETKASVNMPTMR

SEQ ID NO: 1092 - protein, 789 aa, Unknown
  Kingdom: Fungi, Phylum: Ascomycota
MAPEAKKRKLQSANTPASKRPKNHTKPAKASAKKSQKQGQTVPRKVVDASALAWESLGEDFGGLEVIRNVEVIRDGDRVHFSVAEGGNDDKNTKTTTEKDNDNNENHDEGESFEGFGDDDLEGQAGHSNDPSDREAGLASSVSEEVDKGRKQKQSQKQQKPEQKKKTGKDKEQENGRLDGSKKGVQKSAPQGNAFGALANVDESAGEEDDGPEVDMKAWAALTLSQPMLSAVAALKFAKPTKIQAEAVPEIMAGEDVIGKAQTGSGKTLAFGIPMVEKWLELREAPSYERKGPLAVVLSPTRELAKQLGDHMKALCNGLPGNAPYVCVVTGGLSIQKQQRQLEKADIVVGTPGRLWEVLEGDMKLQDAFTRLRFLVVDEADRIFKAGQFKEVEDILGALDKKDPEADGDSSDEEEDDEEEDGDDGKPARQTLVFSATFDKNLQTKLAGKLKFGGKKEDNSMEYLLKSLKFRRQPKFIDVNPVSQMASGLREGLIECGAMEKDLHLYAAMVLNPNRRTLVFTNSISAVRRLTPLLQNLNLPALPLHSQMAQKARLRSIERFATARSTVLVATDVAARGLDIKDVEQVVHYHVPRTADTYIHRSGRTARGENSGVSILLCAPDEVIPTRRLAAKVHAQRSSGGSKDHLIQTLPLNRTILTRLKPRVDLAKKLADAVLAKEKGNGDDAWLRNAAEDLGVEYDPEEFEGAELGHGGRGGGRKKKEKEARSLTKAEMGALRAQLREELSRRVNLGVSEKYITGGRVDVAALLREKERATVGGLFLGGEGLGLDL

SEQ ID NO: 1093 - protein, 374 aa, Unknown
  Kingdom: Fungi, Phylum: Ascomycota
MESASSFPQTSRSLVLSDFGQPLSLTSKPVAPPSNGSAIVRILTTVIRPHHRMGFQGKSPLKFPVPYTPGHTAIARVVATGPDSVNLAPGQLVYVDGFTEARDDPHVVQSIIGLMEGGSQKGGKLFKAWEGFWRDIGTVPLEQCHVLNEAALTKMGYSFGDMQILERLTLAYGACESAKLKAGQTVIVAPATGAYSGAVAEVAAQLGCHVVALTRSSSKLEPLTSRHPRITAVEVTGSEGDLSAAILAACPPSGADAYIDISPPLPGAAVTHFQPSLSAVRPHGHVVLLGMIFDIKLNGVALLLKNITIRGQWMYTRQQVADVIGMVEAGVVKMGGQAGHDVVGKYQLEEWEKAVEAAEGVTGWGKQILFTPRI

SEQ ID NO: 1094 - protein, 292 aa, Unknown
  Kingdom: Fungi, Phylum: Ascomycota
MDLILVLSAAALLVVPALYAYIAAVVPARLPTLKNKRICLLIAHPDDEAMFFAPTVLALTRPETGNHVKILCLSTGDADGLGETRRKELIKSGMQLGLRDEDDVFVVDNPEDFPDSMTTTWDTQKIANLLCSAFAPTLNSPRPKSSSANINIDVLITFDAQGISSHPNHISLFHGARAFIANLLATTASSPVDLYTLGSVSVFRKYTSVFDIFATVGSWWMKGSDSNSEEGQKHPETLLFASKLSGDASFGAAWKAMTEAHKSQMVWFRYGWITFSRYMVINDLRLEKVKGK

SEQ ID NO: 1095 - protein, 537 aa, Unknown
  Kingdom: Fungi, Phylum: Ascomycota
MATVVEANGHLAAGNGVPDVSHNGTQPQADGLLSGYLSNWSGLQISITILLVLMTYDQVAYIIRKGSIAGPTFKIPFMGPFLQALYPKFDAYLAQFASGPLSCISVFHKFVVLASDRDIAHKVFKSPAFARPCLVPIAIDIMRPTSWVFLTGKAHAEFRRGLTGLFTNRALSTYLPVQESVYADYFDKFVEASRANGGKPIKFMGLFREINCALSCRTFFGDYISQEAVKKIADDFYLVTAALELVNVPFSMYIPFTKCWRGKRIADAVLDEFTRCAAACKANMASGAEPMCIVDQWVAHMMESKAYNEKIAAGETEAEKPINLIREFSDEEIGQTIFTFLFASQDASSSATTWLFQILAQRPDVLDRLREENLAARGGDKTRPFELGMLESSLPYTNAVVKELLRYRPPVIFVPYLATKAFPVTPDYTVPKGAMVVPSCYPALHDPEAYPNPDVFDPERWITGDAESKTRNWLVFGAGPHDCLARRYVPLTMAAMIGKAALELDWVHHATDRSDEIKVFATLFPMDECPLVFTKRA

SEQ ID NO: 1096 - protein, 179 aa, Unknown
  Kingdom: Fungi, Phylum: Ascomycota
MSTAPETANTASNNVSSPPAKRVKTTNGDAAADKMESAPPLLIKKLSDKARLPTRGSAFAAGYDIYAAKETTVPARGKVLVDTDISIAVPAGTYGRIAPRSGLASKNFIDTGAGVIDADYRGQVKVLLFNHAETDFEIKEGDRIAQLVIERIYTPEVVEVQELEESVRGAGGFGSTGVN

SEQ ID NO: 1097 - protein, 776 aa, Unknown
  Kingdom: Fungi, Phylum: Ascomycota
MNGDLSLSQALGGLRIANPDDAADLSSPNSAATHSHHPSTTSQHSVSASRSQPYDASAGDPAQAPSHADMARLSMYGLQNDLSLPPTGTSAMSTAMVNSSPHPSRQSSQSSDRRPYDQSRSPMPPSSGPLPPRRSSKGMGGGYASIPAGTPRSYANEVTVSSSSEDWKDRGAAVGVHREIDASGRTVVRQVKKGVRDFSFGRVLGEGSYSSVYLATDRQTLKEFAIKVLDKRHIIKEKKVKYVNIEKNTLNRLTEHPGIVRLYYTFQDESSLYYVLDLCNGGELLGVLKKTGSFDVECTRFYGAQILDAIEYMHSRGIIHRDLKPENVLLDDQMHIKITDFGTAKLLPDPRQMQDSSQRGVPEPGNTDSEGDGRAASFVGTAEYVSPELLTHKTAGKASDIWAFGCIIYQLLAGRPPFKAGSEYLTFQKIVNLEYEFPAGFPMAARDLVERCLVLDPARRLTIEHIKNHEFFDGQPFGKHLWKTRAPKLRPYVPMAQEPNIIQLNGYASSPKPISTSRPQTTMSQATPSNGANRPARIITELPPPTQLDIEWSPVLTRSNERILKLGDLMVLSAPLPHGSNGKHGDEGHKKLSRFFGGSTTKKRQRLVMVTSSGRIILAPSGGEEKRAKQELFLLAPGTSWKIQQDVKGQFVWCVDTGGNHYTFEENKSSTSADGGKSSAEEWIESLERARDLAMSQNNSESYGSDNEFSEMSQQVSSPSSTNAGIGSYGDSYGNNERSNRSHLSKSQGSLDDTASHKRNHRFSKRASRNGLDSAF

SEQ ID NO: 1098 - protein, 598 aa, Unknown
  Kingdom: Fungi, Phylum: Ascomycota
MAPESGTPEEHRPPLPPRPSTNASVDSHLQAQATTAVTPLDIQTLSFPDGSRGTFSTTGPQSSSTPISHGSARVSSDHRPDNDGGEADDAVSVVSYAPTGRPAGDIASLLAGELNRKSAAWNLLWSQSATVPPFDRSRVLAQDPLAMFAKEFEELPSADDGVYEDEERLRAWKSKLKHYMILSSAGKPIWSRHGDLSLINSSIGVIQTIISFYEGAKNPLHSFTAGRAKFVVSTQGPLYFVAITRLDESDAQIRAQLEALYMQILSTLTLPTLTKIFVNRPSSDLQKPLQGTESLLSSLADNFTKGSPSALLGSLECLKLRKSHRHAINNTFLKQRTDNLLYGLIVAGGRLVSVIRPRRHSLHPSDLQLIFNMLFESGGIKSGGGENWIPLCLPAFNNKGYLYMYVSFFDSGVSGEQAEQSATAKGLPADEEIALILISADRESFFELKKMRDEVARQLAKNGSLAIIRASAHAGRPKIVDIAPGSQMSHFLYKSRANVQFCMSSMSPAFTEDVTRRRLMNVYHELHTSVHTKNAHLKVLHTVGLEASSLAWVTPAFEFYCVAGPNMSRAAMTQGANKIIQWAKKEEERLFIIGGGVF

SEQ ID NO: 1099 - protein, 290 aa, Unknown
  Kingdom: Fungi, Phylum: Ascomycota
MATMLPRSRSLASALRSGKAPVAGRGEHAVRCLSTTAPQFVAMPKNATNVRLAPRDQIGSLKVPIVNPADKYQSKSENMHKYGAWVMGCLPKYVQQFSVWKDELTIYISPAGVIPVFSFLKYNTAAEFTQVSTITAADYPTRENRFEVVYNLLSVRHNSRIRVKTYADEASPVPSITGLYDGANWYEREVYDLYGVFFTGHPDLRRILTDYGFEGHPLRKDFPLTGYTEIRYDEEKKRIVTEPLELTQAFRNFEGGSSAWEQIGTGEDRKPESFKLPTPKPEEKKEEPKK

SEQ ID NO: 1100 - protein, 495 aa, Unknown
  Kingdom: Fungi, Phylum: Ascomycota
MALITDEKKKKKDLELAARVSGDAGPVLDSIDRVAEAKLVAKQDLRVLPMVFLMYFFTFLDRSNLGNARIAGMGDDLGLGTYGFNMGACLYYLVYFFADVPAALCVKRLGFIVLPVSCIAFGVVTIGTAFVGGSAGFYAVRLLLGLTESFQFPGLSYVVSRYYRRHEVTARVSFFMLGAAGLAGGFGGILASGLLALERVGSVTSWRVIFLVEGIITVGVGVISLWFFPADPSRTRMFNEEGRAMALARIFHDQPAIQEHKEKMTWGLVKRGVFNVNVMVGAWIYTCDQITVQGLSIFTATILRLNFPDKSLIQIQLLSSAPPLVGMVVGLLVAYVTMKTRRHGVAIALCAALCVLGYAIWIGSSNPQARFAAIFFNTAGGFSFGVLILGWTLSNAAPDTIKNVANGAVSGLANIGSIVATWSYIQTDAKTGYRIGNSLNTATAVSVIIASIGLVVYQRRENKKRAAGGRDYRLNRPEHEVARLGHLHPEFRYIH

SEQ ID NO: 1101 - protein, 340 aa, Unknown
  Kingdom: Fungi, Phylum: Ascomycota
MASSQKIPLDEVQWKDPRIVASMGGLHSNTVLFYFAESPFYEKTSNNAVVLSQALNNQQMYPVIQTREAFEAHLKTMSGLEFLVGEEPAESGPGMGTGVWVIRKQTRKKRWQQEDEVTVHASYFVVGENIYMAPRLSDMLACHIVSLCSTYSRHVEQRLTYSQMTISTSLSRAFSEASNLRQWRPSVGHVYKLPTPHNQISHRIRGLESKEATPMPETKPGQPGASRSSEPQPDETALERVAEEAFMVHMRYGGEYIDKNPITGRPGEFHLSSTGRKAVPPPHSDPKNAAGGLGAMNGPPAINTKLDDKKDGKAEKTPKSATMPKPKRKKSKMGGTPAAS

SEQ ID NO: 1102 - protein, 1151 aa, Unknown
  Kingdom: Fungi, Phylum: Ascomycota
METSLKRPPTDGFGSQEDLASLSRPISPPPRKKRRQQDYSPKSVPSPWKLTWIRDLPEEYNKDAITLHDILGDPLISECWIFNYLHDIKFILDALDPDVKQLVQVHVVHGFWKREDLNRLALVEDASAFPNVKLHAAYMPEMFGTHHSKLMVLFRHDDTAQVIVHTANMISKDWTNMTNAVWQSPHLPKCRPDAEGASSNVPSRLPLGSGGRFKADFLSYLRAYDKQRRTCKDLSDKLSQYDFSAIKAAFVASVPGTHDAHDLSETAWGWASLKRCLREVSCSEGSSRVVVQVSSIATLGAKDDWLQKTLFGALAASKSANLKRPKFSVVFPTADEIRRSLDGYASGGSIHTKIQSAQQQKQLQYLRPLFCHWANDSPYGLSLAEDVPPKEGHRQRAAPHIKTYVRYNQEMELDWALLTSANLSKQAWGDAERSTGELRIASYEAGVLVWPALFDVRHMIPTFGTDSPETSERSEDGDARNSDEQRVLGVRIPYNLPLQSYGPNEEPWVATRLTKDQRAHMGPSQRRTSEHDVRNLLPTSFRSGSPLAQQALAEDIAACADDDENIQDSLANDHNASHFMYRRPSGVAFGASRPVFSDRPLDEPALTPLERQQSRNAERSLLRDNHVLPPKHGRKDADAGFVSRIYRRLFSTKVPRASEPTDENGVDSVQVPSETSPLLDNSGSASSEDLEEQWEEAIASRQLTTTWQRETKTVAVYSAPLIVTFFLQYSINVVAILSVGRIGKLELGAVSLANMTAAITCLAPFQGLSTSLDTLCAQAYGSGHKHLVGLQFQRMTFFLFSLYIPVATIWFFSDHILAYIVPNPESARLAGQYLRVMIFGIPGFILFEGGKRFIQAQGLFTATTYVLLIASPVHIFLTWLVVYKFEFGYIGAPMCVAFTDNFMALLLFLYVKYVDGSQCWGGFSKRAFTNWWIMIKLALPGMIMVEAEWLAFEILTLVSSSFGVEYLAAQSIITTAGTVSYQIPFAMSIGSSTRVANLIGAGLVQAAKIQAKVTFVIALLLGILNFVLYTTLRYYLPLLFTDDSEVIEICAKVFPVVAVLQVFDSLSAGAHGLLRGIGKQAIGGPANLIAYYVISLPISLGLALGLDWKLEGLWGGVIVGLATVSFIEYAYLFITDWDKAAREAELRNAAD

SEQ ID NO: 1103 - protein, 196 aa, Unknown
  Kingdom: Fungi, Phylum: Ascomycota
MKAALATLALSTLATASPLLAGEVNRIARRTKEPSKPDMSDVPFYFTSTYTIKATPDQVVNNDNAFTGGLAGAAGWFLYGINSDEDIICYNITIDGFRGDFQSPARTATHIHQGQRGRAGPPRIAFPNPTGENGHLNTVGCLKGPFVTGVVNDGKDTGEGFTVRQIEENPAAFFTDIHSSEAVPGAVRGQLGPDEC

SEQ ID NO: 1104 - protein, 522 aa, Unknown
  Kingdom: Fungi, Phylum: Ascomycota
MKTQVPFLLSLSGLATATAGSFATQCSALAKTLAEKTDNTTITATTYVAAGTTLQEPPRHPTCPPLNATLNYNFCRVQLTAHTGPESAVVLEHWLPLNWTGRYMSTGNGGLGGCIDYEAIAYAARRGFAIVGTNNGHDGNYGEPFYKHPGVVEDFAYRAIRVGTSLGKQITKLFYGKAHKKAYYLGCSTGGRQGFMEAQNVPDEFDGIVAGAPAFDFTGLQVSSGSQIRFTGNNESDTFLTVDEWTMVVNDTLAQCSGLDGLDDDVIEDPDLCQYRPERLLCAPGQKEGCLTPAQVGTVRNTQSPIYDTEGNLVFPRNQPGSNSGPILWSGQPFLYAADWWKYVVYDDPSWDGIVTVKDIEPARKAQIFGIDAYNGDLSGVRDHGTKVLHYHGMEDPIISSDNSARYYNLVQRTMNLQNEELDDFYRYFRISGMAHCTGGAGAYNIGNQEGTQSGDGPESDVVSSIVRWVEQGKAPDYILGTGYRNPATKKGKFQRRHCKYPLRNTYVKGNPDLASSWKCVQ

SEQ ID NO: 1105 - protein, 506 aa, Unknown
  Kingdom: Fungi, Phylum: Ascomycota
MAEIHNPFKRSKLQSDPVLDQTEISPLDEVIHQKSFFERVLPVFACGAGLFSDGYINNVIGSVTTVFGKKYGSLYTGTTAAKNVAAIAFAGTVVGQLIFGFLSDHWSRTNSLLISTIILIIFTALASGSYWHGDTIGMFNILTAWRFFVGIGIGGEYPAGSVGCAESTGELKKGTRHRWFILFTNSMIDWGFVFGAFVPYVVAAACDNGHYSTIWRVSLGVGVAFPLVLLVLRFRLKEPEEFARHSMKRKTPYILVLKYYWWRLFCVSIIWFLYDFSTYAFGIYSSPILEGIYGGGDGVPLTTIFGWNTVINLFYIPGTMIGAFVSDWLGPKYTLVLGVLLQSVVGFIMAGVYSQISKHIAGFAVVYGIFLSLGELGPGNNIGLLAAKTCATGVRGRYYGIAAAIGKIGAFVGTYVFPSIQDAGGNDPVKRNQYPFFVAGSLCTLSAAIALFGLPNVGQDTIALEDIRFREYLEREGWDISQLGLEPRQGTDEVKSPAPGVDQPKE

SEQ ID NO: 1106 - protein, 409 aa, Unknown
  Kingdom: Fungi, Phylum: Ascomycota
MSEVDATKPTEAAAPQVEEKATDSTPAEETKTEVEGESKEETKEEETKEETKEETKEESKEETKDTEANGSKPDILKTTARADRDAAKNRKFDPSIREVTDDPVAIRKQVEFYFGDWNFPQDKFMWESCGGSENKPIPIKSIHSFKRMRSFQPYTAVVAALRDSTFLDVEGEEGNELVKRKEPYKPMGAGRAKNEASTVYVKGFGDEKPNTQFDLESFFANYGEVKGLKLRRTNDALFKGSVFVTFADEETAKKFLELDPAPKWEGHDLKIMSKAAYCDEKSELIRQGKLEPNSQQPRKFFEGTERGGSRGRGRGGFRGDNDDWKKRRDHDQKNGFKGGRGGRGGRGGRGRGGRGRGDRDRGGRDEAPRDPAAEEAKENGKRSREEDGGSNEEPAAKKVDTKAEVAAES

SEQ ID NO: 1107 - protein, 118 aa, Unknown
  Kingdom: Fungi, Phylum: Ascomycota
MTAMKHFPQAQSAFNIPLLAGDNAYLGDVFSSDKTNPEKPISAGLFRLKKGEPLTYTYKYDEMKIILEGDYTISDETGQSVTAKPGDVFYFPAGATITFTTTDYGLAFYCGQRKESDF

SEQ ID NO: 1108 - protein, 457 aa, Unknown
  Kingdom: Fungi, Phylum: Ascomycota
MNLGRNLALVTLTFQNSLLILIMHYSRVMPTEGDHRYFPSTAVFLTELLKLAVCLVITRRETAATLAPDTPPKVLFEQVYNAVFAGDGWKLAVPAVFYTMQNLLQYVAIGNLDAVQFQVLYQFKILTTAIFSVYLLRRSLGIKRWLALFLLTLGVCIVSVPPSSSSQVHLHDISDHFFPRSLSSRLGSLRAEFEDVVVPPPRLSRRNEAIDVSIDDDIDATAAAAAAAAHLLDQPMNYSLGVSCILIAAAISGLTSVYFEKILKESAGTVSIWVRNTQMAFYSLIAAFLGGVLWQDGEEIAIHGFFEGYNWIVWVAVLLQAFGGIVASLVIRDTDNIVKTFATSISIVISFLISVYLFDDFSFGLTFLLGTSLVLFATYLYGMQDRRAGLRGRTIPPPIKIASFEKPAIEKVFTPGSRGRTPDPLARWGSGLAVSSSRPSSPMLPRQGSRRDLKRED

SEQ ID NO: 1109 - protein, 278 aa, Unknown
  Kingdom: Fungi, Phylum: Ascomycota
MAHFIDGKDCMISEWILLAAAFVFVGLRVYTRLFRLREKLQWSDWLLLLSAIDALGLIICDTLTYDMGVMDAWEPSVALSKISFASNYFYDVGMGFPKLSMLAFYWEYFNHDIGSGMRKVLWGMTAFVVACYTAILWDDTFFCGKDVSIQWSQEEGACNVFWAPEPFIVNFTLNLACYLVVYAVPVIFLAQRLLRPSVGLAVTFVLGTLTILSSVVRFATLKIGTGQENLVYPLSMVEMALAIVVVALPGLKPLLRRGPKSQTSDEAVEVTHHHHDLK

SEQ ID NO: 1110 - protein, 594 aa, Unknown
  Kingdom: Fungi, Phylum: Ascomycota
MLSITRAVVPAARRASVSQKRAVPPFCQSCRRQLSTCRPLASSNRRTTDFNSGFTGSYDPSDDSGRGPMFTKSNFGVPQFYPRDLKKRVDDYVVGQDRAKKTICATIFNHYQNVRRRHQHEHEERNRRDKITRQRFTREREMHQRRREVHPVEGQREGRNPLKRTVADILHQDEFPGHHESVRQLHEAHDFQDDAINHLYEPEDTSIPQRVKIDKSNILLIGPTGVGKTYILETLSKKINVPFSICDCNSFTQAGYIGQDVETCIERLLIESNYDIKATEHGIVVLDEFDKIARRETTTGRDVGGEGVQQALLKLVEGTKVTINVKDSRSSRSAPPITTNYSSSGGSSTPQANPPSGKVEQYTIDTTNILFVFCGAFVGLDKAIIRRVAKPSLGFGGEVKGRTTMSGSQHSLPPETYAHLPHHNALSASTFTPMDLVTPEDLQTFGFIPELIGRLHNICALSPLSKDDLFRILTEPRNSLAAQYTALFETYPSRLRFTEKSLHAIAERAAKSGTGARGLKMEMERVLAEPMFDAPMPYVLITEGCVKGTEKAGYWGKDGMFEVDRRMQEEEVGEGSVQSDLTFERFREAGQSGG

SEQ ID NO: 1111 - protein, 690 aa, Unknown
  Kingdom: Fungi, Phylum: Ascomycota
MAESSMARQPADADDINSSSGAVTPPEALPTKTKGRQRLLLGLQRISSSQSLSGLRRSKSVGGIPYRNRASLSCASLAATGPPLNSGRSATPIPSPLGFPTNLTNESQTSEFPFYDENQAELAVRRVEATQSTFASSTVPLPADLKALKQDGQSRRQLSARTKPKTPFLLWDLMPLELKVHILSYLEPRELVRVSRVSKSFYKFAFDGQLWTSFDASEFYQDIPAESLARIIVAAGPFIKNLNLRGCVQVEHYKRTEVIAKACKNLMNATLEGCRNFQKSTLHSLLRSNKRLVHLNLTGLPAVTNSSCKIIAESCPQLETFNVSWCNKVDAKGIQLVVENCHKLKDLRAGEVKGFDNIEAAEAIFNKNNLERLVLAGCSELSDEALQTLMHGIDPEIDVLTDLPMVPPRKLRHLDLSRCDRLTNRGVKTIGHMVPHLEGLQLSRCTSLTDAGLESILATTPRLTHLELEDLEDITNTLLSEHLAKAPCATILEHLSLSYCENIGDVGVLPLMQKCVNLRSIDLDNTRISDLVLAEAASMVLKRSTRTTEVGHRPFISLQMVVYDCQNVTWTGIREVLFRNTQVKPLSGQPGKVTYPTEIIGLKSFYGFQMTVDEHQKRVLRGDFKSAGRLERKWADYMQANEEAGVMGAGYRRRRRRAREAQALHMDEEYGGAGANGRRRARTMGSCAVM

SEQ ID NO: 1112 - protein, 577 aa, Unknown
  Kingdom: Fungi, Phylum: Ascomycota
MPRPRRAPRAPPAQASKVVENHADTGADELPTRGRTRSTRRSQANTNVTDDAPGRAARNSRDAAIERLANEDPTATSGEDNTVSSVEVGRRGLGTPLRAVDTTGLDLGDDVFGDLDESFDIGGDSLLKAPRSAESSTLSLRNLGRQRSRSRQSSFIGRNEAPIRPSSRNGATPLMSSSFNIGVFRRRAREPSILGTNRKSRYDTTGSVTGSINGSVAGSVTGSVAGSVQGSDLGSDRELSPEVESTPLHGRRRSTRVRATAEQEASTESAVPAARKRKSGDDMETSERPEKTTRVASHGEGLDISDSESELSSLGSPVMLPPLQRPVTPTRDEYNAPPASSDSEDDGDIWPDIQALGKRRRRPSVTTPGQLDRLSDVSSPPSLTHSPNFQATKRGRSTRHQRGQSPELTTAHLANLLPKRRVKKAQKPDPLEAIDTSGLAHDDDELHLDGRTSQRTKNTRLASRSDQTDNALQPRQTPASASRPVTRSSSRIGKTYSRRASGKENDDQSDEDDEEEEPSAFVALPDDTFGEDNEARRRFIETEALKAQAVKFKEVDRWELSFEEVVQAEEAAPVDAR

SEQ ID NO: 1113 - protein, 3981 aa, Unknown
  Kingdom: Fungi, Phylum: Ascomycota
  misc_feature (2719)..(2725): Xaa can be any naturally occurring amino acid
MKAERDTESIAGGREPIAVVGSGMRFPGSSSSPSKLWKLLLKPRDLLSRIPENRFNADSFYHPNSSHHGTTDVQESYFLEEDHRHFDAAFFNIKPVEAHAIDPQQRVLMEVVYESLEASGMTMESLAGSPTGVYVGLMCADYAELVNSDVNALPTYTPTGNARSIMSNRISYFFDWHGPSMTIDTACSSSLVAVHEAVQLLRSGDSDVAIAAGSNLMLAPLQYIAASKLKMLSADSRSRMWDANASGYARGEGVAAVVLKRLSSAIADGDHIECIIRETAINQDGRTKGITMPSSKAQADLIAKTYAKAGLDPRNPDQRCQYFEAHGTGTAAGDPKEAEAISKAFFHPGEVVSGASDPLYVGSIKTVIGHTEGTAGLAGLLRASLAVQHGTIPPNMLFDSLHPNVEPFYTNLKIATEPTAWPKLAEGTSRRCSINSFGFGGTNAHAIVENYVPPAPVQVSQAAPGRQFTPFTFSAASERSLRGVLADYAEHLRLHPDISLHDLAYTLHARRSGHAVRTHVSADSVADLHTKIDGLLRAPTSSDGGSRNLGSRSRPWSSPLRALGVFTGQGAQWATMGRELVLHSQYCRDLVRDVDSMLQLLPEAERPDWSVMDQVTCDAPLSRIDSAVISQPLCTVVQIMLFDLLTSAGVRFQAVVGHSSGEIAAAYAAGYLTRDDAVKVAYYRGYFTSLTPSDRPGAMMAVGTSADDANELCNLSMFKGRLAVAAINSSSSVTISGDRDAVEQAKEVLEDEKKFARILKVDKAYHSHHMLPCAEEYLRALERSGINPLQGRDDCVWHSSTYENRHVHGARDLAGQYWADNMVRPVLFSHCVEAAAAGSEARFDFAVEIGPHPTLKGPALQTIQEAHKVTVPYTGLLQRGKDDVQAFSDALGYLWSQFSPSIVDLGAFDTLVSGIKSRKMLQDLPAYHWDHDNIFWHKSRPTKAFLTQSSIPHPLLGTRTTDVMDEQIRWRNHLLLNELPWIRGHQLQGQVIYPATAYLSTAIEAAMFLVPEGASAQLVEVRDFNLGKPLIFGEDGSGIETVFTLSDITKGKDKTYSASFTYHACSNADAEQLSTHATGRVIVITGEASTGLLPSQSKDLPNLVNIPEHRFYKSLETVGYGYSGDFRAMSSIQRKLNFSSSRIRVPLQEDDRVKVMLHPAMLDTALQGIFLAYCWPGDGSLDQLYVPTGIQSCRVNAGLCRQQLESATEVTSSSQLTGNPLVTKNLNGNVDISTEDGSCLVQMEGLKVVSFSEPTAEADRAVFTEYVWDVLAPDAERAMQGKRATAEDYELAFAIERVSVYYMRQLASLFPEETRSSLNLEWHFVCLFNFITHVLSTTGAGQRKTAKKEWLQDSAADIERIKERYADTVDMRLARAVGDNLPAVIRGETTMLEHITKDNLLDRFYEVGLGLKEFSGYVGKTVEQVVHRHPHMKILEIGAGTGGATKVIMGGIGRAFSSYTYTDISPNFFETASEVFSSVADKMIFKTLDVEKDIVQQGYEEHSYDLVVASLVLHATKNLKQTLANTRRLLRPGGYLVIQEVCNNEPSRTGFMMCALPGWWLGQDDGRKLSPCVSTPEWNDLLLQTGFSGVDSTTHELDSVPFQLAVIVSQAVDERVSLLREPLALVGTDSPVAEHWDLVLVGGQSPKSSHLIEEIVGMLQSPNVSHTIVKTVDDIESSTISETTAILFLEELDKPVFKGITERTLEGLKRLFETQRTVLWVTQGSRSADPYMGMSVGLGRTLILENPDLVLQFLDLEPGIEPEARTILEALLRLRQSDRWAKEGGTFEDVLWTNEHELAYINGELCLSRVHLAAPLNERFNASKRTVLEPMNPQSVPVNLSLGQTVAPALVLNDHLASKMLGSPDAVESESETVIRVSHSLLMPDLATIPPSYLVLGTNSKQNGKIVLAISETNGSYASVSSGRVLDVAPLQGEEPLLLSRLHTQLQVDGMLSICEDGSVLAIHEPPVDLASAIVERGASLGIRVYITTAASPSDSSWTQVHAYSPRTVVKSLLPPDISVFIDCSTRSLSQRAGSLIACCLPETCLKTTSASLPSLRRIRGFSVADMIDNLKGALPRALEKLAAPESSTNTLPLIRADQLGPGSSDADLFTPAIVAWNTTGKVPVQVSTVDSHTTFRSDRTYVFFGLTSDLAQSICDWMMTHGARNIVLTSRHPNIDARWKRTLKEAGVRVEVFSNDITDKAALVSLVDHIRQNLPPIAGIAHGAMVLNDVSFFEMTFEKMIQVIRPKVQGAIYLDELFQEPTLDFCIFFSSCTAIAGNRGQSAYTAANMFMSSLASQRREKGLAGSILHIGAVMGVGYINRGFKDYIFTALSRAGYMMVSEREFHLCFGEAVLASHPKSGRNPDVVTALETSKFGDTVPLWAKFPRFQYCLAAADSGSLKQAQKKHNAAVSTKLRLAEATTAEEALEIVQDSFYQKLQVVLQISQDTEKSQVLASGTDDLGIDSLVAVEIRSWFIKEIDTEIAVFKVLSGISIAELVEFAVENMPGELTPNMSDSLDAVAETPTAPVIPASPPSGSVSSAPSSDPPKTTAETSQHLSESSSKTSQPDEKQSEERDSSTVSLEEPLETAYEKVLPISPGQARFWFLKHLMEDQTTANNTILVSVQGQVRLDSLDAAVRRVGARHESLRTSFFIDKNQKAVQAISDSSRLYLQTKEIHSEAQVEAEFEALKNHAYDLINGECMQLIHLDMNATESYLLIXXXXXXXRKPTTARAFQAKFTKFAEAPTPLPLLPFAAVKQRKALTAYRHTSVSRTVDAKVARQISDTCRKLKANVFHFYLGVFEVLLFKLFGKNDVCIGMADANRWDDQVAQSIGMYLNLLPLRFRLDKQQSFETVLKDTRRKAYNAMSNSRLPFDALLDNLNCDRSTAFSPLFQAFINYRQGVRENRTLGSARGVTKKISLPRAGYDMSLDIIENPGGDTRLAFMLQDALYSEEETAQVLELYCNLLSELSGSPGQILKDVSLFTRSDVDKAVQLGRGAALPSQGSETLVHRIDAMIANPPQEIALRDHTGRSWTWEQLGQQVNKMASTLLQVNVTAGSVIAVHQEASPDLVFSLLAILRVGGIYVPLDSNLPEARLRSIITECDPSVLLLDQTTLARAGDLALPPSVTVLDVSSLPPRVKDAICPTTARRATDPAAILFTSGSTGVPKGVILSHGGLRNHVEALVHTHGFGRETVLQQSSVGFDMSLNQIFMALANGGTLVLVPEPFRKDSAAVAKMILEQSITYTSATPSEYLAWLRHGSNSLFQSTSWRFATAGGEQFTPQLLQAFQTLGTQFEHPFHAFNAYGPTECTLSSNEMKVSLEASSSARQITAGKALPNCSFYVVDDSLDPLPVGWPGEILIGGAGVALGYLNNPAETARKFLVDPKASSSAMGQGWGRVYRTGDKGVLRPDGTLQILGRIEGDTQIKLRGLRIEMQDVEKSILDASEGQISEVGVTPRGDPTILVAHVVLSRNASFSNKQQYLRDLSASLPLPQYMRPAAIIPIDCMPLTASGKVDRRALQGLELSSTRGQSHIQDQGAATQLTEAESELAQIWKDVLPQQLQEVHLIDGASDFFQVGGNSMLLIELRRLVASRLQVDIPLLRLFESSTLGAMAAAIQDLSTGAQVPEVGWEAETQVPSSWAQGGVQPVHLQSHSSPRTVVITGATGFLGKQLVRLLVADANIHRVHCIAVRNVEKLAEFAGSDKVSIHPGDLAQPRCGLSEADAVSIFRSTDAIIHNGADVSFLKSYSSLRAPNVLSTKELVKLSLPRLIPLHYVSTATVGKLNRSDTLAPESLARFPPGATFSDGYAASKWASEVFLENATKKLGLPTFIHRPSSITGDQAAENDIVPNLLKYSSLIKALPDTAKWSGYVDLISVERAAAGIIGSVLQDRPDLGTTAPETQFLHQTGEKVIPAQSIKTVLSPKDEPEWDSLAMAEWVSRAVQKGMNPLVGEFLLSVDRGQGLSVGQKLLLNTHQAKKGM

SEQ ID NO: 1114 - protein, 801 aa, Unknown
  Kingdom: Fungi, Phylum: Ascomycota
MQATHDLIFRARQILSLQLFSLGESKAAVPECNIAAELQRHGLSVNSTATQGVLARGLLLVTSHGTTSLMVLSQITNTPHLGTLRIEIEEVQVDSGAPYECLSYTWGVADGQLPDRRVVVETAHGPRQLFIHRPLEAALFQLMSSKNVANPLFVDQISLDQSNDAEKADQVPLMKDIYAHSTRTLVWLGPGTRESDAWFDFVREIHAEGILSRLMGPNRGHFMQVFDAVMDSSIPTAGVIREDVDDLRSLMDRYSRTFPLKALADVFKRSWFTRLWVIQEICLPPNITMICGTRTLCFDCFRSGNLFFSIYSSYLPNHLNIKVSKAGVVLHWDVLSLSQRFLRIYQERRAIHVSGVRQNALDTVLRYSVVDGAPNVGASKPEDRIYGMMGLMALDDDLHKIKVRYNDVAGVYTEFAGLQARKDLDILCYSQFPKQSDLPSWVPDWHMQLSMPRGYTKLNERRYAAGTHLSHSPQVEVDLVTKTLMVRGIMVDRIVKVSKTELAQDPEPTATDRIDDRSAQLFFGEIDEFLRAADEVPHSRFRRYNVDDARRADADIRLADRGLSERYLRDLGMAEADIRTGLRAAKLQTARLGQRLLDVDEKVRSYHMSRIFKTVGIFPWYWEPRGDTDICQAMAVNPVRTSLNWVKGAALFVVDVAGLCLASWVTVGFSHWLRLKKLYYPHAILFSRSESSLRKHGLDASVEHSKAVSTLNDFMLKNKEQRLYVTEHGHVGLGPRTMQPQDAVVVLPGSTVPHVLRRMDWSEEGEQGWSYLGEAYCDGIMDGELLQDGGEAAETRTFRIR

SEQ ID NO: 1115 - protein, 260 aa, Unknown
  Kingdom: Fungi, Phylum: Ascomycota
MASRASLLRHQRALAVMAFGVVAFTPSQVYAEASPSDTAPVKMTQRKPIYDDDVEVPSEKPAASSLQQLIPSNPFTTPSSAAEESKSRGPTPTDRLAAQIGKARLFLYRHATTAEDALNRTVDSAFHLEESFTRTLTSLAPPRESHEKLMPGAIYVLVASMAGSIISRNRNILLRAATPLALGIGAGWVVLPITMRNVSDLAWKYEQRVPAIAETHLKIREGLEKGVSFAKVHGEVGARLVDEKVTDAREAVEGWVKQGK

SEQ ID NO: 1116 - protein, 919 aa, Unknown
  Kingdom: Fungi, Phylum: Ascomycota
MSYGKKDEDADLGLVKVDRTQVFQEARLFNSSPIQPRRCRILLTKIALLLYTGESFPTNEATTLFFGISKLFQNKDASLRQMVHLVIKELANSAEDIIMVTSTIMKDTGGGTDAIFRPNAIRALCRIIDATTVQSIERVMKTAIVDKNPSVSSAALVSSYHLLPIARDVVRRWQSETQEAAASTKSSSGFSLGFSSSGSQVPMNSSTMTQYHAVGLLYQMRSHDRMALVKMVQQFGAAGAVKSPAALVMLVRLAAQLAEEDASLRKPMMQLLDGWLRHKSEMVNFEAAKAICDMRDVTDAEVTNAVHVLQLFLTSPRAVTKFAALRILHNFASFKPNAVNVCNPDIELLISNSNRSIATFAITTLLKTGNEASVDRLMKQISGFMSEITDEFKITIVEAIRTLCLKFPSKQAGMLTFLSGILRDEGGYEFKRAVVESMFDLIKFVPDSKEEALAHLCEFIEDCEFTKLAVRILHLIGLEGPKTAQPTKYIRYIYNRVVLENAIVRAAAVTALAKFGVGQKDPDVKSSVKVLLTRCLDDVDDEVRDRAALNLKLMGEEDDEMAQNFVKNENMFSLPYFEHQLVMYVTSDDKSTWESPFDISKIPVVTREQADAEDRTKKLTATTPTLKAPKVGPTKASPASGAEAAASATAQAQRYAQELMEIPEMAAFGSVLKSSPVVELTEAETEYVVTLVKHIFKEHIVLQFEVKNTLPDTVLENVSIMASPADEEDLEEEFIVPAEKLATDEPGKIYVAFRKVNGEGSLPVTSFSNVLKFTSKEIDPSTGEPEDTGYDDEYEVSEFDLSGSDYIIPTFASNFSDLWEKIGAAGEEAEETLQLSGMKSIAAATEQLAQALSLQPLEGTDVPVNTSTHTLKLLGKSVSGGRVVATVRMAFSSKSGVTTKITVRSEEENVAALVIASVA

SEQ ID NO: 1117 - protein, 607 aa, Unknown
  Kingdom: Fungi, Phylum: Ascomycota
MSPPPSRFGPAKSRSTQGCYTCRLRRKKCDETKPECDNCKTLEIKCWFTEEKPDWFDGGPKQKEQMAKVKADIRLKAGQRRDRKYLEMLDKDGRETSARSHDETPDHDHPRTRDVTMSGASSAEPEDVHVGSHAEQSTPASTWSNTSLPLRKPQPAAYFSDEASDIDLHYIMIFLESIFPYLFPYYHPFVLTGGKGWVLQSLLANRSVYHTCISLASYFFSILLGNSHTACSNAMVERLQVQLELGLRELRNEMANLRNKPPALGNVDALTCMQSIVLMCHFEVATSNKDTWIIHLDAATTLLQQLVPSPDHWACVLDSFDSGQFDAIGLQKPFTSHQSALRFYAAQCLYLDVLSSITLSRVPRLHSYQGDLMPGCAQKPPNTMRTNHLFLDEFLGIHNSTLQVLSDVAALDAWKKEQRKAGSLSIHELLAKATTVGDAIKVMIDELERVVAGGPEAAAAHFEEPFGLLKELQPHTPDDLPGHPIHNLIWVLASQTHLHLVTSGWQPQCPEIARNVARMTELFSSLPTGTALRSLALPLCLAGCLVGPEQECTYRGFVESMGSLRVFGTVKDALAVMEAVWARRGLIDESWDLSKCLNILGHGVLLS

SEQ ID NO: 1118 - protein, 306 aa, Unknown
  Kingdom: Fungi, Phylum: Ascomycota
MGNVASSLVPANASPAQCTQAFFVLSSAFIFSIQFLPDEIRGVLMDYGARRPQQDNGTASKDSGASPSPALVKLKAVLAKLTDLSVGWSVFWLSQFLSKGRLMAAIAAWQAKVAPKGMGLGQTYIVAALMAIQGSRRLYESYFVARMGKSPMWCVHWALGLAYYTAMGLGVWVEGSGSILEAWRTGNYKPNVPGFVPFAAALFMAASAKQNECHAHLASLKKYTLPKEGLFKYFLCPHYTCECLLYLGLSLAAAPQGSTFNKTILSGLLFVTVNLGATAYGTKQWYVEKFGAEQVGKRWMMIPYLW

SEQ ID NO: 1119 - protein, 273 aa, Unknown
  Kingdom: Fungi, Phylum: Ascomycota
MSAPLDLSNPKRPIHVGVILMNSTTEILDVAPIDILSALNAGEDFGIPENIKPASLDAQMMDFHFHWDSFASCPPLDIVLIGAHNMKYTPNEAELAYVRKAWEECSAFLTICGGVVVPLMAGILEGKTVTGPRPFLPVLRQQGAGATWLEKRWVRDGKLWTSSTLLNGTDMMLAFARETWGNRVAEGEPDLIEHVRQLGAWPSPVTRASRDVVAFPLMFVWEDEGGEKKEKEKKEEEEKKEKKEKKEKEKKEKKEKKEKKRKVCKEDDDEEEK

SEQ ID NO: 1120 - protein, 404 aa, Unknown
  Kingdom: Fungi, Phylum: Ascomycota
MSTSKPEFLRFTGHRHFAQRLVLSTLTGRPVHISKIRSSSPTNPGLAPHEISFLRLLEAVTNGSSMQISYTGTTITYHPGLITGAIAGQGAIDGDLIEHNIPPTCARGITYFLLPLCLLAPFSKAHMNVRFSGAGIITSATETGDISVDSFRTAILPLFALFGIPPARIELRVLQRSCAGPGGKGGGGVVELRFASQVRLPKTLHHNRNPGRIRKIRGVAYSTGVSASNNSRMIHSAREVLNSLVSDIHIAAQYDTAPLVPTGDKAGSKRRLGIGFGLSLVAESSSTGVLYSADVVVPASGGTVPEDIGKRCAYQLLEVIAQGGCVSHTSASTVLILMAMGSEDVGRLRVGRDVLATEDMIGLARDLKTFGASSWGLRDAEDDSGELVVSVKGTGVGNVGRKIA

SEQ ID NO: 1121 - protein, 279 aa, Unknown
  Kingdom: Fungi, Phylum: Ascomycota
MKTSVFTLAAMAMAVVAQNRDNLPQCGRTCADNMLASSKADELGCDANDIRCLCLNKNFTYGLRDCSLAICSEEEVRQVLEYGLSVCSGVGVKIATASDGAAAPTATGDGSDGSGSAGGSGSSGSVSGSGGSGGSVSTILSTITSDGSTLTTAVATTTLDGAGGAAGAASSAAESASNVAGSLSSAADDAAGTASSLAEDASTAATGAAGSISTAATGAAGSASRVLSSLSTAATGAEGSATGTGSESENTSTSEDAAPQKTAAPAAILAAAGIAAMLL

SEQ ID NO: 1122 - protein, 332 aa, Unknown
  Kingdom: Fungi, Phylum: Ascomycota
MTSASAAWEALGHAASGSLGTATSTAALYPLDLAVTRLKAQSHLPPKERHQGIVDTLRDIFAHDGFSALYSGLGPDIAKSVIDSFLFFGFYNYLRPRHRKPRALEELGLGALAGACARAVTTPVSNVVTLKQTSATGQQESFRHILSGIVKRSGVLGLWAGYSATLVLTLNPSITFLVNRRLAKRIIPALEEEDIPVAWVAFLLAASSKAAATALTYPFQAGKTRLQMAGTEAGHNGTEAANTSTGKNASGGRRAWRRLMELLDKSIFGVILRILREEGAQSLYTGLQGELLKSFFSHGFTMFTKGLIHRLIVKLWIAASPRLHQARLRGTK

SEQ ID NO: 1123 - protein, 428 aa, Unknown
  Kingdom: Fungi, Phylum: Ascomycota
MSFYNIINGERRSSPNVHQCTDPRSEEPLWDAPLATQEDLDEAVAAARAAQPAWATTTVAHRQSLLKKLGERLEEHRQELVDCLMRETGKSALIAGIDVTNSIGQCDYYAKNALKDDITYEDDTLTIPSPLAPYAVLKSIEFTHDLFPPGILQVLNGGAELGVSITSHPGVDKISFTGSSTTGKKVHESCAKSGKKVTLEMSGNDPGIVCEDVDIKQVASLIATGSLFNGGQMCVCTKRIYVHESIYDEFLQELVHVVEAGFVINKDPTAPTVFGPLSNRMQFEIASAMLEDCKSKGFNIVSGGDIPNDRGYWITPTIISKPDEQSMIVQKEQFGPLVPVMSWSDEDDVIARANASDSGLGAAVYSSDPVRAQRLARRIESGTVFINMAEIPHVGGYFSGRKSSGYGGEMGMQGLLSYCHTQSLQIRK

SEQ ID NO: 1124 - protein, 413 aa, Unknown
  Kingdom: Fungi, Phylum: Ascomycota
MTADITPSKQAASAIESFKMDSPVKKLDFNQADKENNPDASVATLAEQIDANHKPAIEEIKQVEKKAETAVTKPDESDEPLLQENPARFVLFPIKYHEIWQMYKKAEASFWTAEEIDLSKDLHDWNNRLNDDEKYFISHILAFFAASDGIVNENLVERFSAEVQVPEARCFYGFQIMMENIHSETYSLLIDTYIKEQSQRTYLFNAIETIPCIRKKADWALKWIADKNSSFGQRLVAFAAVEGIFFSGAFASIFWLKKRGLMPGLTFSNELISRDEGLHTDFACLLHSHLKHRPSKQVIEDIITEAVVYEKEFLTDALPCALLGMNANLMQQYIEFVADRLLVALGNDKVYNSTNPFDFMENISLGGKTNFFEKRVADYQKAGVMASTQKKDDAGSDEPKGANGGDFTFDDDF

SEQ ID NO: 1125 - protein, 355 aa, Unknown
  Kingdom: Fungi, Phylum: Ascomycota
MSAPKPDPGDSVVSTWRRQDKSSWTWHHWLIEMLNIHHTNLDEAIPKHAKTEKLPYMKQWSHHVWLLCYSVATLGVHQALLFASGYREPSRWLVGAYYFTAFQLVLTQEVHILRRFSHTYGFLDGDKHDRNDVPDVGVARAVGSLLKTLGGRIAMTMFLTYRSSQAPLDVMVQPSWWAWLAVKIAAYGVVLDFYFYWYHRLMHEVPFLWQFHRKHHLVKHPVPLLTAYADDEQEFFDMVGIPFMTYCTLYALGLPLGFYDWWVCHLFIAYTEVWGHSGLRLYMVPPSTIDWLLLLLDLDLTIEDHDLHHRKGWRKSHNYCKQTRLWDALFGTTTGRIEVAKNNIDLGHEVRMPLF

SEQ ID NO: 1126 - protein, 571 aa, Unknown
  Kingdom: Fungi, Phylum: Ascomycota
MPASDYHLSHPQLGNLIGFARDEDVVQFRGIPFASVPGRFRQSVLRAEKLPSQPFDARQSGPVCPQLKLPFPPYWTAPPPEGYPALEEPGQDEFDCLNLNITAPRKALESGHTVPVLVFIHGGAFMGGSQSIQLAGREIYDATNLVRAGLAREQPTVVVTINYRVGLLGFLTSDKLAERSRELGEAVGNYGLHDQRQALEWVSKFIGGFGGASDRITIHGTSAGGASCHYQVNFPKRKFQSAILSSGTSVGIASRPMPWHQERFEYVVSHLPSIRTDDSELIASLVDLPVDQLLPASPPSLYSPLVDGEWVPDAGLAPTLDRLSKEGETMPALMIGATEYERDLTLLLLSDMSKPMPHPPRPEVQILPVAQDVLAGSAMIPQLDSPDSPYCVPSIAQAYNLSRDRSALDSFEDLGGLMADVAFRVPPVYSASIIRRHQRRNGTTATAAPVLLYEIQATNPYKNWPLGYKRANHGVNDIMLFNPAEDQVLSEDLENWRTAVSQVQGAWLDFCHGKTPWAPFEESEHVDGLGPVYVFPDGGEGRLCKTLAEVDGKATATKWRSLLETALPVDS

SEQ ID NO: 1127 - protein, 509 aa, Unknown
  Kingdom: Fungi, Phylum: Ascomycota
MAIIEHLLSPWALVAAAGLYFLYPFFVTYSALRDIPGPLLARFSNLWLFSTARRGKRFLLVHEAHRKHGPVMRIAPNHVSINSDEAIQAVYGHGNGFLKADFYDAFVSIRRGLFNTRSRAEHSRKRKIVSNTFSAKSIGQFEPYIHHNLELFVQKWDDMALHKASPEDGSVHVDSLNWFNFIAFDVIGDLAFGAPFGMLTTGADVAEVRSSPDSPPIYASAVEILNRRGEVSGTLGCMPSLIPIAKYLPDPFFSKGLAAVKDLAGIAIAQVRRRLDNPPPADRKDLLARLIEGRDEKGEALGREELTAEALTQLIAGSDTTSNTSCALMYHVVRTPGVVDKLRAELDAAVPRDVAVPTFEQVKDLPYLQHVINETMRHHSTSGIGLPRQIPPESPGVEILGRFYPPGTVLSVPTYSIHHSTEIWGPDADEFRPERWENATDRQRNAFIPFSYGPRACIGRNIAEMELKLIVAAWVRRYDVHLRQEVMETREGFLRKPVALEIGFTRRKD

SEQ ID NO: 1128 - protein, 856 aa, Unknown
  Kingdom: Fungi, Phylum: Ascomycota
MSLLSAETTFCGPLNDSSSHTGASESNSSTPPTTISDAASLPSASPKHGSPMIDIEPLETITVSLPDTQAEATPEGDAIVVSEPAIVTSATAADPTTPSAESTSGRSRRARYSAPVYNLSKLSGTASHGKRRANGDVVDSKSSLRRQTIANQIASGSPITTRQTRPSNKVVRDGIDALDLQWSLSKLDSPRTRRKTETPPQPTRLTTRRSAAEAVSALSTKVSAVGKRIRRPSEKAMKNLPRELRKLQDTKEFSHIDDKPVLYTVWSNGKYVDPNAPAEPPVKKVKTADPAADKPENTEAESEPVTNMRKRRVKKYLDKGLYAGQDKPLDPVKCLTPAEKKKWASLPELHPTGHVNTVMPTPVFNGLRLLVNGRDFKLPFNVCNPLPPGQPKPDEWKKMTRNRFIGDSKDYWRKIPTLDDSKCVCTPEDGCGDDCQNRIMLYECDEKNCNVGKELCQNRAFADLTARRSKGGKYRVGVEVVKTSDRGYGVRSNRNFHANQIIMEYSGEIITEKECERRMNNEYKNNECYYLMSFDQNMIIDATTGSIARFVNHSCNPNCRMIKWIVGGQPRMALFAGDRPINTGDELTYDYNFDPFSAKNVQTCLCGEENCRGILGPKPKPKPKQATEIKKAVKATVKAGKRKLKELTGNEGAGGAKDSPKRRKVDNAKGVKKTLANAGNKIKGAATALKKSVSVKVSKQKTTETAKASPVKGSKGTPAKIIKKTTTKRVVTAFKKTPTKKQQTTTKTGTKTTIVLKSPSNGLAKKQTGAAAAAKKSAGAAGKTSTPKAKKTSPGKGQKKTAVAGTQKSVASPKSLKKAPRKIIGKIASPRKAIDLSRDNSSIRVVPASAYDDYDH

SEQ ID NO: 1129 - protein, 585 aa, Unknown
  Kingdom: Fungi, Phylum: Ascomycota
MAAPSIVAAEALPRFLLPRLSWSASPGIASRTARPLLIRQQWAPITTTVSGHNSKRSSRRAAYQSYQYGNNSTILRRAFHATRLQSEGFTEEQSVAMMKVLNDVIEESIQNLTRTMVLREDAAKATYTQKVDFAKLRSELLSADSTESNTTRNTHERLTNDIAKLSSRLRDEIGRTQASVRLDLNLEKGRIREEAVGQELKVKETETKIEQEVAALREKLEQVKFQTLQWLMGVCTGFAALLLGAWRLLIKLSMPAVKPKILQLGVIEHAHEAWEEINKIAEVIRPASTNRQSFIEECRSGTLDGVILAYRTFDSVDLTGRFDQDLVQALPKSLRFVCHNGAGYDQIDIEACSQRSINVSNTPTAVDASTADLTIFLILGCLRNLPVSMANLRAGEWRGSPLPKLGHDPQGKILGILGMGGIGRAVAERARVFGMKVRYHNRRKLEETLEAGAEYVDFETLLRESDILSLNLPLNSQTRHSISHKELSLTKPGVVLINTARGAIIDESALVDFLNSGHIASAGLDVYEREPIVHPGLLKNNNVLLVPHMGTWTVETETKMEEWAFDNIRMALTEGRLKTIVPEQR

SEQ ID NO: 1130 - protein, 1185 aa, Unknown
  Kingdom: Fungi, Phylum: Ascomycota
MDDIHGKAPAANRLSKLPRPASGIPKPSALPRPSSRASGLQPPKPTRASSSAADIHPADGDTRTSRLRASMSRDSLRSSITATTPARSIPRLRASASRDSLVATSTARPPMRPKAQPPVTGQQQSRILPTPQRKPRSSIAAEPGAESEPVLEADEDQTSENEAAVDTDRPLFRRRLTLTRKPSESFNFSPTQELFDSIHRDDTPTNDSTEGDMPPPPARSVRPRPSLTERTMQSLAQIPSSPALKKKNSSFFEQPRSRSRAGSSSSRPGSSYNSDGSGRHMSRPVSRPGSASGQDDNGSRPGTATYKSSLSTIDGTPEGLTTGVSSLRLSKLQATPSRGSFSSKLPSGRPSLSGETFATPQKKNYGALPSHSGSQSVAARPSKARGSTNGLFKKPSMPSMASDLGGSGEAPTVLDEPSDSSWGNTFPSISPARPSQASETAPLSARKSSAALRDQIAKAKAAKRAAMKQAAEIQVQSDDQRPIVPVDDGFDFGVAHEDPFNLRKGENSGKKVLLQRVMAARTSGRLNIAALNLKEIPVEVMKMYDLENIGANDGSWAESVDITRFVAADNEFETLDELIFPDQSHSNPDNDDEGPGNIFGGLENLDLHNNLLVNVPLGFRRLNYLTSLNLSSNRLTNNSLDTISQMSSLRDLKLANNLLFGPMPASFANLGELEILDLHGNNVSALPADVENMTQLRILNLNENSFESLPFDALAKLPLTELLVRKNKLRGTLIEDPIESLPHLQTLDVSSNQLLRIVELGSSISLPVMHALSLSMNRLQGLPDMTTWTSLLTLTVDENNISSIPNSFTSLEKLRHADFSSNDIRVVPPEIARMDNLSMIRLSGNPLRDKKFVSIPTDDLKEMLAARLEPPPPYQEPRSQQVAGNVAVDPKVIQSGDLPTGDAKSPVGPHDDDSLDDDFATPPTSAPNSPPRSRAHTNASLRSRTRTLSNQMWPVKNGGLLDRSQTESSSLHPVVASQIAAEHQIKQIHLHHNLFTTFPNSLSFFADTLTTLSLANNQLTAEGYLNEELELKTLRELNLGTNRITSLKPLTKFLCAPALEKLDVSFNRLNALPTDLREAFPSLTVLLVPNNHLIELTPESITGLRIVDATNNDISHLNPKIGLLGGEGGLERLDVMGNRFRVPRFNVLERGTEATLRWLRGRVPVAEMAAWKGDDGDESPEGGWP

SEQ ID NO: 1131 - protein, 879 aa, Unknown
  Kingdom: Fungi, Phylum: Ascomycota
MPDIEKPTSGVVDDAEHNMDDLKKMDATQEDNAVGYREYLEALDLEISDKEMRRLRWKLDLTILPMFLITQALQFMDKTSLNYANLFGYQTTLHLKGQQFNYLSAMVYAGYFFGQYPCGWLIGRFPAQKVLAISIFLWGLMVIIMTQCRSYSTALLVRFIMGIFEAAVTPGLTLMTGFWYTRREIPLRQCIWYSALGWGGIIGSYISMGVSKLPEDMTPSRWELIFYILGGATCVWAFVIWLVLPDSPSTASWLSKRERLVAVKRVASNETGIKNKSFDKKQIKLGFLDPKTILLFISVFAAAIPNGVVNSFSTIIIRDMGFSTTKTTELKSVGDAVQIVALFIGGTIILNVPNSRLAVATVANLLCTVAAACMAYLPRSNTWGRLVSFWLVNAQSVGFTVSLTTISSNMAGYTHRSLASALVFTAYCWGNFAGPFVVKPEQAPHFTGATIGLLVGYAIKLGCHLALLVYLFTSNRRRDRVYGPADKEASGEAGMRDLTEFENKDFRGLSSGDRDRQSTDNTRSGLHQPHDFSPPGNFSLHNSASSQGVTCLSAAMAAPLEYSFISLSTKPTAQLCYRFVPATRPPTSTSKPSLLVFLNGLGLPQDFWAPAIAELQALRPDSLPAILTYDRFGQGRTTDRDPQDAGAADPTHAHDCMSAVRDLRQLVTQIAREKLRGFDNADEVPLVLACNSIGCALARLYAHEHPGTVAGLLFLDSVLANSDFVSQFPDPDAEGFTEEGLPEGITAEVLRTARERIGAMFHPDVGNKEGLSRKNLRVLLPDADAPVLKGADGKGPYVTVLGHEFEHFGVEAEKMGMPRAATLAYSNPYWDRYNRGLARITESSRSKGPVQVPGAGHFIQRDNPAFVAAELDAMLGKLE

SEQ ID NO: 1132 - protein, 626 aa, Unknown
  Kingdom: Fungi, Phylum: Ascomycota
MGINSSNEAASVKLAPEPETLLPTTTTTLTPPHVAVAKNVVVEQIESVKNTSSFTCKDAPVENQRPLKVRVIGAGYSGVYLGIRIPQRLRNVDLKIYEKNAGVGGTWWENRYPGCACDIPSHSYQYTFAPNKAWSGFYAPAEEICEYIDSVATKYGAKRFIHLQHKVTSSIWDDAAKKWVITVENADGVSFTEEADIVIAARGNLNDPAWPEISGLETFKGKKIHSAAWDQDYDFRNKKIGIIGGGSSSIQIVPELQKVEGAQLSCFVRSKVWISNRFGDETMAQLGWDPAETKFSAERLDEFSKDESTYLKFRKRIEDDGNMVHSSSIRGSDMQNMFVSFFSKITKERLANRPDLLESFSPTFGVGCRRLTPGPGYLEALMQPNVDFITQGIDSINANGLKLAGPDGRQVDVDVLVCATGFHTSYVPPFPVKGRGGCTIEDKFEPFPGTYLTMGIDDFPNYFMMLGPNSAIGAGSLTCLLEAKGDYIIKCIRKLQKEDYVTMTPKRARVDDFTQYIGEYFKKTVYMDDCKSWYKVGGRGDKISALWPGSILHLMETLRAPRWEDYDYESAAENRLGWLGNGWSMCIMEEEEQGDPSWYLNPEYVDVPPEGEPEKDAKIKARPWSH

SEQ ID NO: 1133 - protein, 210 aa, Unknown
  Kingdom: Fungi, Phylum: Ascomycota
MEARSLLRPMANLLSKPSTTTSTALTTTRGHKTTARTKRALKIAPHPSFLPDRTRPFPAADSIIYNPPSSQATPHHTPFLFLPRNDPRRDALKRMRASGLLPSPAIEPSGQLAPELNYKRRNPKSHITAQDVAEMKRLRAEDPVTWSVNALAKKFECSTIFVKMAAPASEEHTQWLAEKLERRKARWGPMRSQAREDRKRREEMLHRGEL

SEQ ID NO: 1134 - protein, 715 aa, Unknown
  Kingdom: Fungi, Phylum: Ascomycota
MDAGPYYTTTGREGDAAQELHDAGNTHVTEHDEANLGHDPNHEQHHNGHHDQQDSRPANLEELQLAAQLGQGLTEAPMIPEPEANMEDPNLRSILPHPEPEHQDQNAEQQPQPYMGPEPSAAEAVAPHGMPVPVPPQIPPHYSLPNDHVPPRKRSKVSRACDECRRKKIKCDATSDSGENPCTSCAKSNVRCLFSRVPQKRGPSKGYIKELADRINSIESKLQSEDGLGHEDLEKFFAQERQRSSTGPADDASRKRPFSSISGNEFTTPTSNNRQAPWGSESRGPQPESFTSYTNASLAPQASPIKPDTTPSKQPVANMDIPMPDDEDVPEVGDNILHDYVTLIQPLYPVLPDDRSKLQSLLVQSPSPVRTGFLNAVMAIAQPAGGNAKLASSLLNDWENSENPRTPASNIVHAQALILLVIDADMRASATLPSLLARAVALANSMKLWKMADMGAAAEPDSDAQLCVRIWWSLVLLDRWHAAGTGKPMLIPDSSIVIPAGLDAIVGESRYYLIRLSKVLGKVATTIASLPPSGTAEPMAATILSDYVENFREDLPSHINSSTFPLVHQAYWHARLLVTLLHPIISGTANRLLWPTSELITLLTSEPDIKTPLTHHFTSLLVLALTRLSQLDESKESALQLARDVVDQPGASVWDEVRERLARLTRPVSSVEAAASQGLQHLADLATAGQGGTADEETVQGQESSSLALGYLDLV

SEQ ID NO: 1135 - protein, 504 aa, Unknown
  Kingdom: Fungi, Phylum: Ascomycota
MFRVSKALSRLNGLPRRTGLNLGTRPQQALLAPTRFQRAAFASKKDDKADPPPPKQPIDYEAERKIGERKLEARPSEVSVKSSTTNALKTPTENLADNPILQNELQHDMGIIKDTFSLDNVPRESKVLGLAGTIPYFATSLSTVYLGWDLKQELPSGNAFYDAIIIDHGTAQYLLSIIEPVQLGYGAVIISFLGAIHWGLEYAEKKPSAERTRFRYGMGLIAPIVAWPTLIMPVPYALTTQFLAFVGLYFADARATTRGWAPTWYGSYRFMLTAMVGLALFVSLVGRQKMSQGNALTQEGLQKRLEQTGRADHDTDWAKLEAEEKKRLKKEKAEAEKKAKEEAEKKDKKGKDAKEAGKEAKDAKKSNGEKTDDDSAKEEDDGRDNNDTKKNGNDQVEEGDTEENQKQNKNKDEDKDESKDEDKDESKDESKDEDKDENRNDQEDEGNEDDDSKDDEKGKGEEDDSKQQKGDKKEAENGKNQKSNDKQQAKKADKESESQKGTGK

SEQ ID NO: 1136 - protein, 220 aa, Unknown
  Kingdom: Fungi, Phylum: Ascomycota
MSRATPRKGRHNRDSSNRIPAVSDYESDAAAMHASYEPPPPRDNNELNLSVLRRYLPSIHTILSIAANAVVYTFDSLAEQWDKSGIEGTMFVCAQAPMPDDPSQRPRACVFVLNRRGLDNVIVDLARVTHAELTSELVILSVAGEWEGQGPRVMGLWIHNDHEETRQVNFAMIQEAWKVASTSGVVEGTGPEAGPALQAMGRRLSLSELFAKQNGAQLGA

SEQ ID NO: 1137 - protein, 340 aa, Unknown
  Kingdom: Fungi, Phylum: Ascomycota
MSASPGQIKTRILIISDTHNVKPVPENPPEATDSDAEVRLPANIHDRTTGYREPLPTADVALHCGDLTMRSFTAQFKATFQMLRAIPAPLKLVIAGNHDLMLDDDFYERHKRPDVHYDRAEMWRIIKEAEADGVKYLTEGTYTFDLQNGARLTVYASPYTPAFGIWAFQYSEVHRFSIPRHVDIAMTHGPPKHVMDWCKDGTRAGCTQLLEAVRLSKPRVHCFGHIHESWGATLAKWREDSKPGDDADEAMEQAATKVVLKGSGRGDAQIVDARGKLVSDQMMAELVAQRGVVVDTTEGEHALKTGDHTLFVNAAIMDQGYRPSQLPWVIDIDLNRTPAP

SEQ ID NO: 1138 - protein, 214 aa, Unknown
  Kingdom: Fungi, Phylum: Ascomycota
MNIAGIGRPLGSLKAACRHVRHVKASYRGIATAQTRDLTSKWVTAHSQQQRADIKKVSKFAIWPTLPSVTTNPMPALREQQVAKLDPTGARTRLFSKEHADSAKVGDVLMVTPKSGEPFAGAFIQIRRQGVDTAIQLRGQLMKTSTEMWFKIYSPTVAGIDIIWRRPKRARRARLTYMRKPKHDMGSVDQLVFKWKKERYALRSKAAGQQGKHR

SEQ ID NO: 1139 - protein, 255 aa, Unknown
  Kingdom: Fungi, Phylum: Ascomycota
MKFICLHGAYGSAKAFQIQLAPFVSVVEKTGKGEFKWIDGGYPAKPPEGFDSYFGPPPWRRHINYDGVGALDELMDKIREFPDGVTAEDAIRDLIGGEAVYNADAIREGVGRILKMIDEDPEIEGILGYSEGATVAGTLVLEERRLFEQEGRPRRIKCAVFFAGWPPVKINEDNSVQCLLADECEDVIDIPTCHIVGCNDPYIHGSMALYSMCDDDLAVLFDHGKGHTVPRDTTTVNELAAAIGDSISKAQAVAC

SEQ ID NO: 1140 - protein, 544 aa, Unknown
  Kingdom: Fungi, Phylum: Ascomycota
MPQSEQPKRRFVPVPIETTFQSFRKNNGRQPGPNPELTPEQSPRSASPPPREHLQKRKFAPQLIETSRRSRRVGDAGPATKPTDKTDITPYTKNIYTAKHVTRRQWEDRFEEDLERPMPPTRRETEDEGVKEYLLDLAAKEAERLIHEEALAAFPNSHAREGGVAHFYFQESSDSDELTEEVPGQDAQLRARRKSSNLGINWWHKHMQEHVQQAQEHDDVMDLDKEPTDAELDKMDLTAPPDPLWTTTNRVEDGDQMNLTTTSKVHDQEPIKTDFATSSATQKPAGSPFGTPFAGLLPKADPQEKKKKGVSPPMLGDDLVFRTCPSPKYTKLETDHPFIEKDRPDRHRDTAGGGGLWRGYCYRSGSDETFLVPAQLKPAPMISTPYPVAQTPGGPMATDYFSQEPSPVSKPALHSLHGLDERLRRAQARAEKNEKIAAEFSDDFVTQVYNYLSLGYPSMARGFDDELSRISRIDIEELRSEDNKQLAKGYVLELNLQDSRRGERCPRWRALRVYITEWAKQHPDLDNLDPLAWGVRERRGSWGI

SEQ ID NO: 1141 - protein, 310 aa, Unknown
  Kingdom: Fungi, Phylum: Ascomycota
MNGASRFGPEAELNSLSQTEVLAYFDACTDAGVIKFDRDFVTKTHTIDGIEFEFRISQALKSKPHETSSPLASTLATDAAPRPGSDLKTAGTEIAALGSTHFLALNGFACYRPHYLMLTNDGYRRQWEPLDEDDFAAVHALLDAQMTGDKSGRGEYLVFFNGGADAGCSRVHKHLQAIPQESYGGDPWMNLDKGIMPFAYFERRFTLDEPFSSETSLKAYKEGLAAAERSMGVATKDGEDGKPHAPAHTVLMDRERIVVIPRVAAGTGGVGANAAGMLGMMWVHSDEGMQKWLDVGPHKVLKAVGVSKLS

SEQ ID NO: 1142 - protein, 359 aa, Unknown
  Kingdom: Fungi, Phylum: Ascomycota
MTESIPKTMYAWRKHRGNSDPIWEEVPVPEVPPTGVLCKMIAAGGIHTHSSPLQLETGVAKKETDLDRASNKWTLGHEGCGRIVKIGDRVEKSDFKIGDVVALFAVPGCGEAECPECSRDLAQLCERGHHSGIGQDGFFAPYATVDARGVVVIPEGVTPAEAAVATDAVTTAYHAITRRAEVKATEVVFLFGLGGLGFNALQVARHVGARVIVCDIKQVLLDEAVKLGVPREDVVPVGTSPQEFVRNRNGLHIDTVLDFVGTSQTFEDAQHIVRRGGKLLCAGSMNPQNTIHMKIGTRKRLSFIFTYGGQVRDVKEVLELIARGVISPQVTEARLEDFPARLAALVNGEVQGRTALMME

SEQ ID NO: 1143 - protein, 947 aa, Unknown
  Kingdom: Fungi, Phylum: Ascomycota
MRRHAHSCDQCRKSKRACDAPQLSLPAGIAADRAALLSGNLQPPETPPCSYCKKTSKTCTMTWAWNQLQLTNVLDAASRRNLDPPDSVPAKRPQPSDAGDASDSSSQSQRGDRSGRAPLMGGGHMHNFSFPTSMPPHAPNMMPTQRTDASLFPGHLPGPVPEGLFSMQGHFGMHDDGGTQHLAMPDLGFSFSDNLPQNGQMDPSMAYAFTSGISPPSTTVLSAPYDQANPDLRFTMPENSIELISTPLETASGASRAYSTRSDSFSDSQPDAKRRRFAESSMDVATRASMSPFSIDQQMMKLHTRSMFSESLIRVYHDVLEHNLSCWVTEATCPYNGTISRLEGQQSAEWGTSWTNRILDRTMKLDASTRAAGLVKLTRVQEYAANRALQMAIMAFATQWAQGSNRKTERFSPRSPSESGSEKTEDSVCDFADSLDRMAQHHFWNEAQKALNEVADVESYMVVCAEIVMGFTQKPWQPDDLDTNAEEGHLGRKTDAFDMESLMAEINRCIEKDGPPTYLERAARKAHTLKFRLNAAAKGVAKRQGLTKGAAKGQILSKEDQRTAGLLYWLAVMADTLSSSMNERPVTVNDEDSQHDGAADEERDGGRWNVELFIKDDLDNPTQKRTWPCSHEEAAEGVTIAGPVKILMYRHVAYLQGMLRRGQGGKRVEDVINSAMRLWQYWNMTHGPFFRQLVDDSDNVPIRVRGWFFCIAAHWHLAVLMLIELIEFVDEEDQGSAEAKRVREARRTLTRMREISYRELSDLGRMSLPPSETNRPPLSMLGDPSLQPDLHHAISEATILSEPWTIILIRAFSKVAAALLKEVDSSQRFGVPPMFGGGEEMRRAEDCIKTLFYLGRKSDMARRVADVLTEAMATLQSTAQRGNDMHRGDLSGDFFGNLQHNIDGHMNFPTSSHDHAHGHGHNGSGHLRAGMAALNQRDFMGMAMPTA

SEQ ID NO: 1144 - protein, 329 aa, Unknown
  Kingdom: Fungi, Phylum: Ascomycota
MSSVPSVLTEVEKEHFLQNGFVHLKKCFTQEQAEKVTGNVWTRLGMDPGDSSTWNRLRTNMPSHSTFSADDFAPRAWAAICELLGGEDKINLERSKQWKDSLIVNLGSPEYEGKDVKPQDLENWHVDGDFFVHYLDSPEQALLVIPLFTDIKPGGGGTIICPEAIPKMAKHLHDHPEGVCPLMWPRGHAEFKKECDRQFNLETAKSCTNFVEATGEVGDIYLLHPLMLHTPSTNPLRHLRIITNPPISIREPFKFHRLDGNYSLVEQATLRALGKESLPDWEIAQPREEVIPARVRIQAKMKEEESKRLAAAAAAAAQSQSSAKAVAAN

SEQ ID NO: 1145 - protein, 419 aa, Unknown
  Kingdom: Fungi, Phylum: Ascomycota
MGAIDRISQVAGQLSGNPTAGGRDKILQKNPDDVVVTACCRSAFTKGGKGGFKDTAAQDLMAGIFKALIDRSKINPALVEDIAVGTVLAPGGGATEMRAAALVAGFPESAAVRTLNRQCSSGLQACVDIANQIKAGMIDVGVGAGVESMSTQYGPQAVAEFSDLLENHTEAANCKVPMGKLSEDMAKDLGVSRASQDAFAASSYQKAVKAQKAGLFDQEIAPLKAKFEDPKSGEVKEITVARDDGIRDGITAESLSKIRPAFAKDGSIHAGNASQISDGAAAVLLMRRSTAEKLGQTIIGKYVCASIVGVKPLLMGQGPWKAIPKALDLAGISKDDVDIYEINEAFASQCLWCANELGIPHEKINPKGGAIAFGHPLGCTGARQVSTLLYELKRTGKKVGNTSMCIGTGMGMSAVWVAE

SEQ ID NO: 1146 - protein, 746 aa, Unknown
  Kingdom: Fungi, Phylum: Ascomycota
MASRQLVRGLASAEPLASTIGVPLFLCPALARYPAMTYGRVQSASGATSPRTNRQFLCQRRRNHSQASATTSGGNHDDTLAQVIPSPEPVTHHVDFAAPVSRQLPMSCSGCGAFAQTTDPKQLGYYDLSAKRVRQWLKPLRANKPKSDVTAKEDQVVESVLANMDEARLKELGLDPELLSTLVTPAEPPQVETPKEPLCDRCHLLTHEIGNPEKVEMFHPTVDSLRETIEESPHKNNHIYHIIDAADFPMSLIPRLNVLLGDIPMRTRNRRSRSGKYMNDRKTEISFIISRGDLLGPTKESVDRMMPYLREVLREALGRVGGRVRLGNVHCVSAKRAWWTKELKRDIWKRGGAGWFVGKVNVGKSRLFETVFPKGMVTHGSKTAPPASLDSSNPEGSAAVDDVVSNDPMSFGDLLPPPRPLEMYPQMPIVSPHPGTTASPIRIPYGNHKGELIDLPGLARSDLEHYVKPEYRDSLVMQSRIVPTQISAQHGRSLILGGGLIRITPTTPDVTFLMYNFTRLSEHLTATEKAVEFQAQTRKLGISDNISTEEAAGKMTSAGTFKLRYDVTKARAGPLVKKHLGGKRVEDLPFRVVSLDLLIEGVGYVEVVAQVRTRDLEDMIASQAAEDLNATTPPSRSSAPEPEPEKTTSDDPFQALAENRIDTSRPPQASHQPVQQTRPARPTKEWPTVEVFTPEGRFVDYRQPINGWLNNKPLILDKHKKKRPRKSMRGAKKKVKQTRRAIMQEE

SEQ ID NO: 1147 - protein, 296 aa, Unknown
  Kingdom: Fungi, Phylum: Ascomycota
MAAATKLRKMVEDPQSFVVAPGVYDGFSARIALEVGFDCIYMTGAGTSASRLGQPDLGFASLNDMRAHAEMIANLDPSTPLIADADTGYGGPNMIARTIEQYHRSGVAGLHIEDQIQTKRCGHLGGKEVVSAETFSQRIAAAAQARKRVHSDIVIIARTDALQTDGYEEAVRRLKLAVAAGADVAFLEGVQTEEQARGVCRELAPTPVLLNMVENGATPSWTPDQAREFGFKIIIFPFLTIAPAYEAIKSSLQHFKKTGTSGISKDFTPKKLFTVVGLEKATAVDAEAGGSMYSRV

SEQ ID NO: 1148 - protein, 634 aa, Unknown
  Kingdom: Fungi, Phylum: Ascomycota
MMMVSPRTEALAGVGVAGYRDVRQHIPSSAGASPSAAWARKRAASLDALEEDKVKLEQMHPGAPRAIAIDEQRDHVCLCTSDPKIPRPRNAFILYRISHHTKVAQDNPGLSNPDISKIIGDKWKKEPDEEKERWRKLADEEKRRHQQMYPEYRYKPRRASKGQPPRKGGTSPVEDTGRCTKCNGRLLTTPDTFQPPSAPITPKNEMNDPLGVQSNYSYDSLMVDRRRHSVQTAPARSINDESPEAKRRRLNETGENQSMQPPSGTPNSFTPRQPGDAFPTAPGPVHTPSRLPFSGGPLPQPGGIPRSQSGPINGPSRNYSTAQWNSPVSSQRQPAPPNSSYQLPPLRNSTPPQPSGLGLRPALPRQGSFAAEVLSIPAERKLSHLMKVCRPLPARPGRGQIIAVEGPHEGPALCEISRIVEQALQTCRNTCVRSWSGNDADSGARSTAEGAAGKGISSQKPPVSIPDYYMSIMKWHEKSNQITRHVSGEGRDPGPIQAGEDDSNPPFMSSPTTDGRGPKSQSTPVALIKDGYSLTESDRFACNSAETENWSPNDHWQWAAFMWRGIVAPDLTVYVCPSRGEDIEHMGSVDFQRQLNMMLVRVPITLEVSESTRRRVAFEVKEWMADRLPRQAGD

SEQ ID NO: 1149 - protein, 289 aa, Unknown
  Kingdom: Fungi, Phylum: Ascomycota
MAEVFGVITGALSVAALFNNCVECFEYIQLGRSFGRDYQTCQLRLDAARLRLSRWGEAVNVNHSDRFAAPPGDDDREAAMAIAYFEEIQHLIQGVQRSAKRYQLADPSRNTSLATPEDMTVVGNRVHNCATEIARHRQKKAGILKKMSWALYDGKEFGKMITTIVTLLDELEQLFPVAPAYSRLADLEIAKVDDEPSLAALQRAAEGIDPTLSDAVARKLLLLTGSNSAGAIETEDESEVQIGNWYSDQVMAQGLSVTDSTTNSSGDIKAGGSSRVQIGNRFGGSSMTL

SEQ ID NO: 1150 - protein, 645 aa, Unknown
  Kingdom: Fungi, Phylum: Ascomycota
MHWLQTAVILAPTAWAATLAGFSDLSPAKSQIEQNSDCKLPASFTVKDFTGKSNGTGSTLSSFNFTFLDPTTEVNTLCQFNSSSVSTTPGSLTKRFACNDRETKFIWEGEEDQLWMIERVCMADSGAPLYETAGSIVMHLNCDSKSQRCTSNATETTGSPSPRGCTPGMRILPPGDDLTFSQDLAPTAPSLNVRTPTDGYPGRTPQRNVAVPGRQVRSIFLRPSVRTISLVWRSIALTDNITPVLPWPLLLLMQLVAVTIAFDIGLGERSLRDAIGPKAVSTRLFAELERLARLVDISYCIGTTGVSKPFNCASRCSEFPTMVLAATWNTGILLSDSCGYLAVDHGTGRSDIGGDIPRSEIGHKAIIIAFRGTYSITNTVVDLSTVPQKYLPYPSPDHGGEKPEKPEHKCDNCTVHQGFLESWQQARKLVLSQLDELTAKHPDYPIHLVGHSLGGAVACLAALELKVSLGYDNVIVTTFGEPRLGNYELARYVDEVFSLDQDIKPENSTYRRVTHKDDPVPLLPLTEWGYRPHGGEIYIAKHDLPPSESDLQACIGDSDPSCSAEDDSSLTEAMRRMLPWAEVDNMREDEGLDGGQARGFPTRFKLWQLFFAHRDYFWRLGLCVPGGDPANWGRERYDLVNGDEL

SEQ ID NO: 1151 - protein, 307 aa, Unknown
  Kingdom: Fungi, Phylum: Ascomycota
MVVAPSAQVETPGSSRADNPILNPSQSVSTAYKPSPLGYGSPPSRSSPFRRPESPASPSPLRHTTPSSSPTKAAPLAGASRFARPTTPTSTQDSWTPRAQTPVESMASPQRPESIPRAPPTKALSNGNALSQLLPAQVRTLRDGFQILDRDCDGVVNREDVADMLSQLGLPNGHSDVAKFFPPSRPQTIALAAFLNSLAEALAALSPSAELLSAFSAFDDDDSGQVNWAELRDALLNTAPEPGERALTAAEVDKVVDGFTGRRAFNRNMNAQLGAKKGEVFKYQEFVHSIMGGNGSADNGSNGNSED

SEQ ID NO: 1152 - protein, 316 aa, Unknown
  Kingdom: Fungi, Phylum: Ascomycota
MAQIASPAPAQAPAQARKGPFWCTAGPMAAPVSGCGGTERSGSITASESDCLFPIYHSLSDKNSGTTSSSNAPDYAEPIRHGAASKHHRPEMKTFLDLDALSTSSITLSHLSSPQIPNPHASRPRLEESNANIFLSSGRTSTATVTAAPEPAEATNLMATSSTDSAVRVLGADATTLHHSALRELRDLELMQDTDFALPDRGRQRSRVNSHHLRVFDHLSADDRPSSSRSHLRYWHRSKSPMLDASKYLRVSSDGSSPSISNLPSMTMTRDEYEALPPTIQRKVSCIFTRVSRIRLTSTILATMNHQPFAPPHLST

SEQ ID NO: 1153 - protein, 508 aa, Unknown
  Kingdom: Fungi, Phylum: Ascomycota
MVVLAASICTRGGKAVLSRQFREMPRSRIEALLASFPKLADSGTQHTTVEQDNVRFVYQPLDELYMVLITNRQSNILQDIDSLHLFAQVVTSTCKTLDEREITRNAYELLSAFDELVTLGYRENLTLSQIKTFIEMESHEERIQEIIARNKELEATEERKRKAKQLEMQRKETARSGRVPRAPNYPTYTPPSQPSTTTYDSYEAEKNKTYNKPLAPKGKGMQLGKKSKTTDMFNRVRGDMGGEIDDTPLVAPTPQAAEPTEPRVSSTLDRDAIHVTVSEAITAKLSREGAVNSLSVSGDLTLRVSDPSLTKIKLGLKAVASHGAQFRTHPNVDRNLFNSSKVIQMSNTARGFPVNNAVGVLRWRATPKVDDASACPITFTVWINKDADKFNITIEYELTGGDALHDVSVTVPYQGSEPVVSSFDASYEVSGDALEWNVGNVDEDNPNGSFEFEAETVDENDFFPMVVRFNKATPYIDVDVSSVSLLEENEEVTFSKDIKSAADNFLIE

SEQ ID NO: 1154 - protein, 275 aa, Unknown
  Kingdom: Fungi, Phylum: Ascomycota
MASGSRPRDLTFVPFVPAESNYQERSPWPASPYAYDIVHARNTSTIWSSFPVTDELQLLEWLSQHTTIPVPKVTSQGWDPQRRQHYALFDTPTGMPLADCWEDLSEDARTRTIEQLRSILKQLRAVTVDKLPNHGTRDMFLDRRDGVVAGPFTTQAEFLKALTVRVDAIGSIYNPGPTRKAICFLEAMEQMSMDKRMVLTHGNLNPENVWVTQNGDVTAIIDWSQSGYAPVFWEYIKACLGDEDSEVHLDGIYDDIMEPWPLHLAVMMHVHDIIW

SEQ ID NO: 1155 - protein, 408 aa, Unknown
  Kingdom: Fungi, Phylum: Ascomycota
MKFLLNVLLLAEALQGYASHVPHQKRLDNGLGLTPPMGWSSWNVAQCASASASYALDTANKFVSLGLKDLGYSYVNIDDCWTTKSRDGSGNLVPDPSKWPNGVKTVVDQIHAMGLKFGLYGCVGTMTCAGYPGSWGHETQDARLLASWGVDFWKHDACYTPCANGQSPQTCWDPAYNTRAWYEKMRDALQSVKGTKNIYYNLCQWGRDNVWTWGASVGNSWRMSGDNWQDWASIQRIGSAAAGISQYSGPGGFNDLDMLIIGNNKLTENEERLHFGLWAIAKSPLILGNDLNKISSASLAIIKNKANINQDKLGKAATTFRPPGSPSPVSGQIYPYWAGPLSDGVVIGLAAASGAATLSVNFKDVPGLGSGTYSWKEMYSGKTGHHSWRRVELTTDNYYYYYYKTSHE

SEQ ID NO: 1156 - protein, 506 aa, Unknown
  Kingdom: Fungi, Phylum: Ascomycota
MQQQYRAYQQQMPPQVPHRSPHATTQRRGGYGPVMTGGQPAMQPAHAQNQHNMQQQQAYQAAEQVKRLKSRKPTDKNLPDGVEDCIVDPEIARRYKELREVERRVDTTMTRKRLDVMDSANRNAKLYKTMRIWITNTVEDQAWQGSGDLNVDAFDFSPNMEASYRVKIEGRLLDDEEETDKPENNKAQDGDKMEEDGPEAEKAKTASSSPKPCFSHFFKEINVEFDKQRYRNAAEQVIEWKRPEPNARTQSGGNPAADFDEFTFKRNGDENTNITINLHRFEVPERYSLSPELAEIVDMKEGTQPEVVMGLWEYIRLNGLQEDEEKRNFRCDELLKRVIGAVEVAHIPMLNEYVKRHLGPQAPISLPYTIRVDEEFHKDPQPTVYDVQILVDDPMRATLQSLVVNPQYASMLKDVTELDGQLGRLVQAIAVSHAKHSFFNSLSEDPANFIRNWLSSQKRDLDIVFGETARSGAAVTGDEWRKGGKDSIWATSNARESVNVLLSKHR

SEQ ID NO: 1157 - protein, 279 aa, Unknown
  Kingdom: Fungi, Phylum: Ascomycota
MDKDGTAAPTPVGASTQPTEPPQDINATPRPAPSGIKSTRAQLNLSNFYCEPPSKYTNKAADTHRVLEAPPLDWLTRTWTVTHSTLDMWRSARNVRITYRTLPGGADVSSSSSGSSRNNKPDRIDDLVEYEPTSSTSKLKNVKGVDTRSPTLGWDWRGKSWLFFVTSHWEVLGWGEVLSEEGDDDDGTEVLERWVVTWFAPTVFTKEGLDVYSDREGGVSEETYRKICQGLEAMVCEERGGDDDGSSGRPLALSPEVDVVRMFRQHLLPVEIKLPWIKA

SEQ ID NO: 1158 - protein, 477 aa, Unknown
  Kingdom: Fungi, Phylum: Ascomycota
MASKASRWANAAEDAELEAKLKREKEEKRRRKQEKAAAAAAAAAAAKLEDERQEDRPSKRRKLTPDPTTPTPTTNGNPGKDLPPAKLLRFERGGWRMARSVEEYDKLNDIEEGTYGWVARAKSRKTGEIVALKRLKLDAADRSGLPVTGLREIQILKDLKHRNVVELKEVVIGDNHSKLDNSIFLVLEFMEHDLKSILDDMPSPFLASEIKLLLLQLTTGLAHLHTHHILHRDLKTSNLLLSNRGVLKIADFGMARYYAPPSENTPTSQQQKLTQLVVTLWYRSPELLLGARTYGAEVDMWSVGCIFGELITREPLLQGKNEADQITRIFDLCGIPTDSSWPSFRRLPNTRSLRLPRTTPSATPSTTQLIRTRFPSQTTATTSLLSSLLSLDPAQRPTAEEVLRHDYFTKDAPKPKPESMFPTFPSKAGQERTRRRAEPHAPGRGDEAVDLGEADLSGIFGGRDREERGAGFSLRMV

SEQ ID NO: 1159 - protein, 183 aa, Unknown
  Kingdom: Fungi, Phylum: Ascomycota
MMQCSSSHILAPFRPHSKGPLTTFQSASLTFFAPYTTQYDQAGLLLTLTSPSTSTKKWIKTGIEFYNSQPRISTVCCDSWADWSVASLPASAPAQEIQAGTKGVTIRVDRGQDENGVGFWVYYVPESANKEEELPLREICWVFGENGGEGWELEVSAAVARPNKDVKGELQAKFSNFNVNWSS

SEQ ID NO: 1160 - protein, 207 aa, Unknown
  Kingdom: Fungi, Phylum: Ascomycota
MSRVTQLSRSVTSAASRASPLLDSTAHAAGVPIMPKYADLLMRSGRSSEHLHDRSITTTHRPTPQPSITNRNRPLMQTFSSSSASKQSNTLDSTILPSTFLFSSSSSSTVDDIRVPLLPDAYSITHPATAAAPISQPEVTIVASDPENVIPGSSLAEVSAAGGADVIDLGFVHSSGQPEAKEESNMLKDLWKGMMDDLFATATPKKA

SEQ ID NO: 1161 - protein, 358 aa, Unknown
  Kingdom: Fungi, Phylum: Ascomycota
MAPTQTAAGAKPAGAYLEYTDHGDVFTQHRFPEQLVDLGEIRMNYSVAGSPSGPALLMIPGQTMSWWSYESVMEQLSGMYQVYAVDLRGQGRSTWTPGRYSLDIIGSDLVRFIDLVIKRPVVVCGLSSGGILAAWLAAYSLPSQILGAVLEDPPIFSSQLSPPVGQSAKQAFALHLFRAWTKWLGPQWSIGDEEGFKRGITKELPSWFTGAIARATEAGLQTIQTGLPPRYYDPGWASAFVDGSIDVNCDQEAMLKQVKVPILLTHHLRYVDPVSGNLIGTVSDLQVAHAKRLVEGTGNSFTVISFPKHQHSMHGTDPVTYVTTITNWLAEEGFGPRVTPAVEGKGKGRYQMPERALG

SEQ ID NO: 1162 - protein, 239 aa, Unknown
  Kingdom: Fungi, Phylum: Ascomycota
MLFQSVYAVAAMAAAVSAQSLNIPSRVGSIISLPSPSVISGSKDMGNREYDRGRPCNSDEDTGSQNAVFILENGATLSNVIIGKNQLEGIHCKGACTLRNVWFRDVCEDAISALGNGNVLIEGGGAQEAKDKVVQHNGRGTVTIRNFTVVTAGKLYRSCGNCSNNGGPRNVVIQNVKATGVSELVGINSNFGDTASISGSCGNSVKKVCQEYKGVQKGSESSKVSSTANCKGQSSFSSC

SEQ ID NO: 1163 - protein, 327 aa, Unknown
  Kingdom: Fungi, Phylum: Ascomycota
MAPLSTRNSILSAAVAFLASLPSVSGQCPLPSSYSWTDSGVLAEPAHGWASLKDFTTVLFNDQILVYGSKHDGQNYGSMNFGLVSDWSQLGSATQTSMNQNTVAPTLFYFEPTDQWILAYQWGANPFSYLTSNDPTDANGWSAPQPLFSGSITESDTGPIDQTLIADSENIYLFFCGDNGRIYRSSMPIGNFPSSFGDQYETIMQDTKENLFEAVQVYTVGDTGTYLMIVEAMGDNGRFFRSFTASSLDGEWTPQAATESNPFAGKANSGATWTNDISHGDLLRSADQTFRIDPCNLQLLYQGRDPNENPDDYNLLPYRPGVLTLNT

SEQ ID NO: 1164 - protein, 363 aa, Unknown
  Kingdom: Fungi, Phylum: Ascomycota
MLKMKATALVTAFLAGCVAAKDKVKNIIVDTDLFSDVDDVGALLLATTLPTSNLLAVNINVPSTYSAHTASALLSYYGHKDVPLGIARPLSNETFFDNWAYELGEYASKVAYHYRNYAKLDWKDGWGMGELEKSVEEGTEEAVELYRKVLAEAEDGSVTICSIGFFNNLSGLLNSTADKYSDLDGPALIAAKVTELVIMGGQYPSGSEFNFFGDNPYHTAHVVNNWAGRMTFSGNEMGGNVYSGKGLLSNGPKHDPATRAYFWYNYGQPRESWDPLTVLYGVEGLGCMFEYEGEGGRNYVFANGSNEWRYGEPGDDDKRGEQRWLKLKVKNETAGAKLDELYLRGSWANVPTTGCTASEKEEL

SEQ ID NO: 1165 - protein, 137 aa, Unknown
  Kingdom: Fungi, Phylum: Ascomycota
MPNVRKQPEPESGMQRAVDFSQSFLAVPGYADDSLLSVMRYVSKAQSMPTSTQTSLRKCDFEEFMAELGNIETATNAAAETPAARVEKIKEHRQKAFSKIEEVPELAAEFNHFLMNSRRLHRQQQGVAKEKGSESQQ

SEQ ID NO: 1166 - protein, 883 aa, Unknown
  Kingdom: Fungi, Phylum: Ascomycota
MEPVVYEETPLADYLKDDAHESGEEWAPVRETPPASDSGQSSPSLPSSPTTGFAPVGRPMVRTRFRNKPKPLRLETTSVPDSFRAINRTYSAAVVASLDRGDTARFLEQFRYTIVASQLLNGHSLLGQGQPAPVDFPPAPDHADKSLVSVEGIFASVLGALGVAVVLSWVLGNAPSYFTRKRLVFLIVLLVAAVLLGQVYMRRQWLRYRRQQSLSEIRTFVSNAQDFDSAAGAALALIQEVELVSRGYRILPLPPISRLEDRSQSRKCVRLRRTLKSTFADMLQTYNQVARVVRGFAEQSDLEKYYDIYDVSDFDMSDALRGFDETEFDDFESLRTLKILAARFQILRKLFLCGLLALDACGDESDLLRWTAAVEALRSINETTGKTHTQLQTILREEESFPTPPTPKNPLSPGRERWRSQMHKLNSLSTGIRGLQAKLQLLREESDQALDDSSDISELGPNLMSQYESIGADLKELMAAWEEGKAALAVGIDRNEKRLSSISTLLSPSSSLSGLTAVEQNGTAADALKALTGQSPTPSEVNEESPEVFEAVAKPRPRSMLSREERLIKMREEREVKAQARQHFDATRGMLKELETVINLRPRKRLTLITPPFFPSSPLHTAAKMLEARLEQANILKKVVDAIKDLVQDCNFDCNDSGIALQAMDNSHVALVSMMLKAEGFSPYRCDRNIALGVNLTSLTKVLRAAQNEDILTLKAEDAPDVLNLVFESSENDRISEYDLKLMDIDQEHLGIPETEYAATIAMPAAEFRRICTDLAAMSESVSIEASKDGVKFACNGDIGNGSVTLRSHTNVEKPELNVDIELTEPVSLTFSLKYLVNFCKAAALSTQVKICLSNEVPLLVEYNLSGSSYLRFYLAPKIGDEE

SEQ ID NO: 1167 - protein, 610 aa, Unknown
  Kingdom: Fungi, Phylum: Ascomycota
MVPARLRTGKAAIQSWQAAVLVPAVAPGAARRFSSDDGSPKTPARREAATPEAKPRSFQGQVMGSIGARLRREREQRVEYEKWRTATDPMRNWSFTFVFLFGIGTAYWMGTYYQREPEPSSTLPLSKALPPKHNTKLENMQAAWTDFVKIVGKENVSTGADEVENHAHSEWSSHRANPNERPFCVVFPSSTEEVSEIMKVCHKRRIPVVGYSGGTSLEGHFTPTRQGVSIDFKRMDKVIALHKEDLDVVVQPAVGWELLNEQLAHDGLFFPPDPGPGAMIGGMIGTGCSGTNAYRYGTMREWVLSLTVVMADGTVIKTRQRPRKSSAGYDLTKLFIGSEGTLGLVTEATLKLTVLPESTSVAVCTFPTIRHAATCVAHVVGKGVPIAAIEILDDNQMKCINEAGMTSRSWTEAPTLFFKFTGTPQGVKEQIAQVQALARKSGSKTFEFAKSEEERAELWSARKEALWSTMAVRKDGDRVWTGDVAVPMSRLPQLIEETQEDLRKSGLFGSIVGHVGDGNFHSILLYNDAQRKKAEAVVHRMVKRAVEMEGTVTGEHGVGLVKRDYLPHELGETTVDAMRQIKRAFDPLNILNCDKIVRMQKPARGEVEEW

SEQ ID NO: 1168 - protein, 336 aa, Unknown
  Kingdom: Fungi, Phylum: Ascomycota
MSGLGGLNKTTGGIVIAAVQSQLFRVDTPQCLARATDHIVALVRRAKRQYPAVDMVLFPEYAIHGLSMSTDPSIMCSVDGPEVAAFRRACVDEKVWGVFSIMEKNDAASEGAMPWNVGITINHRGEIVNYYRKMHPWVPVEPWYPGNQGVSVFTGPGGVKMSLIICHDGMFPEMAREAAYRGAEVLLRTAGYTSPISQAWEVTNRANALTNLMYTVSVALAGADSTWRSMGQAMFVDPEGTVLERGDGTPDHIVACEVRADEVRRRRREWGVENNLFQLGHRGYVAVRGGAMDCPYSYMTDLAEGRYAQAEDAEVQIRDGAVCGFSPPQVDYQKDL

SEQ ID NO: 1169 - protein, 490 aa, Unknown
  Kingdom: Fungi, Phylum: Ascomycota
  misc_feature (136)..(144): Xaa can be any naturally occurring amino acid
MFFKQVTRIALATLLVFVGRVSADACDDVESSTAIAVARPLTLSYISEQNEYWSKACSMLKPVCIVFPTTAEEVAAVVRILGSHDHDFAVKSGGHSPNKYFASVEEGLLISLSKIEHADLDRDTGILKAGPGNRLXXXXXXXXXGNTGIGGLILGGGLSYMSAQYGWSASSVYEFQVVLADGSIVTASEDEHTDLFHSLKGGGNNFAIVTSYTLQTYRQGDVWGGNLAFLRTSRTDQRLLQAVRDFTEYNDDDKAAVIVTAERGNIDLIDSWILFLFYDGPEAPAHIFKNFTDIGPILNTCKRQSYSKLIGSSNWVIVPASHVLMGTETMPIPSAADAPTVFSELHSFWRQVSSTTLLVPGIIASIAYQPFPRRIAQAARARGYDLIDADPDADKLIIEINYSFLPLTDYDKMSDVLERTYTGYRQRIQAWQEDGTLPKDVYLPLFMNYANQRQDYWARLKPESRALAADTAAEYDPDGLFRGRTGGWKP

SEQ ID NO: 1170 - protein, 165 aa, Unknown
  Kingdom: Fungi, Phylum: Ascomycota
MPGRLTADLIFCRKWMLKESLAGRADARRGRGGLCSATPAGSQSAQTWKEVQSSTPPLAKSPCLASSRRASLSPSIRQQRYDEEQQLCLQSSITMPRAIRGVLIECDPSIKSIIVNIDSDNHDFIIEDLDEERVVVKENMVPLLKQKLEDRLKENLPPVDESGSE

SEQ ID NO: 1171 - protein, 1282 aa, Unknown
  Kingdom: Fungi, Phylum: Ascomycota
MTIIDISKDLAALFEQQAQATPDAIALEDEKRTLTYAELDSETFALAERLRDLGVGRDDLVGVLMGRSADNVIASLAALRAGGAYLVLELAYPPGLLRDVIEDANPVVVVTQKAHAGHIKANVPVIIIDEPQPQTNGKSSPVNHHARKPLPEADDLDRLAFVSYSSGTTGRPKGIANPHRASVRSYDLRFGVSNLEPGDRCACNVFFVWEMLRPLIRGATTVAVPDSASYDPVALVDFLAERKITDTLMTPTLLSTVLSRHPKLGEKLPHLRSLWLNGEVVTTDLCRRATTALPNTKLLNVYSASETHEVAAGDIRTFVDYEARVCPVGMPMDPEHTYILDEAGNRVEPGVSGELFVGGHLLAREYLNLPETTARDFQPDVFDTTKGARMHRTGDLAKILPSGLLEITGRVGGMIKTRGYTVHPGAVETTIVKHLAVRSCAVVAHGDGLERQLIAYIVPDKEEIGHRTIVVIDEAGHSPVARRALSSHLAHYMIPPIWVEVDTIPTHGISGKIDTKALPPPPTPKSPTVEQPKEANTKVKMETIVKMWAASLNMPVTAISKEHDFFDLGGHSLTLADLASRLSSTFGFPVPLAPLAGTPTLEGHLEAVKAARDGHTEAVQADLPSVLRADCVLPEDIQSTGCAMRRISEVDTILLTGATGYLGAFLLKSILESTSAHIICLVRFTEPTEDLRAAGMARIRNNLVDLGIWDDSILDRIEILPGNLARTRLGLSPESFDEIASRVQVIIHAAATVNLVYPYAALRNANVGGTKEMLRLASRSGATLHHVSTNGVLPPSPDGWAESSLLDIDAVPTEILDGYGQTKWVAEKLVYEAGRRGIPVRVYRPGTISGHSVTGSANSWDLLNAIILEAVNLGVVPEVDGWFAEMTPVDFISNAIVTLADHTSSRQHTYHLGDSNPPTASEIFALLSQLGYETSKSLPWDEWVELWRSKRGNGKISPEPFPVEILRGGMPTVEGLKSASILKNNVTQPALDSYGLKRVNIDASLWETYARHFYARGWLPKPPKRSQANGIALHPKKGRLAGKVAVVTGASSGIGAAVAAGLAREGAHVAIAARRTDALEAVKRKMNGPGKVLIHKTDVTNKQQVESLMKTTAEKLGPIDILVSCAGVMYFTMMANCQTDEWERTVDVNCKGLLHCLSTTVPPMLSRGSGHIVAISSDAGRKVFPGLGVYSASKFFVEATLQSLRLETAGTGLRVTSIQPGNTETELLGMSTDKEAIKKFGEPTGAKVLDPEDVAGAIVFAVCQPEHVAVNEVLIEPRDEPI

SEQ ID NO: 1172 - protein, 616 aa, Unknown
  Kingdom: Fungi, Phylum: Ascomycota
MWLPPAGYILQPFSLGREYPVSIPWESKGQQYGQQQTLSLPSTALTQNSPGTGQNAVRHLDCSIDRKHLASVQQRYGLEDKFRYLKRYIRFHRKPELERKSMTQIPHPFLASEFRTIDIRKEQPKIRCDAPLELDVSDSGFPFTVDASMFMFGVSTTYARLLHADTTPIEEWLFWLTDGYGHSNGAKLILTLVEANDTQLQEVANLLCDAGVDADVYHSESSMEMAVRYLSLIPTLYNHEQSMEKSWLVLCDDDTFFPFMHKLVERFQTYDASVPTYIGTLSEDVFSVERHGSQAFGGGGIFLSRSLAGIIADLFDSCTTRDKVHESNTGWGPQGDILLRKCIYEHTDVRLKTIWDLWQLDITGDAAGFYEWGKQPLSIHHYRGGDWTNAKPVEFTKIAYICGEDCILQRFMTQDGFLISGHSVSYYPDGTDFDWDMVERTMDAMPQDKGWNLDFMFGPQRPSLSRTGKKVAWDLQESQLGEDGSLRVIAYQLRNVTMPRSDEAAAFFHAVYSAVCEVPYGKVTTYGHIAALVGTHAASRFNHDTVPWQRVINSKGIISPRSQPDGTLNQAEALRAEGVQVTRSAMGELSVDFEEYGWFPAMLPSEAAEQPEEAET

SEQ ID NO: 1173 - protein, 534 aa, Unknown
  Kingdom: Fungi, Phylum: Ascomycota
MIASTSVTLKTCLFHSVVSVSSFFELSLFVARWWNLEFTRLRSLFLIFTPIAQERAGSPSKEAAIFIPRVGGSSVAFASTATKDTHYSIMAVPSEAVLGSPPTLRQRAVNGYYVLLTLMPRRFFRLILISSILIFVTLFLFTSSDSAPSFSRTTEADELQQSNEKIAQIHEASREPLERFPVTPMVSPAQGKGGVDKTHAPWLAAVISPAHDVDRRMLIRSTWMRLYADVPFEPKFVVSNPGPKWVETVRFENRTYGDMIVLDHIPENRVTANSIKTLEFYKWLVKHSRRYEYVSKIDTDLWLNARGFWDRYLEPRLTNTTSSSSMPSWKATVERTAIGQLYYSRPNHRAFPHGSMYTHTWDLIELLAKLQEKDPVVMGEDQAVTKLLRNAGEQANLVNMNATEKFDYDDDDAQSASSPFARAATHPTAMLHALYGSDVLAVHQLKDRELFMKVATAFDSKGIKAPPAFAGPEKTPPFFTRLHDVLDSCGVSTHFEGQLDRIPSSLYRQQGGDWVVNDVWNLGPDMTGFQRELI

SEQ ID NO: 1174 - protein, 634 aa, Unknown
  Kingdom: Fungi, Phylum: Ascomycota
MASSETKQAPVLPVEGKRNILITSALPYVNNVPHLGNLIGSILSADVFARYCRARDYQTLFICGSDEYGTATETKALEEGVDPPTLCAKYHALHRGIYDWFRIETDIFDRTPTDNHTRIVQGIFKDLWANGFIEERETSQPFCPVENHRSFLADRFVEGECSICGDKGARGDQCDACGASLDPLEPDRDSDGAQQDVGAAGWLINPHCKLDGATPERRKTKHLYLKLNVLQEKVAAWFEEASKKGQWSSSALSITKSWLDKGFQPRAITRDLKWGVPIPKVEGLSEEEYANKVFYVWFDACIGYPSITNTYTSEWEKWWKNPENVQLFQFLGKDNVQFHSCVFPASQIGTGQDWTKVHRISATEYLNYENGKFSKSRGWEEFIDTNNNELLKNVGNFCQRVLKFCAAKMDGVVPDGSTYTDDGLEAHKENARRVLGDYIEHMEATRLRFGVADILTFSALGNKLLQDNKLDSKLLTEQPERCNAVISLALHHIHLLASLLAPYMPGVTTNILTQLGLDEATSPAHIPDPASWAFNALPAGHKLGTPASLFATIPAAKLEEWRDAYGGEELKRQKALAAEKLAAKKAKKLADKERKKLEKEKKKQAEEEAAGGASVEKGVEKLAIDGESKPATGS

SEQ ID NO: 1175 - protein, 447 aa, Unknown
  Kingdom: Fungi, Phylum: Ascomycota
MAILKGPVGNSVEAPNQYSQPSRKGKKAWRKNVDVTDVQKGLEDLNEEIIRGGVIKEKDSADLFTIDVKGDSQISKRHPKHASKKGLKADEIIAARSAVPAVSMRKRPGDGKISEGLVPSKRVKKDWVTHKELSRLKRVADGQHDNTIEVRDATYDVWGAAPEPTPVEAVVASTKPVVKAPKTIKQKPISLLANGKQVAAVPKPTGGYSYNPDFHEYEARLNAESEKALEAERKRLAAEEAERQRQEAAARSAAEAEAAEARAELSEWEEDSEWEGFASGVEDDERPEIKAPKRKTPAQRNRAKRRKEEEALAKHRAAMKERRAQEQRIKEIAEEVAQREANKQLALASTANDDADEEIDDIEADDVSNLRRRQIGKYKLPDRDLELVLPDELQESLRLLKPEGNLLKDRYRSMLVRGKVESRRHIPFKKQAKKQITEKWTHKDFVL

SEQ ID NO: 1176 - protein, 231 aa, Unknown
  Kingdom: Fungi, Phylum: Ascomycota
MVSDALEAKNEAKDVPVTEPIPTEPPQGAKPATCGVCNTNPPKYKCPRCYMPYCSVVCNKKHRENHPPDPDPVALPAPAVVPASQAPTDTQSSTEHDPDNPFRLLEQSDKLKVLFLKYPSLPEQLRRIHEATLPPKSSPGSKPGIPESLMQGVSKKETWNHDMGIKNGKAALRRAISADGEEGEGVREYYELVLHMMNEASDREKASQFVQQQLAQEDTKLIERLLAQEKR

SEQ ID NO: 1177 - protein, 555 aa, Unknown
  Kingdom: Fungi, Phylum: Ascomycota
MPWRTSDPKTRSGRAPSSVLEPGRVHVVGEKLCDDVLAYMGESLDRHNGCDLIDLNPGSGLWSRKLHERLQPRKHVLMEGDAELYAPLLSDLTSKDNVELIPKSGIVWKDLHEMLEKCLGHQQPQHSAEPPQRNDTLLVTANLATNPARRLFGFESVSLMVLHQFVTSIHFSSLFQRYGRVRMLIWINDEDKRRMVPQSLSRRRRFAFQTELACEWLHLVVGMDNAHMDSRYLRDEWINVESAYATLQRMQSQGLAMPPGREPQHHLDALANPELLGVRLAGARPPHLRRPFKDELEDIRAGTEIDSELSPENVKQGRRRELFLLSRERAEMQHAGIYHSLLQERDRLFEQATSMPKDEFDAASKAWLDSVSGLKKNAYNEWAIIRDNYHLFRQPDPVMLWDRRAFEPLVPKASEFFPNAPCALIDLQPKAMNPLFLQHGPNSTRSGDMSDLMLRAWFSHTSHAIPYAMQALWPGFADSFEQCPSFRDPALGGSPIGGHGAQTVRTMNEAQWTELVQAWMDWPFRPDYKLFLGRTLDEPDGQEDDDSGATGAFEG

SEQ ID NO: 1178 - protein, 477 aa, Unknown
  Kingdom: Fungi, Phylum: Ascomycota
MADNGAAANTAQMPPPQANAGAPGFEAGKNGQGAAPNQPPPLQIPTNTNPIPTSVTSPLSGVDGGILSPTSAARRAAPEPNKRALYVGGLDQRVTEDVLRQIFETTGHVQSVKIIPDKNAKGFNYGFVEYDDPGAAERAMQTLNGRRVHQSEIRVNWAYQSNTSSKEDTSSHFHIFVGDLSNEVNDEILTQAFSAFGSVSEARVMWDMKTGRSRGYGFVAFRDRPDAEKALSSMDGEWLGSRAIRCNWANQKGQPSIAQQQAMQAMGMTPTTPFGHHQFPANGMASYDTIVAQTPSWQTTCYVGNLTPYTAPTDVVPLFQNFGFVVESRFQSDRGFAFIKMDTHENAAMAICQMNGYNVNGRPLKCSWGKDKQAGFDPSQPFSPASAQTPGAFPGTPTFYPQYGGQYGGQPGNFGSPQGNTPTGYGGSPMGYGGAPQSAGGYGRGQQGPNQQQWQQQQPQGQGQNYGNNSGFGGYQS

SEQ ID NO: 1179 - protein, 735 aa, Unknown
  Kingdom: Fungi, Phylum: Ascomycota
MVPSSHDDENPFRGEPRSSTSHSRRNSIASRSSDASSLEEIPVADGFRHNPRELDDASSSSTMAPSTGTGSFGQSGTETPSDRSATFRNRPSSVSKPHRPHESLSLRHEHSTSGHAQPSLPRASIASSEGPVIRPDSPYRGPTGPSHPYQMYPQRTLSNATTETTAPLPHGSSSEAQQQGPTHPYALYTQSTTEVEETPALSIPVGFTHLPDNYRRQLGPEGEEAGALVGPLGHTEELPPYTRYPEIAYMRKGSIPDTDSISAPSSSTLGVPTIADGAGGIGRATRDPEFSSTEEDLALSRSRPSIRSQRSQASRHDINTAALEINEKSSRQQKWEQRAKRKLWGIVPYWAICLVMVGMVLMGVIMGAVIGTVLKKSDDQTRKAIAESEAPSPKTPVGEVVPYTTLPTDLDPIAIGFYGLPPLDKDEAPRKCFNNSLEFNAWSCDINYGSYSIDITEIKNASKLAMFDLELKAIDQDTAKFLWGTQPPTVPNPIPLRLVNDTFDMGRGPAWWLNVTYNKTVIVPENNFPLPERRKKRTFDDYDLNFDDQLRRLGKNPSRGAQEGDKPWICTWPDTTLEIFIYPNVNASLAVPDDDNDDKTPSPTALEWDDPYPTPLDPKNGKKSDTDRKPDKAYPKVVKFLERRLSGDPESTAICRQVVVIDGGKAWIPLYDDDNDPIEVEIIETASAWEEQIVANQKRDVIRQWYGSTGTGLDKRLFRRDAQELTSCGCLWWST

SEQ ID NO: 1180 - protein, 922 aa, Unknown
  Kingdom: Fungi, Phylum: Ascomycota
MNGLAKKADINQIGTGEYTTGFVDGAASASDKKVGVVGLTLFDLRRRGKVNNLSMVGVNGTKFPAIREHLNKNITQVYNGLDTSFDSFPANDKKDPDAYKVAIDQLKPGDAITIFTPDPTHYPIAVYAIERGIHVLLTKPAVKLLEHHQDLMTKASQKGVYVYVEHHKRFDPAYADARFRAQKLGDFNYWYSYMSQPKYQLDTFKSWAGKESDISYYLNSHHIDICDSMVTDRGYVPVKVSGTASKGVATDRGCHEDTEDTISLLVTWERKDQPGKRGIGVYTSSWTAPTRAGVHTNQYFHYMGAEGEIRVDQAHRGYEYADDNAGQLQWLNPFYMRYAPDEDGNFNGQTGYGYISIEKFIDGCRAVNEGKMKPADLDAKPLPTLKNTIATTAILEAGRRSIDEGREVGIVVENGVWKLVHHYKSQGPDTTSKYHSFYNSTARLLIPMPDPSYSSIIFPLASQPSPLSSLKRSSLTIHNRLTSIATDAAFVATAAQSKRLKGRPLVANERCGSWYVPPEEKGGSAYFKSTDGHERAWKFSTRRLNLHLLKMIEEHDGIIIVDSTRRGKRMPDALSTTIPIWCTVLNLTLLPSHPLSSKLHLPPSAMPTTHAQISALIPGFVASLKNLNLPLEKYHISKPLRPFWVTRDSNLEDTDEENPEPSTGDKVVIFEEYRPVICCTASRRVVGSEMDEGRYIQGAGDDTENWAHGLTPPVFWAHSAELLSAAETELPDLIARLVKAHSEHEKAREHEWMEIVRGIAVQQLPLVAEEEMGQELLICQIALTSSNTPRDSWIKSERTMEVGLGRSKAASRNLRTALPDICAFVTSCLGKHQVDSATPQQLHGTIVLACDSGKDISIGAALGLWCWLLDEDGTRRPGNGEGVHFTKDMIKARLGVIMTKFPHVNPNRATLQSVNSFLMDWR

SEQ ID NO: 1181 - protein, 510 aa, Unknown
  Kingdom: Fungi, Phylum: Ascomycota
MAATSPVEDPQVLIAIQLNTLHLNTQFSGGGEPQQASVETEEYVSQDRPDLHNRVKAEAEAEIKQEDLSEEETSKRSRTSTPRSSVEDEDMMMNPEMLERQARFRAQLEEDDLIVIDEANLEEARAQLKRQMEAERQRFSGASHWAPAEERLFELLFMREHLALMPRHWGYDFQGVPFQDHVFSTSLQNPPIIYAHSRKTEFLATKGMMNLIDLSSKVRTLLQSGLTYKAPGTIEKTLNAFLAWAAADGGYHKLEIIPNLIAEVVEADADHVTVIKSRMDALAQLHRDFLRADRNNHGWQGVKTEVHDQGFLMAGSPSSSARLKTKRCVHTHGNPLNDMDEADLSFSRMSLGEASPRQRAALAAGVSPSSATSKAAGQKRKRSQDDETATTERPKKMRNTPDKTLHRSRRISPRTPLRSKQQNGFTRQPPVVWGLFIINTSVFLCSLDAAKAEQDAYVSWHAEIAFTQTRQCVWHALTIALVVCLARDEMMTRLEDFEHLPEEVEEDPDL

SEQ ID NO: 1182 - protein, 503 aa, Unknown
  Kingdom: Fungi, Phylum: Ascomycota
MPAASVGTEGFGQGLVHHQKLTKSRNRTVVKPILKKFHSAGSDNNSLDLDRGWDEQSINYHDQPADDISPGRLSARDVTFSSSASHTASGNTLADTSSRRRHGLADKYTHARSTSGASHASIATSGSGRTGTFVHPFQQTPRTSEPPLSQSYSNTSHSRPSLDLNYGLGLRDLDHSSTITEDQDDALNYPFTSVTAAPTAITPTTSTPGGTISNNSADERLVKNGKLQNERHNKSSSYGRTVRSLAGQRTNSLSDVTSLATAPRSATSNRSHQASTPRIPAVLNHSRPELYSSSFSSGNESSPLSSTVPALYKEPSSNSPHTLATACSSITGGTPVISPLRSSLDMSGFRLRSRSSLDTATRQEQVRQARRKFEEKEKAKEEKYARAETKKRERADTKEAQRQLRKGSVSGLASGRTSSSTDIQPTASRKNTGTTGIIGEKDGDPFGQGYDSVQTGERHQAKAEEVVFTPAPRRSKTAKRKTTGAWTSFVLWLRTRLLKLGRR

SEQ ID NO: 1183 - protein, 378 aa, Unknown
  Kingdom: Fungi, Phylum: Ascomycota
MRYTVPLIAALAATASATAPEDVKRENTKLFTLEIAPGETVEVTEDEKFRMIDDHVHFFDVTGWKDHEPATARLMSVADSPYPSSVSHRSAVEAMVDKVDMSKVKKQLQCFSSFHNRYFNSRFGVEAAEWLHEEIKKTIDRSGHPFASIRLIQHQAWSQPSIIVSIPGKVRLKTIVTGAHLDSVISNDRGAGRAPGADDNGSGSIMLMNILGSLLEDPRIAKGDHLNTIEFHWYSAEETGLLGSQDIFNTYARLGIQVEAMLNQDMVGYAGRDGIERFGLVTDFTDAAQNEFVKLLVDEYADIPYEESTCGYACSDHSSATRNGFPSTFLFETPFGNHNPYIHTPNDTMEHLDFDHILQHVKVTSGFLYELAHNDFTT

SEQ ID NO: 1184 - protein, 598 aa, Unknown
  Kingdom: Fungi, Phylum: Ascomycota
MPRITRSQDEENSTMVIGIDFGTTYSGVAFAHTSRPKHIQVVSNWTDGRNTNKGKCPTLLTYCGGQVASWGYGAAQDCRAIKWFKLLLLEQADVPLDLRASDELQEAYKKMRDLNKRPVELVADFLKQLWALTCEKMVKSASRDLVDNSRFHVVLSVPAIWPDYAKELMLEAARWAGICNDRPTRPASDTILDLISEPEAAALATIMDNFDDKITLDGAAIARAGDCFVVCDAGGGTADLITYKIQSVNPWLIEECVRGDGKLCGAVMLDKGFRTSLQSKLDPERWKSISDSPHVFEVQWEKVIKREYKASTREQTVQLPFTGYPARNIYWKPVVTLTQDDLRGIFNPVTNSIIDLVRKQISSIPVRSNFRGPPAKYVVLVGGLGSSHHLYERLQDGVSAGPRGAEILQSEGDLPWTAICRGAVLHGFNQQNAHGRAARGAPSFGVQSRIARRSYGTICTYEEWNPKEHSMADRRYCPVEDCWVADYQMSWFVRAGEPIREGEIKLGSFDLTLETAEDLEDGIKTELVYSDSPRPPRRCDETVKKHCEIHWDRVPSFASLPERLTDLGREHDEEKVASKNVIVKFEGSGSAARQLLAE

SEQ ID NO: 1185 - protein, 791 aa, Unknown
  Kingdom: Fungi, Phylum: Ascomycota
MSAGKGIAEFPDVEAKLQKPTKQSAFEKQRAEAAAKREREAAETAAVLKDFVESFDDDDSSGAGGFGNNTRRDQFPPPPQRGRFGGAPPGPSRRHFGASGLKSGPGSLGPPPSSFGKKRSFQDFAKASGSRDARPTTLLGFDREESDRKAQDRVGRAFRTSDDEDEHMTDGDARAEEKLVAKPTLRLLNLPPGTSPLMIKALMPSNLTVEGVKMLPPASGPSGKERKAATAIVTLSQETPANDMDAAVSALQHRYLGFGYYLSLHRHLSSTALAATTAATLSSSASELHPFGAKPVETSQGSQRSQHQQGFHRGFAPPTSYDRAAGGVDRSSLLHVPVKPPQDVKTVQLISKVIEGILAHGPEFEALLMSRPEVQREEKWAWLWDARSEGGIWLRWRLWEVVTGGQQKSKGKYVPIFDGSYAWKMPEKRLPFEYTTDLHEFVSDSEYNSSDDEDYEADGQHQGNGDDEKTFLNPLEKAKLTHLLARLPRTISRLRKGDIARVTAFAIMHASRGADEVVDMVVRNVSQPLSLTAANPERKQQDDPAAKGEDREAAADDAGAASLVGLYVVSDILSASSASNVRHAWRFRQLFDAALRESKLFETLGSMSERRGWGRLRAEKWKRSVGLVLSLWDGWCVFPAESQETFTKEFENPPVSTTPEVKADKVDEGERAPLPVSLVVDEEEKMDEDDVEGEPLDEEDIEGEPIDDDDIAGEPIDEEDIEGSPIGEDDVMGEPVVEEDMTRDEPATVLEQGSRSPPPRDGTGAGDGMTGPRRKRMRAVDMFADSDGEGS

SEQ ID NO: 1186 - protein, 821 aa, Unknown
  Kingdom: Fungi, Phylum: Ascomycota
MEQIDAQVSDLRYLSQAPVALSAHEVPGSSGPVPAYGSHSLAGATPPTILSPGSASIGDNSAHPGTSAQGSAVGTPLGGTNNKRKDTDDANATGKQARSKRNRLSIFFTTTLFSDAASTHLFAPLPNAADPANTSVNECSNECKRRKIKCNGETPCQRCGNLNLNCLYAPNCCSNNFKDSEEYKHLTSQLQRLQDEVGYLNQTVRAIQADPARTGNVHDRAVVAGSSTVTPSPSQTSSSLQRNTDQPPGRRAPFHGPTSAAFSLDVANNTIANMGYKPAHEGIDEPNPPTQPIELSAAVPTGSRDPLLDYDKDEIIRLCRVHEAEVGIMFPVLETAAVISHARSLFSFFESLKGERQLHAINDEKTLQLKMLMCIAHVVEENGHSQKAMRLYESMENVLNRKLMADESDIASLPLLALLGGYRFLSNDEILGWRVIGQVVRLCMELGIHQRMGVMKIENEQERRDALTTFWTAYILDRRWAFGTGLPYVVQDEEIDPQLPMPDEYPFMIAMITYSRLAAKVWRQVSHFEPVLARELREEEMERLDQEIKEWYDSVPEEVKVRNWDKERHMASTPSYNLQRLRIWTYLRFNQIRTWLYTPVLHSATSIMAHSAQAQRVVDLAKDTIRYLTHLNKTTTLYQTMQVFYHQFLTSAISVVFLASVHAPVRFSAVCREEFYLSLDLAKDLSSRSMVSKRLWSTIKKLKDVAPRFGLNPDDDPHSTAALGMIGLARGHVTQDQDPSTPYQRSLVPSAHATSEGMVDQNGSRIQSEMSRIFEGYVSLNGFQHEHDAGTDGQGGIPSANNRGGMYGTDDTVYPHLRAMF

SEQ ID NO: 1187 - protein, 626 aa, Unknown
  Kingdom: Fungi, Phylum: Ascomycota
MSVPKPQPPSHFASPIADITDQMTRSPLLLSLAAGLVLSLDSAAPVCDSAQKPRWGYDEAQNLVCYEHVRVITIQVGSPCDQQTDCGKCSEDVRVLLAEIDCQGCVTAIEPYTGPSTLTAPITTTLFPPAGSGDRPTVIIYTPTTDGLDAAPTEYIPYTDTPPITAPLTTTVRPGGTGPPTVVIQTPDVSNLGDYVTITVPYTGTPPITRPITRTIPPTDDEAGTVIIETPPAVLPDGTSLLPTDVGPNVPDFTGAGGDEEDPEESTSQVDSEQTSEETSVQTIEQTSVQTPNETSEQTPEQTSVQTSVQTPDETPEETPEPTPEKTPEPTPEPTPEETPEETPEVTPESTPEPTPDPTPEPTEPTPELTPEPTPESTRTGSPAGPTFDCDEGGYLIQRRTLYRLDLATGVNAAINTRVGPGGNINAMGFNILDGYLYAFVSIGNGEQQLIRIGGDGTYDLLPLIVDNGLNVGDVDDQGQMWASDAGRRWIQVDLNPDSSNFGAQVDQGVSERGNVADWVYLENGGDYLYSIRLGSTAEAQRWSRSSHEWETLRDFTSTIEGHSGFGALYAVEDELWGSDNQSGDIVAFPVLSEDEDDDARKISDGPATSSNDGARCFRAPAPGLA

SEQ ID NO: 1188 - protein, 316 aa, Unknown
  Kingdom: Fungi, Phylum: Ascomycota
MGQSQTAGSAKSAQHFVSGLGSGVASAVLLQPLDLLKTRVQQSRHSSLATTLNDLRSSPHVFRSLWRGTVPSALRTGFGSALYFTSLNAIRQNVRQLAYFKQRVQDQAGSSDLPSLTKSANLVSGAAARTFAGFVLMPLTVIKVRFESNLYSYSSLAAAAKDIVRHDGFRGLFSGFGATAIRDAPYAGTYVLLYESLKSEFGSWVTNRAYETALPTKMGASLAGTVNFSSAILAGAACSALSNPFDAVKTRIQLEPRKYRNTWHAFRKIVVEDGMRSLWDGLALRISRKALSSALAWTVYEDLIRRMSKPHQQVQL

SEQ ID NO: 1189 - protein, 486 aa, Unknown
  Kingdom: Fungi, Phylum: Ascomycota
MWTKSVFTQSIWLLVSCQWASAATVDWTSITTSRGDQLPDFSFCGYHSSDKEIPSTDSTPIVTVKSSSGDQTAEIQQALDLAAASGGGVVRLAKGTLHVSSGLVIPSNVVLQGAGIASTYLAVDGLKVGIPVLSLGNGTASRFNPERSTAITDEYVGIGAKTVTVQNAEGIKAGQSVFVSRAVTAAWVRDNGMADLVRDDEPQTWIREGVLVQQPRVVEKVSGKKVTFKVPLTDALDSKYMSPYLAVYSSPPKSYEIGVEDLSITRKPSCSGLKLNASSPCAVAALSVAPWTVDSWVRGVNITGFNSFLEIQSNSSRITIEKLSLFRDADTDNAAGYPADISIQGSQVLIRESGQYGLSTAKAFAVVTQSGTPGPNAVLRHETQANIQQLYPHQRWAHGFLVDDTDASASFINRGTSGSGHGWSINAGVTWNVRGDVQIQSPPLGVNWGVGSTGKIVSPTNGTMLGTGSKVTPQSLFEAQLSARKT

SEQ ID NO: 1190 - protein, 439 aa, Unknown
  Kingdom: Fungi, Phylum: Ascomycota
MLVQLGLLSRSIVPAQSFLVVRNMHYYIGGFFALALSHVTMARGCANATEWVTIWGTMPQLTEPANLPPAPFNRTGVVFEDTTIRQTVMMTSAADIIRLEISNAFGGSDLHITTVTLAMSSNQTLGISGVKPNTLQTLTFSGTESFTVPNGALVFSDPIDFPVTAQSIVTISMYLQNGQTTNLITSHPGSRTTSHLVHGNHANDSVFEGSTTTDHWYFISAVEGQVSMGSSAVVLVGDSITDGRGSTTNGANRWPDQFVERLQNNSATRHVAVVNQAAGGNRLLADGLGPNALGRIDRDVISHSGVRRAIIYNGVNDIGVAGTDEASQEIIGSRIIQAYDQMILRLHRHGIAVYGATITPFTGPNQSYGHPNREVTRQKVNKWIRESGKFDAVFDFDEVIRDPDQPDMLLSTYDSGDYLHPNPRGFKAMAESIDLTLFE

SEQ ID NO: 1191 - protein, 899 aa, Unknown
  Kingdom: Fungi, Phylum: Ascomycota
MATPAPPEDQARLLEDALIAVRQQTSVMRKCLETPGKLMDALKCCSTLVSELRTSSLGPKQYYELYMSVFDALRYLSVHLRENHPVNHLADLYELVQYAGNIIPRLYLMVTVGTAYMSIEDAPVKELMKDMMDMSRGVQHPIRGLFLRYYLSGQARDYLPTTEGDGPEGNLGDSINFVLTNFVEMNKLWVRLQHQGHSREREARIRERKELQLLVGSNIVRLSQLVDLETYKTGILGPLLEQVVQCRDVLAQEYLLEVITQVFPDEFHLHTLDQFLGAVSRLNPHVNVKAIVIGLMDRLSEYAERENSAEAESDRETAESEALAKLLEKVKLAKENPPEPKPAAGADAEASAETERDTSEETNGDEATDSTKADSADAGEDVVAASGDDSSTLADNTAPSTAETDTTAVNGQDGAGVPNVQLYEVFYAQVKNLVEAQRLPIQDIIALLVSLTNLALNIYPDRLDYVDQILAYATTKTREHINNADLHSPLAQQSLLALLQAPLNRYVSIFTALSLPTYVPLFQAQSYPTRRAVAGGVARSLLKNQTRITRTDQLENVLEVLKVLVKEGNQAPQGYPGAQRRAAETDETMEEQGWLARIVHLLQGEDNDTQFKLLQMTRKVYSEGNERIRTTTPPLVTASLKLARRFKAREHLDDNWETQSNALYKFVHSMLSTMYARVNSPGSAELALRLFCSAGQIADLAGFEEVAYEFFAQSFTVYEEAISDSKAQFQAVCVIATALHQTRNFGKENYDTLITKCAQHGSKLLRKPDQCRAVYLASHLWWATPVAANGETEETELYRDGKRVLECLQRALRVADSCMETATSIELFVEILDRYVYYFDQQNEAVTTKYLNGLIELIHSNLAGNQQESASVESSRKHFQQTLDNIRSRQYEGVVLDPN

SEQ ID NO: 1192 - protein, 800 aa, Unknown
  Kingdom: Fungi, Phylum: Ascomycota
MTHALRNQPGPSSSRQQSSEQNATSGNADHHVDASPPSASSARSLQQPLLRRLNGRPQACDACRYRKVSCDHAHPMCRRCQKRNEQCVYTISEQTASASTPRRRRRPGSKSGSTPRQPATAPERVRRRDRLSTSSADELTTASPAGAVPPSAASQHTGINVRPSLSSPPERPTPRTRNHIPLSEGYLGFTSYSNVFDEARNTLSLLNSGYPEGPQSNEATRTSKNNPTPASASSSIHQTSAAATDPLPPATRDVCLHVLRSIPDPSYPALGTPRKPAQLWSRLAVERIMATLKRKYGSDLGPTRRDAKLERIAREICANSSKPFDSDLADPTAFLNQFAGDDLRWESLGLLFTFREYSPDVNGSGASAAPPPRGWDKRVSHQLWSESARQCLRLCLVLAKTFSDGNSIIMFLCIRQMVVDSLVYGDASLDCWLSHGAAVAIATFLGLHALPDSSVHKPSLASELKRRFFANIFTLDKVASSFHGRPPLLGHRYVTSPSPLDLPDEALIAGGEVLEQAVANLDDDGWSRSGKMESATLPRCRFMLATIKDELMEIALGNAKHAPLAVITEIKQREQRIFDSFPPWCKYHDDDLKDLALSIDVLFSRLLLLLEHLQSCLIAERFIGRHNGPDDGSLLFISFEMVRHVLVLWLHVDRFEGGWEGQRVDFLWMVMTFGAPAGGVLCMELLYPTLPNRPIPYTSPETPRITRSAIIQQLSLLVGFLGWVAPTAPTSEHTANCRRVIQSVLDYTLNGNNVPSGPGQQAMDSMGFLEGLETGDLNFGFDMWGTFDWYRPEEAMPGFA

SEQ ID NO: 1193 - protein, 397 aa, Unknown
  Kingdom: Fungi, Phylum: Ascomycota
MAKTQKTLELGARHAQVVQSALRHWLESEALSESQATLLADTIHIRTFDWEKFAKYTLRLAVVCLVIAVSSVVLEASFMRLLRRIVALPAAVRGGVTGLVAVGIHVLAYRRSQTWPEQKYANEGFHAVGALFFALAALQVIEQLNDWHTSKAQRDGTDTVQPKAEVEEDQAVRERRKQEEKERRRIMGNAIWAVVFGLAVVYATVALLSKSNLIWTCAIMVFSSCIGGSGGYFGGGYWIDMESPFLFIGFGSFLVAIARAMQSYTLTEPLWSTTRTWGLLYLFVSLWILSIWGYDDYFEKVSDSSSSSSRRLRMFFWSVVFFVAAGFSTWHGLRFDDSTTKGFGLTFLGINLYTKYFEYFWGWSKPIFFAILAASFAAVGKYAENVWNMRVEELRLN

SEQ ID NO: 1194 - protein, 272 aa, Unknown
  Kingdom: Fungi, Phylum: Ascomycota
MFFQSTRYDELNRLDLFHKFLTVAREGKLYRYALNTLGRVPKVLDLGTGTGIWAITVAEELPEGGVDVMAVDINQIQPELIPRGMTTIKFDIEEPTWDPLYRDCDLVHMRMLYGSIQTDLWPDMYRKAFDHLAPGSGYVEHVEMDWRPNWDDTEMPDNSSLKVWTDFFITGMEKFGRSVKVEPEETRHLMEQAGFVDFRQEVIKIYYNPWSTERQEREIGRWFNLGFCLALEAMSLLPMTEQLNETPERIRKLCSEVKKEICTLRWHPYCKL

SEQ ID NO: 1195 - protein, 100 aa, Unknown
  Kingdom: Fungi, Phylum: Ascomycota
MNSGERSVGNITTPNPQPRTQPLNSAKMTAAWKAAGLTYNRYLAIAARAVRRSLKEDKRIAAERRGEMELRFAKWQGGKQGEIKDLASANTAAMAESASS

SEQ ID NO: 1196 - protein, 271 aa, Unknown
  Kingdom: Fungi, Phylum: Ascomycota
MSADETNSRPVLDHLVILVSETTLATLPDRLRDSFVVVTGGEHTGGQTFNKLVFFQDGSYVELIAFYDRVSPEDRKSHRWGSAKENTIVDWAFTLPDEANFVHVQKRVVEADGGITYDDPWNMGRKRPDGVELKWSIGAPRQADGNPPPPGTVPFWCLDQTPRNLRVPYEDNPQTKHPAGILGIAEVQISVPADKYEGVKKVYAGILDGKNHATSDNSWEAAVPTVLDSGAPVIRVETSSGERELSVTLAGSAGSPSEIEVLPGLIFTVRS

SEQ ID NO: 1197 - protein, 822 aa, Unknown
  Kingdom: Fungi, Phylum: Ascomycota
MQRVSAFLPSWEKRNSSASGGASSTTSVNGGATAGGGLFGWPNRSSSRNSTTSNGGTNGGTTSSHRPARLSIASVNSNARVQREAFWPATLDEECDKAARILKSFCGDGYLAPLSTESASPSPTGEDPKTPTKIMMKIPRRIIQNAAGIAVFTCMRSGLWMTGSGGSGILIARKSDGTWSPPSGIMLHTPTLSFVIGVDIYDCILVVSDLAALEAIIRPRVTLGEDVGLASGQSVAFDSEDSDFKWMDPGATVLTYLKARGQHQHVNLTGCILTERANENERFYGSEVSQMDILAGNVGRYVEETKPLFEVIKMAEGRTDYDPAIVNRISATSAPGDALIASPKSKSASSGVSFGVPDAHDPDPFGVLALEMAGLEIREAGSRVRPASSQLNFNSGISSPTTSKFPRQSMDTFLSRSNRGSFMSTHTVKSQVTDAGTQTAEHTPETTPSPAQGEGSPASRSAEQADRIPEVKEEDEDVDYTTVDMSVLKHISSPPSMNSATGLDFDKTRLQPKKDDDDDADKASKASSVYEQDSDSDDLNDTDEEDFSDEEEPVVFEVAAVQPARTQQVASRVMQAKGSMVTIPKRLPPPLPARNPGRRSRLGNNDMGGEVSGLRSPLRQEFGDDANEDPKATEDVSQKDGIRLDVPSDSSSARKADEDLETPRAKESNHELDDKPAIDVSQAEGSAGERKAVEEKAHFAKSDTPLDETVEAISDNKAIQADDNRSEINGDEEPSVAHSRTSTDTTGSVSGVKHSSSIFTGPIEGRGSIDGSSITTPTSERPFSVIEEATADDTPRKAARADDKLDGDELVAARIPLPLEAD

SEQ ID NO: 1198 - protein, 635 aa, Unknown
  Kingdom: Fungi, Phylum: Ascomycota
MPAKRKRSTIESPTARPDAPRRSSRRIKEEPNRDSPSPYAFKDREAEARKKRTVWDTKEGVEKAVRQLTQMEEELQSAVRRQQLAVESSDLGLTEQDPADRPFQPGFIKAEKGTVNEIPADVPDELEKAPVNGYEAELAVGDVAEAKLEDDKVDRGAKRPPAVNSELLPLPWKGRLGYACLNTYLRTSSPPVFSSRTCRMASIIEHRHPLQDPSQPEHATKNRPDKNQPADIERGMKYVQELGLANARDIVKMIKWNDKYGIKFMRLSSEMFPFASHQEHGYKLAPFASEALAEAGKVAGELGHRLTTHPGQFTQIGSPRKEVVEAAIRDLEYHDEMLSLLKLPEQANRDAVMILHMGGVYGDKAATLDRFRENYKKLPQGVKNRLVLENDDVAWSVHDLLPICEELNIPMVLDFHHHNIIFDESIREGTQDVLGLFDRIRHTWTRKGIRQKMHYSEQTAGAVTPRERRKHSARVKTLPPCGVDMDLMIEAKDKEQAVFELMRTFRLPGWNLINDVVPYERDDESRKAVMKKKSAKKAKKAKVNAPGCKDSPNGTDLPDKTHDENDNIEVPEKIVEPEDFGMGGPENRVYWPEGMEEWLKPRKREISKKAPGTPTPSKVKKVAAKSGDEDFDEED

SEQ ID NO: 1199 - protein, 427 aa, Unknown
  Kingdom: Fungi, Phylum: Ascomycota
MGKQYPYRPVSTYSEERLAHKRHWDRIRQRECRSKKRKLTGELEEELLHLKERFDALEKERNELAATVKRQAEAMQRSEREAQRLRSAVERVCTSMRESQSTLQAALGHHGAPFSVLSPAGSTQHSDAASSTLAEVRASDYASDFDLTLEARAASDIGSLPDLSLTLQSFAHGPIEDALCTPSQVLEDGEDKGATLETTSPSTDAAMPAPWHRIPLNTAPMGNMDHGFLDLERICRHDPAHGVPMAELKAQAFPHISNLLNPEVPSHSLQHPLSSLVIDRMMKQMPLRTTVGRLAAMWVICTLLRWRICRTPETYSAMPDFMRPNEVQLTVPHPIWTDTIVWPEARTRIIRDFDMKRYPEFRHDLNFAISVGWTRPAAEAICQGPTPGEHYLSADYVKHLSDLRNWTLPREIVQKWPVLEGAVNVRD

SEQ ID NO: 1200 - protein, 590 aa, Unknown
  Kingdom: Fungi, Phylum: Ascomycota
METTPDLAPVSAEQGNEKPLDGSKGPGSVHVEDGNVTIQTLLNNEVLLARYAEEAAKGEYALGVWTSIKLYYPAIGWALLCATCVIMEGYDTILIGNFFAYPAFAKKYGSLVDDRGNPQASSFRWFAQRLRTDEDGVQLTAAWQSGLNNSHGVGAFFGVLINGWLVQRFGQKKTLIYALVCLSGFIFIVFFAPSTAVLLVGWFLCGLPWGVFASSAPAYASEVLPLRLRIYLTSYTNMCFIIGQLIAAGVLSGLVDLENQWSYRIPMALQWTWPCFLVPACVFMPESPWHLVRKGRYEEAEKVVGRLISKKTQDTPEGRAIDTRRALALIIHTNKAEQELAIGTSYKDCFKGPELRRTEIACMCFAGQVLSGSQFAYNSTYFFQQIKLSASTSYKLNVGGTGMALFAALVQWFCLAPYIGRRTNYLGGMLGMAIILFIIGFLQIRGGPDSISMAQAVLTLLWTFAFQLSAGQLGWALPAEVSSSRLRQKTICLARNAYYLVILVANAIQPYAMNPFEWNLAGYAGFIWGSTSICVFVWGYFRLPETKDRSFEELDVMFAQRLPARHFKKYKPEVFVEAHTGKLDVKGDEA

SEQ ID NO: 1201 - protein, 627 aa, Unknown
  Kingdom: Fungi, Phylum: Ascomycota
MASHHRTNHQRGPIRIGNASGAIGDGIDQVYRLASSGAVDAITADYLAEFNIAWKAIELQTQPDLGYEPNFLEQLAWDNGAGARAVADNRIKVVHDGGALNPRGLAEKTDQYFQSLGIRNVKVAWVEGDNVTEQIKSGRLGNVRHLDYVNTTFSAKEGQLLAANVYTGQRGIIKALEQGADIVICGRCCDASPVMALCSWWHGWVPTDYDRLAGSLMAGHLTECGAYVTGGNYCGAREIPNLHHCGYPIAEVAADGTSIITKPPGTNGAVTVDTCKAQLLYEIQGPRYLNPDVSAQIDQAKLQQVGKDRVRLTGIVGLPAPETAKVAICLLGGYQAEISGYAAGLDTDFKFDLMRSQVMGQINQDDFTTFNIDKYGSAPADPKSQKECTVHFRFFAQSPRLEAFTQFKRAIFYNGMQGYCGLHLGMDWRTMVPKPYVRYFPALVQQSMLPELTVHFVTGETFTARPHVATSTDVVPKEPQTLEPAPTVSVRSFGKTVKRPLGDLCFARSGDKGGNANVGFWVRDAAAYPWALSFLTPSKLMELLGDDWNARYSIERCEFPQLNAVHFLIRGFLQEGVSSSSILDGFGKSIGEFLRARVVDLPVAFVELEDRRRAEALRAVEAVQAKL

SEQ ID NO: 1202 - protein, 471 aa, Unknown
  Kingdom: Fungi, Phylum: Ascomycota
  misc_feature (236)..(236): Xaa can be any naturally occurring amino acid
MPFPFTLPTTSAFAFSSCVDCDSHPSLPLNASTHRGVVRDTLKKHKRLPPSSQISNLSTVSAAINDYVPYMLAVDAGLSDRDLPSGEILSAVLKSSPLIEWRPTLSGDLVPGRERNRVKITSFEHEIVFVLSSLGFCQFLTARATLQPLYTTTGEFLSTQQRTTAITGATKSLLDAASIYDYLAHRGEQVSGPAPCADVSAATMRALASLAHAEATLLAVLKDDPYPAIVAQDRNXERQRLDVQSAGYSEASEHAAKAASLCHSGGSSGTKIDSGFAKYLDDLRRTSRAKACRFFGIDAELGGQTAEGIAWLRAGLKEMGVEVKEQKKGLSLSKFKKEFVEKREDRKVDKEAAWGADAGRMEETRILEMLDAKWNKINDTMNTQAIPPINSLLTKMPSGREIHTIPQYQPPSLDKDVLDSMRGPPEERDDYGDMSSDEDVTAHSSATYVGAFPGATDDYSRAPSTAGKAYY

SEQ ID NO: 1203 - protein, 754 aa, Unknown
  Kingdom: Fungi, Phylum: Ascomycota
MASQSSDDVEAFSHRPAFRVRSEFGGARQWRSRKSRPCDACRRRKTACIIETSPPCQSSFFVSLMPLGPVLSCPHLFLALSTVRSRLTALPPRIGRFCESRGIPCEASQRSPPARKRPGRPEVALSPESLVARDGVDAGPSTVTGSAASFTSHSMPGPALTAEVPHRGRHSQSTSEGYGPDAAAVLPSPQTNPSDHGSEFSEKPVASAPPPEAYRPDPAHGSRDPSVLTLEDGERRHAHCIGLAGEQDTDLLASFRSVIVNETNKVDAGVVQVFAGNPLQGEPPVHFNIVMDDFIPHDNLAKGMASDSIEALAGRHGPRLVSLYFQHVHPANCIVSKARFLRAYARDKLSIPASLRGVVYALGATFWHHDPSSHHGVLALDLRTLLEQAHYALHREYHAPNLWNLQASLLLVHERPGHTYTMETPRTWVLSSSAVASAQMVGLHREPQLWSIAPWEKSLRRRLWYAAYMTDVWSSVCHGNPPHIHRSSFTTAPPQIDELSIDEDVEDHLKYLVDPSSFSPNITASARFVEAIKLTHILHDLLDFSYSDKSYKESSSDHTARETRLLHIQRALETWLSLLPSCLGRTNIISAPGSSNIASLHLAYFAVKTLLYRSLMWPVSMAAKRDPSSALRRYFDRAVADFQIFADFVESINSRCLHGFWGAHARSHLVLSGNFLVYLFLTAPTPDEVQSTFRLLESVHTSLKRLRGIASNEDAVALLRPVVLRMDTLFTQASRIMSSGSTDLREITLSGVQI

SEQ ID NO: 1204 - protein, 595 aa, Unknown
  Kingdom: Fungi, Phylum: Ascomycota
MSFPNDQGSQLSEKNHNEHAEHVHPVMPHEQPFDDENTFEVEEEELPKGYFTSPFFVGSMTGICLGLVAGVAGFGYIAPILPLINADIGPSGNIVWVALTYTLTSAVCLTIIGRVTDIFGRRWIFVGGAFLGIIGSIICAVATSVNMLIGGMTVIGVAASTQLSYYYVMGELVPMRYRLAGNAVCYSLLIPLSGFAPVVSWSFVQNHPAVSWRGCFYVLIGINTASFLCWLLFYFPPTFQMKHGENASLMRYIKNFDYVGTILYTGSLMVLMLGLNWGGGMYPWKSGYVIGSIVSGFVGLVVFVLWELFAKLKEPLVPMHLFKNGSWVAATILSGLGASVYYALAIVWPSMVAVLYNEGGVMTNAWYSSFVGLWITVGQVLGGFVAKRLGHIKWQIVVTVLISGIFFGCTATSTPDSKARAAAFVAMGTFWIGWAESLAITVVTLTVWDQSKLGSASGLAGSIRFFITSIAATVYNVTLTNRLQETIPDRVPAAIVGAGLPETSIVDFMTALTTGTGFDQVKGVSDRIIAAGVSAYKVANAEAYRTVFFVSIAFSVIALICACCLPDIDKLLSSKVAMTLHKGKKDEKRAMHEGV

SEQ ID NO: 1205 - protein, 389 aa, Unknown
  Kingdom: Fungi, Phylum: Ascomycota
MTSTSYCHRSTRVLDSTSPVDGRPSAAGPTKPSRRDRDSKKQKSTPFDPDDLCRRLQIVLAEEKAYSERKRRSRANIDRTTIKPVSDDDTNRRGREVPLEIAANQATAARSAQVTTARRYVLPSSAAKRRSKDPMLDSSPLQLPEKDASDLYQHVPQVAATQFARTTSSEPTSDRSLVHKLSRKAMKFHMESPNALAGLKDSAAPDEQARTFHRVRSEREKTYSRNQFQHTAAILEASGDVDDRHNREAIYRHTFDTHFHTKHGLSTEGDENAHPRLSMSSTKGYQRGGARESTELPVAYPVLTQDSAEHDEAAVRMEDHRVDWTQSDEKSSALLFPALRKSDWRWTLRGRLSFHRTGKSEKDLLTSEDRAPSPALRSPRSSFFARFKR

SEQ ID NO: 1206 - protein, 258 aa, Unknown
  Kingdom: Fungi, Phylum: Ascomycota
MPDSQQGAAPNGMASSMTAAAKQQLRSLMKQRLSELSPEAVAAQSSRVFASLQSFKPYQDSRRISIYLSMPGAEIQTDPIVRHALDAGKQVFVPYLHRSPLETPDTPARVMDMVHLKSIQDYESLKRDRWGIPSVDPATVHERQRILGGPDVFHSDQSTLDLILVPGVAFDVEESGHVRRLGHGKGFYDFFINRYLARAGDHGLDDTSLQLYGLALTDQLLPESSEVQIPIGQYDRKLHGLLVGDGKVIDTSNIKSIS

SEQ ID NO: 1207 - protein, 533 aa, Unknown
  Kingdom: Fungi, Phylum: Ascomycota
MADFGDYPPNMAPQDALIVRQQAEPDHAVVKYSAEDISRPKAGPANPFKDESSGLKRKNVPTGNATETYISEHTFRSKHRAIEREGGPEREYQSGAELKAEAAKLRAGREGKGDATIAEGEGAYLGPWAKYKRPQFEVVDNEAELGSDEEYEIVEEEEDEDVVESGTVLQAPAQAIARRKEVEELGEETTTFHGSEQYDYQGRTYMHVPQDLDVDLRKEPGSITNYIPKKQIHTWKDHSKAVTALRFFPNSGHLLLSASADTTVKIWDMYHQRELLRTYSGHSKALSDVCFNASGTQFLSASYDRMMKLWDTETGKCISKFTTGKTPHVIKFNPDPEHAHEFLAGMSDKKIVQFDTRAPPKENLVQEYDHHLAAINTIVFVDQNRRFMTTSDDKSLRAWDYNIPVPIKYIAEPDMYPMTRAAAHPSGKYVAYQSSDNQILVYGANDKFRQNRKKSYRGHNNAGLAIELDVSADGQFLASGDSAGYVCFWDWKTCKMYHKLKAGQQAITCVQWHPQETSKVVTAGMEGEIKLWD

SEQ ID NO: 1208 - protein, 723 aa, Unknown
  Kingdom: Fungi, Phylum: Ascomycota
MADSGGRTQTPMHTPNRQTQHRRPRLRLACLRCQRRKIRCDGQLPTCKNCQNAGAACIDGQSARLKDLPRAYIVTLKERISWLESIVQARCPDVDLSDGPRYLEDGTEEGSPVNMSTDTLEDTQTTPLNSGALNQQQITATDLPQEHLRQTGRTANGAVNTNALSHEIGLVSLGTNLDSRYIGPSSGYFLARVMLTSKSRAASPPTRDPNFSIRLVEAAHGSLGLPRKEMTEELCDAFFELVHPQYPVLHRPTFIATLNKLYEQGDQDPVSSFQVYMVLAISCRLKSGLPGESYCMSALKYFDRLNVENSLQGLQCLILLTLFAMHSPSVRLNVWYLNYQCIAAVLDLGLQRDITTRSGISLLEQEMRTRIFWVVFTLDRTIATMMGRPIGLRDEACELRLPEGLDDASLMSTSNAQHSTSDSPYNPIAYSVHLFRLARINSEIKYVANSIVRHAPAYAYPAVINIYEWQRGVLQQLDQWANEIPVGDETQALHMKLICRQRYHSLRMVLLRPSPAIPKPTNEALEQCYHSAQECIRTFDKLYRNNLLVYSWTTFYSLALSTLTLFYCIKTVAKIAQDTDVPTLMSDLSISSSILSATGEHWSGAKRCRDILDDLGRSTVRQLFESSRQPVSPEAQRRRTRSTVVADQRNPSTSLLSDNNTVTPALMDVHPETEGAFEVPLNLFDDFLSTVSFADYLSGNEANVDVMMQSLFDDFGSAESNFG

SEQ ID NO: 1209 - protein, 453 aa, Unknown
  Kingdom: Fungi, Phylum: Ascomycota
MASSSSNVVGVHYRVGKKIGEGSFGVIFEGTNLLNNQNVAIKFEPRKSDAPQLRDEYRTYKILVGCPGIPNVYYFGQEGLHNILVIDLLGPSLEDLFDHCGRRFSIKTVVMVAKQMLSRVQTIHEKNLIYRDIKPDNFLIGRPGTKASNVIHVVDFGMAKQYRDPKTKQHIPYRERKSLSGTARYMSINTHLGREQSRRDDLEALGHVFMYFLRGGLPWQGLKAATNKQKYEKIGEKKQTTVIKDLCEGFPEEFSKYLTYVRNLGFEDTPDYDYLRELFTQALKNSGEIEDGEYDWMKVSKDSGKGWDNKGHSNTYLHNPNSRPGPSQMELHSGHRPGNTTSHQQAQNLTVGRLNAAQPPPPSPIKQMGKQRDRQNAPGALSPHRGSGVGGLRDMTTPTGSTQAQFQNSAQNLSQQRGPQQQAHMSPQAQPNAQPNEAQPSGFQKFMKTLCCG

SEQ ID NO: 1210 - protein, 426 aa, Unknown
  Kingdom: Fungi, Phylum: Ascomycota
MSASGSPVGSPTNGTVNDGQEEEFKDAVAAADSDRDSDLLSEIDENQFEDYDPETANIEDRPVDIDEDAVRTLKASKRKRADGEVPRKPREGRREKKRRDRDDDTAMAGADAETATAPRRQRRTGDGERRARIKPTTPEPENEEHLTPEERRKREIERQLDAAIQKPSTSRRKRKDEEDLENEIDDKLIALNQMMDRACQEDNDAREQGQPALHKLKLLPDVVAMMNRTDVRHAVLDPDTNFLQHVKFFLEPLNDGSLPAYNIQRDIFMGLNKLNVEKDSLLSSGIGKVVLFYTRSKQPEPSIKRMAEKLLGEWSRPILNRTDDYKKRAIETRDYDYQAAKLAQRQKTGSQFSLTQRPAPPSAETERERLLAPKGFNNKARAAGLPSSYTVAPKSTFDGARGTEHRPLGASGMDAFRKMTQKKKKA

SEQ ID NO: 1211 - protein, 382 aa, Unknown
  Kingdom: Fungi, Phylum: Ascomycota
MAHPQQRLVPGQDDRPFQHSTTPADHSALVQSRETGDVIPMEIPKGEVKALPFAKSWVHLMAGAVGGMTAATMTAPLDVLKTRLQSDFYQAQIRAARAAQPTVARNPARAALHHLTETLQILGSVYRNEGGRALFKGLGPNLIGVIPARSINFYVYGNGKRLISEKLNHGREAPWVHLMSGVAAGVATSTATNPIWMVKTRLQLDKNVAEKGGTGATRQYRNSIDCIRQILRDEGVRGMYKGMSASYLGVVESTMQWMLYEQLKVGLAKREMRIQASGREKTWWDRTVDWTGKFCSAGTAKLVAAMIAYPHEVARTRLRQAPMANGQLKYTGLIQCFKLVWAEEGLLGLYGGLTPHLMRTVPSAAIMFGMYEGILRLFNTPS

SEQ ID NO: 1212 - protein, 281 aa, Unknown
  Kingdom: Fungi, Phylum: Ascomycota
MKFTPNSIALLALPFATAIHSPSVNGMKILFQDTFTGSSGSSPDSKTWNIARDVNTNNELQDYTSSNSNIQLSGGQTLQLVPWKTKDGKWTSGRVETKDSWTPKNGKKLRVQAGLRMGPAANKKGMWPAFWMLGDAVRHGTEWPLCGELDIFEQVNGDGIGHGTVHCDLENGGACNEPLGRGASTDIPDGEFHAWSLVVDRTSRDWRSETIEWARDGNVFHKLSGADIGDEGVWSTLAHSPYYILLNVAVGGTWPGNPDKSTDDGYGNMMEVQYVVVYEST

SEQ ID NO: 1213 - protein, 154 aa, Unknown
  Kingdom: Fungi, Phylum: Ascomycota
MGNTPSKSHPSSHTTSSKSRRQRPQYNSDNESSAQLGQASSEHLQALPLAKWDTGTSDEAAAAAAAVVPPSPTVGASNKKDRGSKKAVVKEVYTMRETVDVARASIEAVRGSPAMRSDTPREDRLDEPWGPVNEWHRDRELLGIGSWMDDERKK

SEQ ID NO: 1214 - protein, 381 aa, Unknown
  Kingdom: Fungi, Phylum: Ascomycota
MAVSSTASNLEREDHSRDANFNKALHGKSAQARGGIAAMFSKGADAKKAAVDEYFKHWDNKTAKDETPEQRAARTAEYATLTRHYYNLATDLYEYGWGQSFHFCRYSHGESFYQAIARHEHYLAAQIGIKEGMKVLDVGCGVGGPAREIAKFTGAHITGLNNNDYQIERATHYAEKEELSHQLTYVKGDFMQMSFPDNSFDAVYAIEATCHAPTLEGIYSEIFRVLKPGGVFGVYEWLMTEAYDNDNLRHREIRLGIEQGDGISNMCKVSEGLAAMKAAGFEMLHNEDLADRTDPFPWYWPLSGELRYIQSIYDVFTIVRMTKWGRWAAHNFAGALEALKIAPAGTKKTADSLALAADCLVAGGREKLFTPMYLMVGRKPE

SEQ ID NO: 1215 - protein, 781 aa, Unknown
  Kingdom: Fungi, Phylum: Ascomycota
MADIPDTSPETSFDVRVADYLDDRFQSTLDLDNLDDLLANIETQRTQLQSQLDDAVKELEQARQKAEGGQGSLNARIEDFKKLQDSIDTRVQIAAASDAPSQAIARLQRPMKKVEAVELARKYLVLLRDVDTLRLETKERFAEDPKAALEPYSTLKQLSTNLRSMEAGEGLHLVDHVESVTRSLWNEMKDSLSAELEGILNKHKWPKVDPSLEMDEEWVSAIEKLVDLQVPEIMHAQGAASLLPLDIMAHIFVTEFRFHFLSDKRTSDPQVIGSHCFPWFISLIEKWEDFFRDNLSHLLAAEFYDTPMSANAIYVDPVCAFITAMLPVMREKVSNTVSKAVQSPSCLSSLISQLMSFDETLRTKFGYDGGDAQNGWAGLTTEVLDEHFDAWFQAEKDFAAERFRTIMTAPDAHNIDYNYTTDGRMKPTFAAYNRVRKFKHKIRFLIGIQLDILDEYHDRLRGSLEAYQAATSTLGRTLHGVSKEQMAMLEGTGALETLCKVLGSSDHIVNNLKDWGNEDFFVLLWDELQSRAAKRSSGVGFTGTMSYDDVRGRTSSSVGAEEDGGLFDETISAYGMRRKAAQDLLVRALDGAHSKALRGYVNRVQWTTIGDSALLDDPSSLTISPELDQPLHVIRRNFEFLIKAVSTASYRRIWREALSKIQDQLWHDVLVRQTFSTFGAAQFARDVTAIFALVDRFIPHGSVAMDTLAEGVRLLNLPAEIGSADEGGKEQLTLKEASDRVFTDNDEARAVLEQLQLQALTPANARLILQKRVENSENVGW

SEQ ID NO: 1216 - protein, 1106 aa, Unknown
  Kingdom: Fungi, Phylum: Ascomycota
MPHPVSPPTMVSKDAPPPPSQQDVDAFLDTIFTAKTSAASIDACYGLCELILSTVGASGLTQYGILAELKKAAADKKSGLRRESSQNLLGAIFEKFPPRQPLSEVVLMLQDGGIVPCALDALADKGSVVREAAQYGLDALFNNLSSEALVVGLLPVLVDYVSKKTGKWQGTVGAYILMKKMADKSQMSVGATKEEAADKDVLREAMGARLAGLIPLVENGMHDLKTEVEKQAVQTMTSLTALLSNDDVAPRIPLLIETMHNPNTQSSQKAIHALAHTTFVAIVTSPVLALLTPFLERSLNTPTTAQEVLRQTVVIVENLTKLVHDPIEARTFLPKLMPGVKAVCDRASLPEVRELAERALATMKKAMGDDKDILARTSGDDVAKVLDEHIKKNGGLVGQLDLYKVGRSYICDQVAIDVNYRYVNRIAARVSPYLSGLVQDSEARQKIADAVQEHYIAEDHRKFGVPEKEDDGEVEIVNADFSLAYGGMLLLSHTNMRLLKGHRYGLCGRNGAGKSTLMRAIANGKLEGFPPQDVLRTCYVEHNQGEDADISILEFVSKDPEIAAQGQERIIEVLAEVGFTAGPEGRQSHKVGSLSGGWKMKLALARAMLQRADVLLLDEPTNHLDVANIAWLENYLKTHTDITSLIVSHDSGFLDNVTTDIYHYEPNKKLACYKGNLAAFVKVRPEAKSYYTLSASNVQFKFPPPGILSGVKSQTRAIIRMTNVSYTYPNAPKPSLSDVSCQLSLSSRVAIIGPNGAGKSTLIKLLTGETIPTTGKVEKHPNLRIGYIKQHALEHVEMHLEKTPNQYLQWRYANGDDREVFLKQTRVLSDKDREQMDKWIDLNDGKPAKQIEALVGRQKWKKTFQYEVKWRNMLPKYNTQISRETLTELGFDKLVQEFDDHEASREGLGYRELQPTVISKHFEDLGLDPEIANHNEIGSLSGGQKVKVVIAGAMWNNPHLLVLDEPTNFLDRDSLGGLAVAIRDFKGGVILISHNEEFVGALCSEQWLVNDGRVAQRGNTAVSLDRFEDSSRPGSGVTSTAASSVVSSAVNSGVEDNGDLKFRARKKKKMTKKELKEREVRRRLRHIEWLNSPKGTPHPPDTDDEE

SEQ ID NO: 1217 - protein, 457 aa, Unknown
  Kingdom: Fungi, Phylum: Ascomycota
MSFDKASRDSIDEDAARPPRRSSMAARWFISFAVFSFLFAGLCPSTVRSACGTVSQAVQRPARTVEEQARRILAKSPLIDGHVDFPIAVRAMFGNHIYDQKFKDDFEKGNLRGHVDLKRLRDGQSGGAFWSVFAQCPENFSDFSDENYAPTVQFTLSQIDLMNRLQDLYPKELSQHVDSSNAMKAFKQGKLISPLGVEGLHQIGNKVANLRLYRELGVRYATLTHNCHNKFADAALVEEGAKIAEPLWGGVSPLGQKLVHEMNRIGMIVDLAHVSDDTMRDVLAGKGDWDGSIAPPIYSHSSAYSICPHPRNVKDDILQLVKRRNSVVMVNIAPQFISCRTSKSDPSGLPEYVPEDATLDQVVKHIMHIGELIGYAHVGIGTDFDGIEDVPKGLEDVSKYPDLVAALLKKGVSENDVRGIVGGNVLRVWKEVDRVAAVMQAALAPIMEDDEPKLFEQ

SEQ ID NO: 1218 - protein, 523 aa, Unknown
  Kingdom: Fungi, Phylum: Ascomycota
MAIIEKATGLAFQPFLIETVGLILLIVLARFLWGPLDKREPPALRSRIPIVGHLIGLIRNGPHHLPILGEKGRPISTLPIVQGRLYAVWDPAIVQSLQKSKNLSFFPFLRLFIKKETAYDPRHEDIMQRDPGVLEEGRKVIQTSMTLKHIRAMNLTALDHLAKELEKITADEPLRIDNMWIWFRNTMTSATCEALFGRDNPTDKTDKYPTIMDDVWTFEGGVDRLVMAPWPSLTCRNIIASRNRLQAAMREYYSNKSDEKAGVSELIRGRAAMLRDFGLNDDDIGGYEIMIIHVAITNTIGTGFWFFAYIYTTPGLVEALRDEAEAAVQRSVEDQVTVDIAHIVEKCPLLVACYRESLRLTNQFIGNRQLQADTTVSDSSNRTYLLKKGICIQWPARFLHTSKEVWGDDAMEFKPERFLDMNKDPDSPETKRKLASYIPFGGGKHYCPGRSFAQAENVGVVLTMILGYEVSPLQGDWSSVGIPEKDTPSFASAIYKPAKNGQGWGVKIQRRKGWEYATWKYVT

SEQ ID NO: 1219 - protein, 1123 aa, Unknown
  Kingdom: Fungi, Phylum: Ascomycota
  misc_feature (49)..(54): Xaa can be any naturally occurring amino acid
  misc_feature (240)..(249): Xaa can be any naturally occurring amino acid
MQLLPVPPSAQPPPALISFNNNNNNHRRDPPPSLPPIPVATHNLNSLNXXXXXXKRVYQACIPCRRRKVRCDLGSVDNPHDPPCVRCRRESKECFFSATRRKRKADDGELSDQDEYIIRNGRKRPNHSESRTPPPPTDSRLYSDVPLTPGGSQGRSRPLRRPDDHVGRDSRDGSHGRGHGEGSDHDQGDANQQLENVEAQTVMRRGLYGPHDALDLLYKAATDRSVASEFSKPKTNTQSXXXXXXXXXXLLSSSFGGTAGAESRGQRTRREMHRHASDVGGARPSKQETQQADEPQPIDPELTDQDPSTQPGYNDAIRAWQRFRFVRAGWFTAQEAIQYIDYYYKYLSPMTPISPPTFSDPASHFTLLTEEPILSVTLLTIASRYKQLDGPGGHCRSYAIHEQLWTYLRGMIERCLWGQEAFGSGFCGSGSATMIEEESKTSSTAPWRGMRKGSLRTLGTIESLLILTEWHPRALHFPPQDATDELMLPDFEAPAARGGSEPGEDGAARNNPSGFGGKRIESWLEPAWRSDRMCWMLLSTGMGLAYELGVFDDMEEMIREEGANRPEFLDEAYRARANRIKRLLLIYTTQLAGRLGWTSMAPDELRRHDPAFARRSSGKHHHQQPQTMGSNALHDDATPGTTFSALSMSNAFNYIPDMELDDQIIHCWAGISFAMHMGNEKLFRSRRHTQEIIQSGKYVSLLGDFGPMLRDWAREFELFRLPPFIRCILKIEYEYVRIYVNSLSLQAVVERCTNNATGASALNGGSTDGDHQAQQQQQQQQQQQQPQQQTQPQPAQQPQQGHGQDQAGPPQLSPQTIMNYGKLPLGQLGGFTVHDQEYVREVVEGSRNLLNEVVTGLLPNGYLKHAPVRTYFRIISGAMFLLKTFALGAPRSDVKASIDLMDATVEALRNCVVDDVHLGIRFADLLESLTSRLRNRFIQAPTMQQVTSGRGQSPVAAGAEAGAGGNVGGDWIGGHAQSLRDGLNGQFRPASPAMEANNISATPFDLTTSSFPYPGGASLGPATPAAALDLANNTNGQHHQSTNHNQHHGPANGGIDATLFDEWNNPGNEMWYLPPGPAFFQNVGVGGDSSTVAMTSEGVNVGGLDLLDYMGMDSTQYGTAMEF

SEQ ID NO: 1220 - protein, 365 aa, Unknown
  Kingdom: Fungi, Phylum: Ascomycota
MSYGTTRASPAEQNGSNTAPSSQSLGGASGSSSDPAVADQNSHGNSLRLRAKAFYSRNLGLVFVFLAQIFASIIIFVRMLATALIGSFWMWFKKVPGFPLGPRGVRRLLVIRGVAGSVGLFGLYYSLSYLDVSEATVITFLVPTITAFVCWVALHEPFTLSEALAGLIALVGVVFIARPTFLFPPGGLLPPVRASPLERSIAVGCAIAGAFCAATAYATIRIIGKRAHSLVSVNYFASTATVSSFLIIMLHPSLQFEIPTSLAQWLLLLSIGLSGFIFQILITEGLQREKAGRATNLIYTQLIFSLIIDYTVWGTTPPATSIAGSVLIIGAAVWISVQKKTTPEKRQPSTVDEESRLLPSEGPRT

SEQ ID NO: 1221 - protein, 628 aa, Unknown
  Kingdom: Fungi, Phylum: Ascomycota
MEEGTDIHGAESPLHQQLVLPENCVEYFLLVIDPQLEPRKKLSQLESIRQAALELARTLTKDYIWQREEFNLELRTENGLTYLYGITDYGDAVEDEWLIVYIIRQLTSSNPSVWARVADADGEFLLVEAANVLPKWISPEIDRNRVWIHNGQLFVIPVDEVAAPKSEPLSLPRAVEFVTNKSSALVHSPFIQEEAFYRLGKYPDQIADSIHHALVTIPRRLAYVIHSVPRAISAAVEAFYLRDPISLKPILSSSSTLTFPPEDLTTVSVRFSKVLFAQVRSQHFEAPSRWRELLSEADTATDTAARTRLEMGMKLTCGFEMLAARAHKSKSRVVRELAIVIDDLKEDGDEVLPSDAEIRSWPDSQRNDDDGWMDINYEDFERELGGERGPSKGSKKASGFGDAQTETDLRKIVSRFEAFLNDESAGLDGAELDDMDYDNESDGDEDDELDDESDSEDREVGFDEAEFSRMMREMMGFRPESSASTSPQYVQQPRHSAATDDNEDGEEIEEIKNLTSQMESELKEHGALKLDAPRDSRTLENGEKGKGKAKASTLTDEEDDGESDEDDVDIDYNLAKNLLESFKSQGGMSGPTGNLLGLMGIQLPRDEEDEHLQGKGGQSSQPPTARSP

SEQ ID NO: 1222 - protein, 615 aa, Unknown
  Kingdom: Fungi, Phylum: Ascomycota
MCIYLYKRWRRSRTAPDETSLRPSCEHRDEPSPEPCVECKAADKAATRYRLKLIAGLFFPFALAALDATIIASALPWIAQDFGQYSQLNWIVSAFNLTSAAFIPCWAQIADVFGRKTGLNAAVITMLIGSTLCTAAPTDAFPVLLLGRAFQGIASAGINVLCRTILADKVSLKENAKNWAVFSLVGGTSYALGPLIGGYFTQSDYRWCFAINLPVGVVALALIWVFLRNELLGPQPIPELDNSFATGRRTRLVARLKVIDYGGQMLFIFGFGLIILGLTWGGVTYSWRSAAVIAAITIGGILVGCFVFWESLFATGRFAARTMPWQKPMIPWTLISNRDIGLLFFMECVSGMSMFAVLYFCNIYFTAVKNFTSDKAGVALMFFTPGLAAGTIGCALMTGVWPRTTFTPIMAGTILEAVGMGFMAWACWTEKIANVYGFMAVIGCGFGLRFMAVPLHGIGLFRQFRASILALMALSVPLGGTLGLTIMATVFNNVSGLDSHKLNSHGKSTADSSIADLSDDATYNAKMGVVWAFVAMVPFTLLALVAACCIGNIKLGQGTGDAETGGDNIVIEDVYLLTLFRRSKGIDAEWQASANEDAEETRPEKQVATSAKRQT

SEQ ID NO: 1223 - protein, 764 aa, Unknown
  Kingdom: Fungi, Phylum: Ascomycota
MPVDDTVYGFPPEAFDESFLPDVHRQFIDPEDLHAFERALQAPDPLQSPPADDASIRSPKSPTGSVSITKRDSQTAMSMEEDLSAIAAAAAAAGGDLPPPDTPAQGHGTFITAQNDWAPVNSRIYRNRRNGAKKGRRKKTTSAVEGLLGTRTKDETREGYLYQLSKWPLLFFVLAWLLWLSVAYLSTRWYIWVYEHFFTWRGRRETLRRNLRRTTNYKDWVAEARQLDSYLGRQAWREENDFAYYDSKTVKRVWEQMRKVRLRAEAQEGSGPANGDKAKAVEDLKALIEACVKNNFVGVENSRLYSQTYYGTKNLVQNFIDEVESSIKFLLRTKSLETEEKRLLFKHVYANYGRTALCLSGGAAFAYYHIGVVRALVDADLLPDVITGTSGGALIAALVATRTNDELKKLLIPALAHRIDACSEPISVWFPRWWKSGARFDSVDWARRGGWWTRGSMTFREAYERTGRILNVTCVPADPHSPTILCNYLTSPDCVIWSAVLASAAVPGILNPVVLMMKQRDGTLAPYSFGHKWKDGSLRTDIPIKALNTHFNVNFTIVSQVNPHINLFFFSSRGSVGHPVTHRKGRGWRGGYLMSATEHYLKLDMNKWLKFIRHAELLPRPLGQDWSQLWLQEFSGTITIWPKSIPSDFWHILSDPDPERLARMIHEGQQSAFPKLKFIANRLKVERLVEQGRRETRPWVRRGSIQTLMSEEDLRSLLVREMVGSGTTEEEDNTEGDDEGLTGTPLEEMDDPVYGGGGGHEKRD

SEQ ID NO: 1224 - protein, 269 aa, Unknown
  Kingdom: Fungi, Phylum: Ascomycota
MGKTNDVPNAWEDDWEAQADKAEANPAPASQTTPKLKKSERLAQHVETNRKLWESAETPQTFHYLEATNNLPANTTTFRPQIKVLSRKPILAKRDPSSGTQTPADEDEEDDEAKKRAQLTPEQIRAKQKRDLEEKQRRYDEARAKIFGESAPSSGASTPGTVTPPRGADGAHHSPRGRGRGRGGRGNSSSNTLNIGGVNDSRRQNVSQQVSGNRELYDPNYAQRRPEDGPARMVGGAAKDEQAPIRAPRGPDGTGKGGFGFARGLGRGT

SEQ ID NO: 1225 - protein, 265 aa, Unknown
  Kingdom: Fungi, Phylum: Ascomycota
MCEFLRKPALPPATCHLRPSQQQGGRAQSRWRVECSQKTQLRSITASAKQSSSRNTAENNGDVAPKPGMARFMGPRPTRLVVAITGATGTPYAIRLLEILRDLKIETHLVMSKWALATLKYETHLSEAEIRSLAHTNYTARDMSAPIASGSFQHDGMIVVPCSMKSLSSIRTGFGDDLITRAADVTMKEGRKLTLVIRETPLNDIHLDNMLFLRRAGACIFPPVPAFYTRPKTLEDIVDQSVGRMLDTLGLYVEGFERWEGFRKD

SEQ ID NO: 1226 - protein, 313 aa, Unknown
  Kingdom: Fungi, Phylum: Ascomycota
MLSSLSTKLALKKLGLPSNTLDFSSSSPAASSSSRDRRRDDAHDDDKSQGWGSSWLSVRSLPLTTQSWLSPPPAAVPVGRVPRIGDLAPRDPDGKLQLGGGRRVLVVFLRCVGCAFAQKTFLSLRTLANRHASLITCVAVSHASPAATAKWLDLLGGAWNVRVLVDERRALYAAWGLGVAGLWHILHPAAQAQAWRESGWLGDRVAEAIQRRGGVQSQSQSSASAAAAARGDVGGGRGDKRRNALRGDGRQRGDDVAEEDEDEDDGPLTVMGNKWQESGAFAVDGRGTVIWGGKALRADDLMDLDEGARLLLM

SEQ ID NO: 1227 - protein, 659 aa, Unknown
  Kingdom: Fungi, Phylum: Ascomycota
MSPSLPARPWGSVVFHPKSLPLLARVANRSQLHQPPPHYDPSPPAQVIIFTFTFSPAFFTSLHDSFAPTNLHLCTYPCMRLVLSVLVRQCLFRPAVRLRHCPACFESTIASLVYVTRSPFTVTVAALVTVSLSVESPFIHAMDKMSKFRRKQKPKPPTIETSVPRVSSETSDSLKSEKGIAAAAAATVSGTTTSSSSTPSSPTGNSKRSGARSSRKSPFRSLGLRSYRKRARGSPPAELSSSPPPPAVVGQDGATSLKSHRMSTDHDHETQLDGERDVPKIPGFLTFSEQEIDGQYQSLTWNERSRVLAGVRREDGEENRWGQYKQIDRERGIMDRYSNIKPWNHNRVRLQVPENQFDYVNASAIELPSSSDPTVAPLRYIAMQGPTEPSFAYVWRMIAEQLRSPAVIIQLTSMVENGTIKCHQYFPEDDEESDWSLNEDDIWEDGWKARLISDSVEELAGGAIEKRKLLLHVQNEAEPRLVWHLLYRKWPDFGLPEHDDLESFFEVMRLSRELSPDPSNPRIIHCSAGVGRTGTFISLEHLMRELDLGALRAPSSTSDEVTEADLVHDTVDFLRQQRRGMVQGELQYRFIYQVLRRLWQDRYGSDEYDSGAEPAAKRLEVGSTGVDPFLDESKSMDDTEDGEKGERSTEDRDSLKLHR

SEQ ID NO: 1228 - protein, 567 aa, Unknown
  Kingdom: Fungi, Phylum: Ascomycota
MALPLPYSYIQCPCSEQLETDREEDPQDEDVVEDAERTFDPRGPRSNYSLFPLEHLMYCEDCQQIRCPRCVSEEIVTFYCPACLMEVPSSTQRSEGNRCTRSCYQCPNCVAPLQVSALQTNPEAGLLGAESNPAATQGPYALICTYCNWTSSEVGIEFDRPSGIHSQLAKLQNGGRPKVTAKEVKDRRNKNPDEPMLPDEQVDAEMQFAHLREFYQSQLGDPKSLMGGMALGDNMGFSSPAALSRIMSLYTGRGHQGDRTQHGPPDSMRESRNTEEGLKLAQLDESSSLKKLMVADWESTLNKEQRSLQLEQVRFQEDMRPIPSLLRTKRSKRCPVCRHIITKPENKVTSTRFKIRLVAKSYIPTISIRPLHPTAAPIPVTSRPMLPEEELLRPLKTYQYVVTFKNPLFEKVKVTLAAPNKTPGRFSSTVTVLCPQFEIDANIDMWDDALREDAADNKKKGDESNGQAAAGKVWERGRNWVSIIVEVVPPSLRTEHLGLMAGPDTVVDKSPLKDGEDVVEIPMFVRLEWEADAQHEVGSAPGKDKDAREKRELAYWCVLGVGRVSRE

SEQ ID NO: 1229 - protein, 401 aa, Unknown
  Kingdom: Fungi, Phylum: Ascomycota
MKRLRLTTSSSRWTAQHLQTQSRLGLSISNASVSRRCLTTESTPASTPEAITTSILPDTPLPPSAHHLSELNTSPPPAAALTSAKLAALHARLALSKKIPLQTLARCLVTPSADQDKRFNNVNLALLGSTIVNYHAYEYIICKWPRLPQSVLFQALSAYAGKESLTQVSKRWGVEEAAAPGKEVDSGLLQWSVKQHDAVDTQWAHLRAEAERGDIEYRRGISSRIVLDDAFGDEMPVSKSQRSPEEHLAYCRSVAHSSFVQAVVGAIYAHCGRESAKAFVSSHILSRHLDPSELFQFKQPSRELSMLCMREGFEAPVARLESETGRASRTPVFVVGIYSGKDKLGEGAGPSLNAARKLAAMNALKAWYVYSPGHKVRVPSDMMEEGAKPWTPPHIDVGEIV

SEQ ID NO: 1230 - protein, 180 aa, Unknown
  Kingdom: Fungi, Phylum: Ascomycota
MMKLSTIALTVASTAVGADANDYARTCKSWKVTGVNNVVLRACCLDARGYWKISELHLKHCLANHDGLVKYREGNFHESCDSCSVQSKPNSAYTCRCYIQGEEQGWYFDTFNKLDDIIFNRDGKLGCFSSVGGDKGTDSGCRGYGAQLLMANGATANGTIEEEEALSQPETQCCSVAPDR

SEQ ID NO: 1231 - protein, 177 aa, Unknown
  Kingdom: Fungi, Phylum: Ascomycota
MSSPLFCCSSIHPYRPQRLSHDAKFTSFILWASFPREAQPEKGKDGTAISSKDYAIQLVRQVNFGPLETIRYFVPTGDDAGAFVEISGQDLIQANFQKVNTYKNYKCLVHNKFFEVNVYQKDAVNLHHWRANLARPAAEIDLQPQATTQVTSTPVTQSQVPIGIILGDVVARRLWKR

SEQ ID NO: 1232 - protein, 649 aa, Unknown
  Kingdom: Fungi, Phylum: Ascomycota
MMLHIPLHARGRDAFFALPTTTPDHEATEQEAGSYAAPRSPAENAESCSNTIGKVIPTAGLTAMPLSDVITLENLEQKLPRWTSAIDSHLYAIVDMGSNGIRFSITSLEPPSTRLLRPVYSTRAPISLFDALTPSETGLVFSDSTITSVAATLADFHRQALMYRVPQANIMILATEAMRRAANGGRMLEAIEKSTKGLGVHILDPAVETLCGAVMGSRSGLGSLPERGALFLDLGGGSVQMTWVDPSASDYEILAARSGVSLPFGAARLIRVLKQGEATVVAEQTEKLSSGLSEAYNGLCRQFPRLQALREAYQNHEEGLVDVYMCGGGFRGYGSMLMHTDEVQPYPFSTVNGYSVLAARFKDTDRMRSVHEDLQDSIFGLSSRRREQFLAILTVIEAFINAVPNIGSVTFCGGSNREGALMMKLPFETRESNPLEALASVKDIEKPVFDAVAQILRDAMPDEPSLARIPTVFSTGLTSLVIRETWSRQGHDADSNTSFALRNAIIRDTDAPGLSHRVRALLALTLSARWSGSLSAGDAQLSRSLQAIVDREHPGASFWAFYIGGHLRVLADIFPVLPLAADQLRNGISLQGRIQRSSDKKDRVSSTISIHPSTQIRNAEKMAKKLKEVVNSVAQKQALKFEAEIIIKS

SEQ ID NO: 1233 - protein, 1344 aa, Unknown
  Kingdom: Fungi, Phylum: Ascomycota
MPDRTSSSSRHGHSHRYSDTSRTSRSRRSSSAAVPPSPNRAPPPPVPSASASRRPSAVARDSAQSTFDSSVFSRSSVSTSFTTDSRVTSLSSPQYPQPTASYRDSFISIVDDPFFQRFDPAFSAHAPSATRLSSDSEAGDADDDGGEEEEQEEQDDDDDGERPESDDQHNSASAQAADGHATKSDSNWPPPRRESLTIGPAQYWSHSAAMESFNIAVIGAEGVGKSAFVQRVLGLQRPSMSNTSSVRMAVDNLTHFVTLLELDLEYFELSPDQPIQWPKQMNGHIVPRVDGALILYDVMEKESIRDLPTTVAALTNSGLPAILVACKCEHPEDDWEVDAEGMANHKFFQACIGTYKITKDDSDTAKACLQSILKAAVANRREEQGENVPRRRAQSAAYAEPGEAPGSRAIPEQSKHSRASSDLSLLRGFPNAPIKDGYRGQAGRSPRLMQQSAADGDSNSHQIYNSMLRSTTGIRLDRSGTDSFLDMDESDAESFRYSEEVPILQRSDDGPDKPSKETGVTFDSLVDRLLAPRLSKPDNNFSEIFLCLYRKFAAPGELFSAILERLDRVREDKTAHYLSKTATQLRMIEVIAKWVSLYPGDFARPATRRNLEDFIRHLSTEPIFSIAAQQMRRNLHYNVVEDDDTGWANSDESGDKAASQLLSREMSELAVGISTMQFDDDNSGRPSASSDASQLDRGSSVSSQFHFHTYDEYEREAASLEPRDHLPMNKTRYHIFMDIPNDDIADELTRIDWIMFSSIRIRDFVRHVSLSASQKEKCKSLKNVNRMIAHFNHIAKWVANMILLRDKPKHRAQMLEKFMHIAVKLRLLNNYNGLAAIVAGINGTAIHRLAQTRALVPEVVINRFTRLCILMGTQKSHFAYRLAWENSPLPRIPFIPLHRRDLVSAEEGSKTFVGSKGDRINWKKFEVLGEVLLPVMKSQGAAYPNLARHDNARELILGCRMPTDEEGALLLNLPAVLLRDNPDGPSTTADLMTVVNERQLWISRVGPCLLRFSVLLPPEEALCVTDKQLKEYILSNEIWVPPRGVLTAELKEVRAAIKISGKGYQKHVKPRQEEKGRDFMNPHVFAPHELRSEDLRAIEEFLSHSGIQQTETDDKASQLPSSTGQGYTTTGPSPSEGSLREMIQSATNILLLGGKKRHTAITWIGGREWHGLVQIAPAVFNISYLQIVAQKAKFMPTIAMSLCRMMHAESPSLRSLAASFTDLHMDDKDMHEDPQIIRSDYAVSGIEKSIWKTLLANTQAPGVVTRTKRKRAASNFMSAEILQVEQWEHGDILQLGEATRGSSGGSSLTPTAATNAVVRRENQDVGSETLFMSDFFLDSLAQKF

SEQ ID NO: 1234 - protein, 788 aa, Unknown
  Kingdom: Fungi, Phylum: Ascomycota
MAQTRKSRAAASTPSKADAASDTVTSKPIKDHSNGAANDASKSDSDNKGKDGGDDAPSSKDSSAEAGPKTSKPFKGCVIFLSGNFVSIDQSMLSMKKLVREFGGMNPSSITQATTHIICTSHELKRRRHESVQMKIPALKPEWVVDCALQKRRLPESDYLWDYSEVLPTGETLTSADILAAAISEGLIISPAKDIPLDSKTGKRARGAACEADIKAEDTEEEKPKAKKTKMVAKAPKSKTGAKTKSKAATPVEEETECRELTEGQFAKKKDMVIPIDEFCPLPGYQVYIDPDSGMIYDASLNQSNATHNNNKFYRDQVVVDTKSGTYKTWTRWGRVGDVGQSAMLGDGSLADAIKLFEKKFKDKSGLAWSDRGNDPKPGKYAFVERSYNPDSDDEGEEVPQKTKVKGKGDADEVDLEPPSCTLEKPIQDLVELIFNTTYMQNAMAALNYDANKLPLGKLSKNTITRGFQQLKDLAALLNDPTLATSKWQMTFSAANEHLSNTYYSLIPHDFRRQRPPVIADHNLLKKEVELLESLSDMKDAADIMKIDRKKATVHPTDLKYQGLGMKEMTTLDPTSTEFSLLEKYLNATRGSTHNVNYEVQNIWRIERPHEHERFDKSPFASIESDRRLLWHGSRCTNFGGILSQGLRIAPPEAPVSGYMFGKGIYLADMSSKSANYCCAYNSNGHALLLLCDAELGKPMQELTNASYNAGDTAKADGKVATHGLGRIGPSKWIDAGAVHPSLKGVKMPDPNHIPGNTKVSGASLYYNEYIAYDVAQVRLRYLLRVKM

SEQ ID NO: 1235 - protein, 328 aa, Unknown
  Kingdom: Fungi, Phylum: Ascomycota
MENPTFEEVQARHRRELKDLQGRITSKKKNANKKTRKGVNDECAAMERDLKEKQAAELAALSADGAPEVPEEDVDEPPAEEQGQGELEKVEEKLEKVVEKLHLAGESHGDASAPTSPSQRQQQQQQVAAGGGPGKKRNRQKERMARRAAEQEEAAQRAEEEASSMTDHRARESESMRKTIDSHSLTEHQIAPDGHCLFSAVADQLSQNSIPLSSHGEPAYKTVRRDASTYMLEHRDDFEPFLEEGIEGYARKMRETAEWGGQLELMALARRYGVEMRIVQDGGRVERIGEEEGLKDESRGGTGKVLWLAYYRHGYGLGEHYNSLRQKA

SEQ ID NO: 1236 - protein, 469 aa, Unknown
  Kingdom: Fungi, Phylum: Ascomycota
MQLRPGAAALREAVASRAAARSALCSLCRRPSPLLSTATLSSSTVTAPNPSVPYTPRASLHTSQRRDSAWGAAVQVATNVVTNAVKRTTNDGMTIDPLRAVAKEMQFLTGNIRKLLGSGHPSLDRAAKYYTQAQGKHVRPLIVLLMSRATHLCPKTTTAQTPQTARGIDTSISPEKILSDINPSAQPLTSYDTLDGAPATGQSDILPSQRRLAEITELIHTASLLHDDVIDHSVSRRGNPSANLEFGNKMAVLAGDFLLGRASVALARLRNAEVVELLATVIANLVEGEFMQLKNTERDERKPQWSEETLSYYLQKTYLKTASLISKSCRAAALLGGSDEVTVDAAYSYGRNLGLAFQLVDDLLDYTQTGSSLGKPAGADLELGLATAPLLFAWKNNPELGALVGRKFEQEGDVARARELVLQSDGIEQTRALAQDYSERAIAAIANFPDSEAKDGLIDMAEKTIKRRK

SEQ ID NO: 1237 - protein, 515 aa, Unknown
  Kingdom: Fungi, Phylum: Ascomycota
MHFSPSFKTSQICALSPDGALVASTGFPSPTLANVHIRTTRSLQTISTVKITQDATQSVVGLAWSPTSSRILVTTSDQVRVYNVEDASLHAVIRNPGSGGGKPTYVQFGATDDEVIVVVAFGLKLSVFNLTSSKAVEVANPKFYLPLSAARSYAFNPRSEHMAVLTRAAGRDALSIHLPQTREVTRSWHPETVDAAGFLWTPDGQWLLVWESPAHGHRLLLYTTDGQLFRTLDSSRLCVNADASLHPGIRLCQTSTDGHRCVVGDHSRTVTVLDTANWRVNMNLNHPLAVTPEDTLQIWQEQIAKSPDGHETHNFVRATQALSPESVTWNNRVTADLRVGCSLAGFDASSDLLATRLDESSCTVWIWDVASAELRAVLMFHSSVSFSWHPSIRELLLVTCQDEAFRGVSYVWDPLSAGPRYLSLGEQLPEGKVQGKTQALWIEWPQEAPVIFLSDASRYLVALANESLPYPEMWPLNDQGSSLQGFLSREDTPLLDGHDEDDHSTLDDTFSFKQG

SEQ ID NO: 1238 - protein, 376 aa, Unknown
  Kingdom: Fungi, Phylum: Ascomycota
MAEASCSGTTAFKRIVDHQSRDVSHHQDRLVGQPHSGSQGAFRSAAAPAQHVQDNFAAFMDGNHGLPGMPHDPAGRLAAHAAALDPLNHPRMSTPGIIQPQQQHSGQSTPDIAGWAADFNRFNQKRAPLTPLQNGMLPAQQQQMQQPAQFQGFQAAFGSVAPLYGPTNGGFMDPVAAAAQRPVAEADFDQEMTRWMAANGGGDMTDVDAAMDQMARELELNEAALKEAEQAAERESYLEAQSDQEAQYQQEALETRLTDLETPEIANLSIDDRHALEEESRAQQAAKERSAVAEAAEQLLDTVQHEHGEKWQNSVFLSLMRDFRDGRKDIVDGTIQVRSGTQSPAVSEGGTLVTDFRKIHDPQWERPGNLEPSDKA

SEQ ID NO: 1239 - protein, 371 aa, Unknown
  Kingdom: Fungi, Phylum: Ascomycota
MSAVEQIRSTSQNEDWMAGRSSEDTACNTEPASFTNVIQASAQFFGNIRTPATSRSANVAAMHSVTSAFKPDASGHSPKQVPYLPSLKLNDGNEIPMLAWGLGTARKGNGTFDEELVEVTKTAIKVGFRHIDGAEMYENEAEMGAAIKASKVPRDQFYVVTKCSGTRKSNTQEAFEESLKKLGLDYVDLYLIHAPYFADSPEELQQKWADLEAIKESGKARSIGVSNFLQKDLEIILQTAKVKPAINQIEFHPYLQHGDLLDFHRKHEIAVSCYGPLTPVVRAKGGPVDGLLKQLADKYAVSEGEIALRWCIDQGLVAITTSANELRMERYLNKIPKIKLTPREVDEIAKLGKEKHYRAFWNDKFAADDRS

SEQ ID NO: 1240 - protein, 1140 aa, Unknown
  Kingdom: Fungi, Phylum: Ascomycota
MRSTQLLTQLSLWATTAHAFYPYTPSWMEEEREARGLQHKQRLGIRDGNGVRMELVQRGGQIRGSPAERAAREASRLTRKYAAESSSTNALLRRDNGYQIMEAADPGKPMSAGISQDGTDYSYFIKVQLGSKRTEVYMLVDSASGTSWVMGPDCKSTACTLHDSFGAADSDTFEGSSEDFNISYGTGEVSGKLAKDTISVAGVSFKFQLGIADEASDDFQHYAFDGILGLSLGKGKTENFLDVMSEDGDLKDNIFSVALNRAADGTNNGEIVFGSIDSARFTGKITYTNIVSGSKVWAIPVDDMAYNGKKAGIGGTKTYIDTGSTFIYGPQNLAKKIHSVIPAATSSDGGLSYKVPCDSNQDLTFTFSGASYKLSPKDWISPPNSNGECTSNMYGHDVAAGALLLGATFVKNVYAVFDKDNERIGFAPLVEFSKPVVSTTATSVASRTTHGETPATSRGTSTSASTGASTVSSSAAGTTNVSTSKITALPDTGASSKKPSLGLTGPEQPSATTTQEKPQKEETDTPPPASPSSPPTEAWFSPAQHLPPLVDSAYDCGLDENDQTSTCDFCTMTEAGDLGGAQRRGEDRGFLAGDEGRWGSFEEEDDLAVHPGVGSDDGPKTPRTPGRVRFDLRPEVVGGAPANGSAYRDSLDMEDGGGRDSASYHRTPLLTDMEAPSVTVANSWGEGLEDDDVDHADRLEAEMRRPKSGLKSAFMNMANSIIGAGIIGQPYALRQAGLLAGVILLVGLTVLVDWTICLIVINSKLSGTSSFQGTVEHCFGRTGLIAISLAQWVFAFGGMVAFCVIVGDTIPHVLLAIWPGMADVPVIGLLTDRRVAIIVFVMAVSYPLTLYRDIAKLAKASTMALIGMLVIVVTVLIQGAMVPSSQRGSFPTSELTINSGFFQAIGVISFGTNPSLSSHQPHSYYKLTDAKAFVCHHNSLLIYGSLRTPTIDNFSRVTHYSTGISMAACLIMALAGFLTFGDKTLGNVLNNFPPDNTMVNIARLCFGLNMLTTLPLEAFVCREVMFTYFWPDEDFNLKKHVIVSTALVAGALGLSLLTCDLGAVFELVGATSAVAMAYILPPMCYIKLTTRSWRTYLAYGTVAFGTAVMIISVIQAIDKMFNGKVQPNQQAPLRMDRQVD

SEQ ID NO: 1241 - protein, 854 aa, Unknown
  Kingdom: Fungi, Phylum: Ascomycota
MATSLTEAQIELINSLAPDDIPIKLRCAICSKLAVNAYRLPCCEQAICETCHSNLPDACPICEHSPLSAEDCNPNKSLRTTIKVFIRTAEKKREAARAHEAKESAPNTPVEVRKPSVSGSVQEACVKEGIEQAENPTESSLELVVQDEAQTGSDDAPKSEQPPEEQVDHAENIASGDDNPKLVHEVTEGVEDDRNEADEEQGAHEQEDDENADTMNGGYNNMNYAGASGDYSQMQMMMAMQNGMNPSNFGGFPMMGMPGMNLDPMQMQNMYMNGGFQGMGMNGMGGFGGGFGQGSNNWNNGSQQWNFDQNNYNQNGAGMGAGDFGGFNSGFQSGYNQGNYGQFNDYRRGFGRGRGRGRGFYGGYGRGGGYQQYGGGGNVPYQEQGRFPHHAQGQNQLTQQQQQHDGSEDQKQTDDLGRDVPRSTADGQGEAGPQDSSALSSHGASGSGAAGPSSNGPSAIPSVLSAPDVPLNAPTGPKAMRQGLPNTSLHHLRARGYQVGGGPASIGHGSQSGSRPQTPQYGTQSNADHVPEGNTPKKHDDQGTDAYDQDRGRSGSRGNERQEDEQRTRSRSERSRSRSREHRSSRRHRRHRSESGDDDGASDHHRKKHRSSKRSSHHHNEEEEEEEAERLRDQKPSDRSRSQSASADESRRSGHRSRRDRDRERRDKDRDKHRDRDRDRGDDRKKSSSHRSHRDREYESSRRRDRDRDRDHDRRRDRDRRERHRESDREDKSAADDSRRHSIADDPSTTPQDFKPPSGPRSFDIKGSSSRGGATATKDVHTLEREARDRERLLKEAQRMAGMAGRRGSGAGGSRKRGREDGDEGGGRKSRRSRGDEEERMRRGEEEREGRRWE

SEQ ID NO: 1242 - protein, 398 aa, Unknown
  Kingdom: Fungi, Phylum: Ascomycota
MSLMKGNTYVLGFRDGELRSRSASGEPAPCSSADLITFLTRLVPYSLPLLRRLQLSSITEESMIVSVNLPLERLSFDGEHIVEHAKRGAENPASIQPDEVWTLALLHRQGHPSTEVWFFSSLELSHGLSPHEKESQPADVKPEVLRLPFTDATQQQATSQLAVILSNMPITSRQRGVDLFQQCKTFGSPGSLAGNVHSTVAALLAAAGLIVYGSPPYGHYVYLAKVDDKVFIPDGSSEGLPDGLIWSTIQPSDHADVMAVNKIVRSAATIAHLPSAAIRHVRPREDGSPGKTVAFGFASGDGSLRTLHVDPDFRRQGLAKAVVTRLLNSGVFAPPKGGPFAAERKVYEELEEPHPFAYASIERSNVASIKTFEGIGAEWKWDVYWLWLDLDKAGEMVR

SEQ ID NO: 1243 - protein, 411 aa, Unknown
  Kingdom: Fungi, Phylum: Ascomycota
MATTNTSNGAGADDDPIVLPDSPPIDRRSISFLLNEPLNAEHRSSRAGRLRQRRVPPPQVNTQPPPDVIDLTEEPDSPIERGLAADTPAPRTLPWPEIGSSRHRRADGSRNPRRTNSTRISPPMLTRSDSTLMSGRHSIIDLTDDSPEESRTLQLPRISRQSNANTTLPSFTGNRPLLTHLHHRHHHRHHHHHLHQHPAVHPPQRQPTTDEIVEVVTAVGTVGDFVQNSLRHYHGFITGGFSGLARAFNPPQLDVTRNAYAPREETPQPPMDPVPPVRPGFTRDTHAESEAGGEDTIAVCPACNDELAYDPTEVAAAQKPASNASSAAAAAGRKRKRAPGEHHFWALKKCGHVYCADCFENRKPSKANPAGVGFQLPSDKTGNTAFQEMRCAVDGCETKVAQKGEWIGIFL

SEQ ID NO: 1244 - protein, 409 aa, Unknown
  Kingdom: Fungi, Phylum: Ascomycota
MADSPRGVETADSVDFDHDSNSNKQNDKKKSRRPPNTAFRQQRLKAWQPILTPKTVKEIRLDYTNCADEAPTWDSNEDSFGKMPDDDVKTSFSEGVSGIGAQWAVQHNVNTTLWIGGAVVNTTRCYIRFSLPEDMTPPVLFYYHLTNFYQNHRRYVESFDTDQLKGKARSYAQIHDSKCTPLYGNSTENLPYYPCGLIANSMFNDTYTFPVLRNPPGDASGRNQTYEMQNNTGISWDSDINLYGKTNYKPDQCIPPPDWAKRYPGGVYTDERPPPNLKEWQGFQVWMRAAGLPTFSKLYQRNDNDRMIKGDYEVIVDDHFPVKAYKGTKSIVITTRTVMGGRNPFLGIAYIVVGGVCILLGVLFTATHLIKPRKLGDHTYLSWNNAPASKGPGPSTATASGRDARPGEA

SEQ ID NO: 1245 - protein, 416 aa, Unknown
  Kingdom: Fungi, Phylum: Ascomycota
MIQLPDLDAFDISPTLGFLSNQPPRPSFSDPHFAQLDEVAASLPELIATGSLRQKLDSLPYLDPIHLSSEGDYRRAYVVLGFLIHAYVWGGPKESAPLGTIPPQIAEPFLAVCERLGTEPVLSYAGLCLWNWASKDGAAPSPGGFFELDDLQPMGSFTGGRGEAAFYHVPVLIEAEGGPLVPLLLEAVAATGRSDSDQATKALIKGTAIIERMKQHLSKLYTTLDAGMFYHELRPFLSGGKGMEDKGLPRGFVFQRRGGSEQEVHCIGGSAAQSSLFQFLDIVLGVQHEPMGRNSETLFHEMRAYMPGKHREFLESVSKLPSLRSYVQQNAGNISLHNAYNECVKQLRHWRGSHIAVVSKYIVRPARLSMGVDQETATDTIEQANLGTGKEDNLQGTGGSALIPFLRQSRDETAGV

SEQ ID NO: 1246 - protein, 281 aa, Unknown
  Kingdom: Fungi, Phylum: Ascomycota
MAHPLDDFDRIAAFQVAIWSIYLVGAVLLCTRHDFAHTSGWVYLVILAVARIVSASLRLATISDPGNTDLYIGWGVCSGIGLTLLISINTGLMSRLLKSVRRANGGHALVTPLMQKVAKLVMLTAVVLFIVGGTQADWDITDPGGRPDVTYPVISKVAVSIMVAMLVVSVLEAVYLATVRRCIPEGERRILLAVFLTLPFATVRLSYSACLVYGAYSPSAWFSLGLEVMMEVIAAAIFEVIGFTLRKETTHDEPVQLRDSSDPEQQVQEAKESSSSNTLLR

SEQ ID NO: 1247 - protein, 1488 aa, Unknown
  Kingdom: Fungi, Phylum: Ascomycota
MDEDPADIFGIGALPDEDSFFVDNSDDITFHWPAPHDIAQDAFSQSANAVCEYAENFEKQTIAGYDLAPFTAPDTSLDEHREPSTAPAVDVPGAQSLTSTPSEKTDSGPPLSVQREPCSSEPTREAVLASPALGIPGFEEADASYVKNSPTIETDSKAKLHHNIESVMQDVTFINRSCEAPLNGRREDILEHRQDSLVNRVDLRMDVDAEVVAEDKPELLTTKTCHIHAESMVSTSRSTSPDRLSSLPPRSMDELSTAVTHVEEPTGGEPRKQPARPPDKAPRPTVVKLPPCDSEDEDERPVASAVPSVPVHEELALPDEEECFGNETELSASEASFANETTPRSPPSSTGTISTPYKEPWPCPPQSNIAVELPTSTLISPPSHYEPFTPPAPESAEWRAVDALCRESRRLGLTKDGYLEFDLNDFAVYVDAAHYPDEMRSLHFLDTRAGHSKYYFDGTLSVGELRFFVRRVPIAALPIDGYLDPDVHTVRGLTWLHSAHNAKRQLYYKLRRPAKEYARFYEPFVWVADLAKHVVDFLDAMQERGDKVSIHSFKHDFGVWLLRRHDGAQQLLRWGRQHPSGDFRTSVAAHVGFLYKEAYGVLGPKKVDFHPLWDEIMRFTRFQPEPAAQVEHDPTIVTEYIRDCFAHLPFGDRLESFPFSEETKRLRRRLIRRRRLEMPAPLHDGISGLSNAASERIRRIRPGDTISTDRDDVGSGTMWKREVARGSHDVDRWFARVQRVSTNRRGQRVFDVIWYYRPVDTLCGVMKYPWSNEIFLSDHCSCEETSKITEDQVLGVHEVEFWGSSSTSKELFCRQTYIAGERKWITLEKKHLHCAHVSVDMRDNDERRYRIGDTVLLHLNPRTDRSEPCEIVDLEPGSQEIQVRRLLRRRDVDQMAATAPLNELVWSDELLYSKRAQITSKCHVRFFKEGGDIPTPYDRSGVGAFFFITHQLFRDGRCRPLTARPPSLRQGFDPYQTLPRLRGLDLFCGGGNFGRGLEDGGAIEMRWLNDYNQRAVHTYMANVADPETIHPFVGSIDDMQRQAMLGNFSEKVPRIGDVDFISAGSPCPGFSNLTNDKTTVQQRKNQSLVAAFGSFVDLYRPQYGLLENVRGIVQKKANRDQDVFSQLICAIVGLGYQTRFFFLDASSCGSAQARPRVFLAFAAPGCRLPNKPQITHSHPPGAKSLSLGLLPNGEAMAEREMPAATPFKFVSASEASSDLPAVYDAKPDTCIPFPDHRVAIGTTRDLRLQMSLIPTQPWGMNFALAWYGMDRKKAGSGIFTQAERDLFPADKGPRTVGRTLASSSAYGRLLPHRPFNTIVTSQSPADAKNGQQMHWREPRTITLMEARRAQGFRDHEVLLGSVRDQYKVVGNSVAREVAVALGLMFREAEFGSLTDGEEDLSRLTGVDVGDDVPSPDEEGYPNAFPVVRVDGSSSVTTATSSLRSTPATAVKRSSSASSLVMEIPTAKRPCHHPVPSADDRPLNPLEEM

SEQ ID NO: 1248 - protein, 403 aa, Unknown
  Kingdom: Fungi, Phylum: Ascomycota
MHFSNLAVKAAGCLAFLETVHGHANHKRDASPEDIRVLNEKWGTDWPFSGISTFAHLPHFKCLVEPDKSFDIAIIGAPFDTAVSYRTGARFGPRAIRSSAARQTSFRSFNPRAGINPYKSWADIVDCGDIPIAPFDNKLALKQMSEAYVELGRRAPTSKAAGYQATSKLITLGGDHSVALPALRALKERYGQPISVLHFDAHLDTWHPAKYPSAWVDASETDAQSFFNHGSVFWLAGTEGLLGTNGTNVHAGLRTRLSGTDWADLEEDTEQGWHRIAADDIDDIGVAKVIEIIMTKLGTERPVYLSLDIDVIDPGMAPATGTPEPGGWTTREVIRILRGIEGLNLVGADIVEVSPPYDDAGESTSLAAAQIVYEILTSMVKRGHREEQESLKLAGEESAKDEL

SEQ ID NO: 1249 - protein, 238 aa, Unknown
  Kingdom: Fungi, Phylum: Ascomycota
MKLSLFTTLVSLAAVTMAQTQLCERYAYYASDGYYFNNNRWGQDSGTGDQCLLVFNTKGGGVSWQVDWTWSGSENNVKSYPYSGRSLTPKLISQISSLPTAAQWTYQGNNIRANVAYDLFSASDPNHDTSSGEYELMVWLGRYGNVYPIGSSKGMVNILGQQWELWDGYNGAMRVFSFVAPSQRGSFSGDLKAFYDYLTQNHGFPASRQYLTTNQFGTEPFTGGPATFQVQNWYAQIN

SEQ ID NO: 1250 - protein, 485 aa, Unknown
  Kingdom: Fungi, Phylum: Ascomycota
MVGKRGLGEDDRKQSYPADQTPQGHLNGNGEARWRAKRRHTGDLEAGQRPNSPRLLNGRPRPRLWGYRDDADIIAQEDARREELKNALLKGIDRNDLEKFRKSNDELKEIKNKALRRFYEDQNCRLNDWLEVDAVIMAIADHVLESMNPDPDHDGENERNGELQRVAGNINKLLPDEEQEKRRKAAEKAKIGIQVNVLANVLLLAGKGFAALTTGSLSLIASLVDSALDLLCTIIVWTTNKLVLWRLNALKRRFPVGRRRLEPLGILVFSIIMVLSFAQILQESFGRLMPPHASAEALSIAAIVSLVATIVIKGIIGVCCWPIKTSQVQALVQDCKTDVYFNTLSLLFPLIGYKADVWWLDPVGAGLLSLYIIFDWGHTSFENVVRLSGEAADDRTLRKLTYLAYRFSPVVTGFKAITAYHAGDGVWAEFDLLLDENTPLNRSHDIAETLQYCAEALAEVDRAFVTTDYAVSGPTGHATDAEQDH

SEQ ID NO: 1251 - protein, 293 aa, Unknown
  Kingdom: Fungi, Phylum: Ascomycota
  misc_feature (163)..(168): Xaa can be any naturally occurring amino acid
MEPATVIGLVTALFETFADGHEDYSSWKRKRALGNHYHGRGLASPPCALSTLLLISGPQIKDTYDKAVQALGTDFSTGDAWCRSTLWSQLNILSDRVAILHRAAGASVSVALDLADAVQVCEGVRRASLRALTDQYSRLAAGRPIPKALAVPKPNLTPHRLLXXXXXXPEQTTDEPGPSRRPANSVFALFCPEALGLQVDTKKKIPATAECNCGYSWKHLLTDSKDALRLKEGFQLTVRFLVKSHHSKNGYGCVLCTSSGKSEKYDGIEQLRDHINASHTKWQLLHDTDCRAS

SEQ ID NO: 1252 - protein, 666 aa, Unknown
  Kingdom: Fungi, Phylum: Ascomycota
MNGAKAARDEKLWGVVQVSDEYLRPHDPYPFKSLCSLIFPTLRCDLLQNTIPSPDTRPLLSGFHEACSVEKPGVAPTHARVGTIPPQTRKRKAAEAAIVSDQRGLSPIKKIVSSAVSPILIAAPPTPVTTGSVGMDSDEEFMSNMSSDDAIMNDSNDDMSDFDDDDFEQPDTDFDLSNKDLDKPKRPAHVVPFKVFEPSDIQKQQDDMINEVNMILTMSKEDAAIMLRHFRWNKERLIEDYMDRPEAVLEAAGLNSSTSAMPKLETVPGFVCDICCEDEPGLETFAMKCGHRYCVDCYRQYLTQKIREEGEAARIQCPSDGCGRIIDSRSLDILVTSELTDRYHELLNRTYVEDKDIFKWCPGPDCPNAIECGVKKKDLNKVVPTVECKCGFRFCFGCPNPDHQPAPCTLVKKWLKKCADDSETANWISANTKECPKCNSTIEKNGGCNHMTCRKCKYEFCWMCMGLWSEHGTSWYNCSRFEEKSGTDARDAQAKSRTSLERYLHYYNRYANHEQSAKLDRDIAAKTEKKMVQLQTASGMSWIEVQYLNSASQALQTCRQTLKWTYAFAFYLMKNNLTEIFEDNQRDLELAVENLSEMFEKPITELAEPKLKVDIMDKTSYCNKRRLILLEYTADNLANGRWTFNSDLTNPTSQPSAAQPARAGTR

SEQ ID NO: 1253 - protein, 1691 aa, Unknown
  Kingdom: Fungi, Phylum: Ascomycota
MTSSLASEERPTLPAPGEAAGDPFVANTPGAPHHRFSSFDHELFASGPGSSPTQAKRALEAHLAETDRRLDEAGKLGTALVSQRKALAERLQEVEKLQKEGELGPDLRKKLVEIEREFNDLARESARVFLPKQRIPSNEANPGSPFVPEARSGRRSVSPSKFESHATGSPTKLSVPNRKLRNQPSNRVHDIEFAAEISTSLIAQVRSLQTLLSEREEEVKTLQTDRTKLEIESESLQQRLKTLDESEHRYKEENWNLETRLQEYSSLQREAADREKKLTQALGLSNAEKNTAQKELDEVKLSHAKLAEEHAATVKHHDIELGTAKRSMVMAEGERSAMQRKIDDLTSQNQELAKAFSLQRGRATEREPASGLSDEEFDTAADNITPEHSPPPSPIKGTPRHAMLETETIKTSLQHAQRTIQNQRSQLHREKTEKLELRRIIQDLRDDLEKARNDSGSAATSRRSRKVDSKEFKKSNRLLGSFRSSRQEIVVDDPEWEDNPEVSPGRSSASTIPSQGQLATSRTDTSDQFETANEASESAFETANERATETEEFQTGNEGFSDSDDDAATETESPSRGFGRMRQPPSLPAGLARHTNRNSFHSTASTSADEDDVAELRTPTTRLSSQRSRVRLTHGSLSRSSRQTSEEPNLQSSPASFASIGAAQAGQSLFAELQDYGGSDDDSLIGTPMTRRSVRSGTPGSVRRTLSPAPAVPELPRVIMVDSGVMTDPVRITSEVYTEALQRPVSVQSVVNAPPGQTSGVWGTNRGLDADVSRPLSTLSYSDAGAQYEHDIAEKLAQFPVPPTSPPQIPPTPPALGLSMIRSEAVEPREEPVVLPTPPSLRMSSLAMQQVEPVAEPEVPAPVLSLSSIVAQGLYPVMEPVSPPPALTMAPMLTEVVEPVAAPPPSLTFSTITAEAVEPKAEPEPLALPLPPVPQPPVLSISSIMAENVQPISEPEVVIRAPPLTLSSIHAEELQPREEPIVDPIQAPLSFSGIATQHVEPVSEPQPSPPALTLSSIVAEHMHPVMEPPPVPPALALSAISAEYVEPVSTPPTLPALPSFGFSGIESVETRPMSPRSPRRDGFILPRDEACHFTETGMPKTPPSAKMHRATGGRSNRNDSPLIAEDETRQSPREVPEVSTTPESQRPFKEISSNSALRPSRKPPVTTSDQGAQTALTAGAIDKLLMDGTREANRHVKQASVDSVPSPDTTGTVRVYRSQESFDSVGRGNAIDDVAFEAVPPFRPGSAASGKGSIQGAPPLPSNHRQVIDAARSGSSRGQPGAMGPPLFPASAMKQRPHTPSMQRPPSATSGRGTPTPRVIHAGSVAGQAGLQSPTRLTARSRQSSVSSFASELDTRFNMRPGEMGMGPTGFSPNTDPRMIQAITQTMIGEFLWKYTRKTIRGEMSENRHRRYFWVHPYTRTLNWSDRDPSTAGRTELRAKSVPIEAVRVVTDDNPMPPGLHRKSLIIISPGRTIKFTCTTGQRHETWFNALSYLLLRTDQQDQPEVDEAVDNITREDVDEFNPQSGQRRAVGNRPRAPPSLSSYNSRGSRNESPALGVSMNIPTLTPSTQRQSTTSGKTSTGTLSKLSGYWKTGGPRLSDTISSLRGRGPTNQNTGIYEASEVHDSAEDLREMIERQDREAHRLENVRACCDGKHDVGTLHHASKRGRGHPSHSHPASAASTPMASTRSRA

SEQ ID NO: 1254 - protein, 506 aa, Unknown
  Kingdom: Fungi, Phylum: Ascomycota
MPPPLSQGPQRPPMSHVDGSTLSAEAQEVLEIRRGMAAMNAVFDWTGPDDPDNPRNFSRAWRFFITASVTLLAFVATTAGAIYAPAQSAVEKEFHCSDTVAILPLSMYNWGLAFGPIVGAPLSEAYGRKAVFMYATPIFICFQLGAGFSRNPASLIVCRFFSGMFGSPLISNASATILDLTSGSYRGVALGIYYSLPSFGAVLGPLIGGFVVAKNDWRWTQSLGVILTAAMYVPVCFMRETYKKVILQRRAIRLGLQDSSSQRTSPGRAFRYFVTVLIQRPIHMLLTEPIVTLVSMYNAFILSLFYTFVVSVPWIFRTYYGFDATEETLSFLGLNIGAILVPIPMILIDLRFYQKRLRQWRLHHADDEPLPPENRLISSLAGSFVLPVGMFVVAWTAQNRVHWAVPIFFQGVVMLSSMLVYAGATLYMLDSYGPLYGASASGALQLSRYMLSAAFPLFALRMFQSLGVGWALTLLGFITLAMAPIPWLFWYYGPQIRARSRYETSQ

SEQ ID NO: 1255 - protein, 252 aa, Unknown
  Kingdom: Fungi, Phylum: Ascomycota
MASAVDHVVHSPPRPDAQRPKGILKNSFQKSPPASPRRERSMSGKEVTIENTQINAGHRRSSSAARSASRRQSAHTSSDPHESSQRLKWDEANLYLTEQERTSTMKIDEPKTPYAKHYDPAEDPSDEDDDDIAVQGHSPRDKAPRARAEDDIPGLSLGEPEEEIPEPPARSPSEKTVHVDEESVGHTSDPDLAGLSAEEREKHRKFEQMRKKHYEMKNVASLLGHPEDILEDDDDDEQQAVPPVPRLPNGAA

SEQ ID NO: 1256 - protein, 254 aa, Unknown
  Kingdom: Fungi, Phylum: Ascomycota
MPGWQRHPMLSKIRGEKHSMGIMQITNPSHVGSQVFRPMDSLIDAWFSSSRASPHTPRRASSSSSSSSPPPVRPSSKPAKAKEKHDGQARFTVNQLLLRAHALLTYSPHQGSTTQALCYADRALDLAVEHRLERHCGKAQWFRGEALMRMERWESAYAAFVRSAGIVEGGWRRPGEVRQRMEACWRAKEEEEEAPEEQRHRGAAAAPKSRGGQLLLLPMGSTGGRRVGSKKAVRFQLGIQDDVGLTSDQIGSSD

SEQ ID NO: 1257 - protein, 397 aa, Unknown
  Kingdom: Fungi, Phylum: Ascomycota
MSDLKTDAFAPARIPSPSFQDVEKGGFRPRSAAASPLPARRPTLNTLPESMSKVTNNAPLSIMAYCLSSISMTIVNKYVVSGKFWNLTFFYLTVQAVVCITAIMACKHLGIISHLAPFDKNRAKQWFPISMLLVTMIYTGTKALQYLAVPVFTIFKNLTIIAIAYGEVMWFGGSVSPLTLLSFGLMVFSSIIAAWADIQSAVSGHFDQLDASAAMSTLNAGYAWMGLNIFCSAFYALGMRKVIKKMNFKDFDTMFYNNLLTIPVLLFFSVLTEDWSSENFVKNFPIDDRNRKIVGMIYSGLAASFISYCSAWCIRVTSSTTYSMVGALNKLPIAIAGLIFFAAPVTFGSVSAIFIGFIAGLVYAVAKVKSSSPGSSGLPFTKPTMSASAQSARDANS

SEQ ID NO: 1258 - protein, 77 aa, Unknown
  Kingdom: Fungi, Phylum: Ascomycota
MQRALDATPQHEGSQLLPRNVWDSGRRFPNPALTAPPLERAGTGGEAVTLQLVLADFAQCGVQGAITGIAYGNRMAV

SEQ ID NO: 1259 - protein, 614 aa, Unknown
  Kingdom: Fungi, Phylum: Ascomycota
MSADLFAEFNELSKSPPQSRSQPALGQPPAQPQPQTQTSGASHDLFSFLQGTNTNDVSHHQPSQQWSSFAAQPSSSVAWGGNGSSILPQTAGAGAGDDDDDWGEFETSESKPVTTVTQPQQLWNPSGPQSSIQWQHPPPLTDPPRPGVVRASTMDLMTNSLVGTGDQARPPPAPSIREEWPSSPPKARPKLSKGSSDPNVLFDAGDFELEGGDDLDDGLDDDDFGDFETVAPVPSQPAGQPRPAVKSVPPSLDLLGLSLDDGPSPAIPAQTRSPFLQTQSSGLLSFGAAPGGYPIAPKSPSFQQRNPFPALAINTPVKTEFDKKDANKSASPVTAWPSFEKEEAQGTGKYQDDDGWGAWDDIPSGPSQVSADIGSTKAPENWEWDSVDNVQPITSSVKGDDNAPPPVNVPPPSVILSIFPDLLNSAKQLFKPMAGQSASIKERILSDPKAVGFLQAYILLATTAAHVIAGRKQRWHRDKILAKSMSISAAGSKGMKLAGVDKTQSAREDREAADVVAVWRDNVGRVRSAVAAANSAGKANLKVPELAEAMQVQTAKLAPTAPKSCIICGLKREERVNKVDFEVEDSFGEWWVDHWGHRACKNFWLEHEQMLRQR

SEQ ID NO: 1260 - protein, 897 aa, Unknown
  Kingdom: Fungi, Phylum: Ascomycota
MLYFSRFLLLHPAQLPSFFALLTGIDSSATDGPTTVQLTDQVREIVQPLLDTFGDVHVCQSGASCIAKLFEIQEASDFDVKPTLVLLDTPSDTPLNPSNRPRTTESHKTDIHAPDEDIYGLNLLQKLMTEAHLRGVSKLVVPVPIISPIDSLPAAPAEQMTDGAVEHASAPLGFMPATRKLVKRCLDLGAADVIISPLSAKCITSLEICAYRAHRDATREQQAILEVRRGRKRSWVGVNEEKPFAYLREAMVSGLMSGICRMNADDDAQLISAHIAVSSERQAVITKAIGPWHFDAHAFTDDELVVAAMFMFKHALAVPELEQWRIPTDQLINFLVACRAAYNNFVPYHNFRHVIDVLQATFSFLVNVGALPSCSAEANMTAPMNRSPLATLIGPFEALTLLITAIGHDVGHPGVNNGFLITLNAPLAQLYNDRSVLESFHCAAYSQILRRYWPTVFMNKQIRSLMISSILATDMGLHFDYMKKLGDLQDKLHENNTTDGWTGRQTEEYKALACALLIKCADISNVARDYGTALKWMYILSEEFSRQASMEDELKIQSSLLAPPKKDALSLVRSQLSFMNMFAIPLFQGVADVMPGMQYTVNELELNRELFEKKVSDDREKNDLQSKIDPTRKRLLHEGTFSPRTMSFAAEPGTEHKANDLNPQHGDHAEALAKLTENLGDTPTSEGPHELMPEQLDKRDSQLSPPRSTPTMKPPHIPSTYDDNYKEINGAVSSFDAVRELAESDPFRTKHESKDSGFDNSASPHSVTRRSGTTEGSASGQMGDWASQATSTTTGKMPLSPSTQGTSLVSSESMERQGCSLTGVRPTASGQISSSTTIMKKETSHTDGDSNSTTSIGKADGKALKKKPSRFRMKDFPFFRKHHKSSSPTPSSTDTAT

SEQ ID NO: 1261 - protein, 394 aa, Unknown
  Kingdom: Fungi, Phylum: Ascomycota
MTSTPQSRGEITFQADVGPGDITGVYYITICNLPFETSWQQLKDWLRPHCEVDHIEVFNTSTSGWVRLRGRTNFDKAWSRLDGGNFHGRSIIASDKNKSEVIKIKELLDFKYNTQRARQRSDQAILTQPASPIPCRSPGSVAMIPPASTGSNAQYYTAIISPPCLPMASAGAPGYVGLPHFTMPPGGVLAYSHGHVAMKPLFEAQQRPSKPMKCPHQSHAGHDQHFATNASPGEPSRSDPLQAASPDHCKILLKNIPHRSGAKDIDIWARRKLGPFEKGLNGVDVPLDDSGAISRGHAVLRLNSLIHADLVIKKLHKATFRGRTISATSLEDEAAYGKGKHKTTSASGHNNGPESISVLEFSTDFSGAPTNARPSRSGPLVVEGSSRKATGNGQ

SEQ ID NO: 1262 - protein, 568 aa, Unknown
  Kingdom: Fungi, Phylum: Ascomycota
MPLGILESRLEHVSGTTRYFDDPSRPQIANEQNSHGLKCDTSGKQPIILIPQPSDDPNDPLNWPLWRRDLITFTLCFAGILATSLGAILAANTITLSLFFARDFTDIALLSGYFLLGAGAAAIFFVPSGRVWGKRHLFLIGICICIASSAWAGSVGKSYRSLLGARILQGVGTAPFESLLNAAVGDLYHVHQRGIRMAFTNLAVFGGAFFTPIIVGKLTSTLGWEWSFYLVAIFMAPTLLAVFLFCPESAYRREDRLNTDGLADDPKYESVPVYEQSASPAPEFSKPRSLSWGGIVLLPLSGAPQPIGSSSTPKKTFIESLSLFDGRKTDDRYWVLLLRPFPLLLNPAFIWGCLVQGTMIGWTIFIGVIIAAIFIGPPYFWSEVKAGYTYTGAFLGALAGFAIAGLLADSSVRWMTRRNNGIFEPEFRILLVIPMFIIGQIGLYGFGLTAGEVISGGYSYYVPLIFFGFEVAGMVIGTVASSLYIVDAYRDLTIEAFTVMIIFKNFFSFALTFYAYDWIIAGGVRTTLLAISSIQVVVCLTSIPMYIYGKRCRAFYHEHDLLKLTKLR

SEQ ID NO: 1263 - protein, 397 aa, Unknown
  Kingdom: Fungi, Phylum: Ascomycota
MMTHSSSHLEPLSPEVAASYTRLKDQSFDEDKCRNVLVRYCAHIPRNYHYGDGVQLVFLVLRDHLGDEHLGRAGGGLYEMIEVDCNHSDDPGAAFQRWRHDHMHRHPQANLELPHIPHLTTVSTNITPTTALVKWRAGHPDRYKIMLSDHGMGHSRTPSSPIRHRKSWTIDCTTYVSSRDGGTWPMRRLNPKEFHEMQWNPESPHRGRFVKERSLDLSEVSATNLGNETASTRPLEGDQDRNMERTTFRTRSLSDVVIRTYGKFKSYGKKTRKMEMAMLAGSQSLPRDRSSCTLLDTKNQPQVSEWEIPNASFARKFGLVADGHSLPPSIKELPVAEEKAMDKVEEATLPDARLSLGFQGPFTPQLWFDGGLDYRYRLEWPSNDLQSRHKTSGRGAT

SEQ ID NO: 1264 - protein, 455 aa, Unknown
  Kingdom: Fungi, Phylum: Ascomycota
  misc_feature (246)..(249): Xaa can be any naturally occurring amino acid
MEATQPAARSPDSDVSPTSPNTTKPEYFSAGDNGSLKITESKTTENSDNASEQKSTISFGDLRKPTDGAESKSTEIGVRRKSSVSSVTFRQPRNPSLPQGDHQITGGTRLRASSPPHDRFQQHVAFDNVPIGEPTKNNMPSLTLNVRHKGYQARRRSRTFMVGVDENAYSDYALQWLLRELVDDGDEVICVRVMEREARLTDKHYIDEAQEIMKSIIGKNEGHRALSFTLEYAVGKLHATFQKLIXXXXLQGLMNTRNSFSKYCLQYSPVPVVVVRPDEKRIKKKTKRANDVTRQTYVGMLQATHGRHEADSEASSTYELEITNSPDEEAHQVAKVLGLPARFDPTIKPISHSSLGRTRSPAPSSTLPSPEGTPEAARVTKGPASNAGDSDDGDSEDEEGEFEVLNGQNILDQQQKAEQLHKMEVGEAAALKMRVDESSDDEDDAGHTAGTKAAS

SEQ ID NO: 1265 - protein, 455 aa, Unknown
  Kingdom: Fungi, Phylum: Ascomycota
MSPGSKPFIAVEEGHGNGHPLSDFHDPASPTLDEVLRKYKRAACSGVQCPHPANAWFRDPRPETGRGQRKSNTRVLRELVTELAPDAPEVWSVVERFQSNDDLDLLKEENEASLFPQFQRLPAELQEWIWRAAIPRRWVHFAQPQFPVARYPPLPVPQVASVCRAARHVVLSGGANVVFRQHNTAGWSDDIERPPDASTTRYEQHIPAGFLNEQDLLYITQEPYLGHVLGENELAAQMDGDVSVTTWSAEKVLGVVQDAASLAVFWQDPCFYFLGQNSPDDRSGQKQIARWSFLKGCAALQTLFVNFRDQPVTLQLPLIGPTCTTPQERRWNSALNLVKLYDDDRLAQLTRLETSPTRISMPRYRYDAGKTPGGQGKHPGRCLNCERVQWELHHKHVVERFWLQLWVDELCEAERAAVFPSRKTYDASHPWARSKMKRAPEFVPVVAIRIEMQTE

SEQ ID NO: 1266 - protein, 592 aa, Unknown
  Kingdom: Fungi, Phylum: Ascomycota
MSRSRRREPPVEDSWRIVDGEHDSFDTTILPTSTSDSSDIILTQNSSSGFPSQQYGAPLGAGSQDSIRDFATHQEDEQVILREPFRPSLPPTPVRGGLRSSEPQFRMPLVDVEGDRDRRSGRNTRPARATVRDDGVRRRTGKAAGAAIQIMRHGSEGDYVYGSEVLDRREKSVRDRLGESLPTALYNVLFWSLSVIGLAFRYAQKPLAILLAIYLSLGSLIIAQNLVTKSLSASLSPLCRIPFAPALLHLPFCPDVPSSPFWSSGNGTSPPVEFDDLMNVQSHFEQVLEKSAEGVSLPLEMKKSETSIRDLRTLVRNSQIQGRDELVLEFDEYIDIARTTASDLQKFNSHVGAAVDSVISINRWTSRYIDSLDPSDTSATQTSPSFMSDFASWIFYPFTPALQPFDERLLLDKYIEHTSHVSSRISTLILEAQAVLRLLNKAENHLDLIYDITSRNSDSLSTRREQVLWNLWTLVGANNARLADLSAQLRLLRTVDYQRSTAVAQVSALILELEAIQAGLGDLRDRVAEPGLLQGAEGAAGKIPLSVHIETIDRGVERLEAARRRIRAAEDDRVREALSKGGVKDEPLLEGR

SEQ ID NO: 1267 - protein, 567 aa, Unknown
  Kingdom: Fungi, Phylum: Ascomycota
MSTVADDLLNDFGSSGDEAEDQEYDGLAQTGDATTERDANAMDVDGDQDDDEEAQNGVADLNDAEATKAKVEKMQLGAVKDVRSVASLMQTLEPVLEKIKHFRSQPATQTRNVGNIEDHPEYHLLTQSNSLSTQIDGEVALVHKFVRDHYSTRFPELERLVTTPLEYAKVVAIMGNGPMDSESIKAMQTSTNNPLGVGLKSVLDGPSLMIVTVEATTSKGHEMSPEELARVLSACEMVISLHKAKQTLTEYVQSPAQLLNAAGGLTGLSKTPACNLPSWGSKKRQAGLATNIGVRQQGYLYNSEIIRGIPNDLKKQAMRIVSAKLVLAARVDRIHSSPDGSTGEDLKTQCLERLEKLTEPPPNKGQRALPVPDDKPARKRGGRRARKAKEAVAMTQLRKEQNRVAFGKEEKEVGYGTGSGTVGLGMIGQNNDGRIRSTQVDQRTRAKLSAKSKGWGIPSSGHASSIGGFGQTPGGVDLRGKGLRSSGVGSSINGAATGTASSLAFTPVQGLELVDPKMQAELSRKRKAEEDRWFKGGTFTQAGGGSGGGDGVFKVPELPAMKRVKKD

SEQ ID NO: 1268 - protein, 785 aa, Unknown
  Kingdom: Fungi, Phylum: Ascomycota
MPSAAARQAYEDQIPPFMTVFDLDAETMADQDTVTVVNPKMVDLVSKDPEMVNTSQQPTLRSNALLTDPGAHKHTDSTSTQASESADSSPTTTFSTTDSSPLSDPSPSSSPDSPVHLIPLNNYPSTTFGTSIGSTTAATTLNSTVPELHPMSRPMTSPSPRKPRNLKGLSIQPVFSSSTAAAAPLMEPCSPSFIKPQIPAMKRKPSQLSLKTNSSDLLKTTLEVPQPLNMPPILQRRALKHSTSSPHMLSTLKSASFGPPGGMSFPKVLERNENGLSEVLRPMKSSMNTKFDVAIAEEDSPIKPQMANRSDYEPYPEPGNNEDLKSPGYPDGPIAIYDDNVYLYLEPTAEEASRFDVVINVAREVKNPFKAADNGTTASPALSQTSASEDSSPIPDTAVTTASFATAFEFQPSDDRWVETPTTPKANPLQRPEYIHMEWDHNTDIAPDLKNLCETIDERTKEGKKVLVHCQQGASRSASLIIAYGLYQNPNLSVNDAYYAAQAKSRWISPNMKLMYSLQDFQKEISRKRTPLRSGRSPTKHRMTLSADAINLSAKEPQTAPLPSLDKQEEEKEEQRSPTRPRGNSTPLRPTAVVEAASVPRNFERRAPVEQSSPPPPPMPTLNFVDLPQRPKSGQGRTESGSQIESWFKPPPTPGFNSHGSFGFQTMSFPSFRDSVSSVKNEKYADSTAIGQVPGSFPIDVEDEALMSPRAETMTSNPLHELPEVAGMRFVESPPTPVEGLFSPRASMFPRDPFTPFGRPEQVADPRSPPTKGETPIVRSIDDIL

SEQ ID NO: 1269 - protein, 285 aa, Unknown
  Kingdom: Fungi, Phylum: Ascomycota
MKSLLGFLNLVSTALAACNGHDALCSRRYSNITYMGAHNSAFDGFTPFHNQFVSVTQQLDLGVRFLQAQTQEKKGHPQMCHSHCWALDEGPLEDYLSKISDWLDENPDEVVTLLLTNIDAIPVEKFDDAFKKTGLRDYAFHPEKRLAKGDWPTLQEIIDLGTRLIVFMDYNMDEGKVPYIMDQFKHWWETPFGITDDSFPTCAVDRPNKGDPNKLMGIMNHMLNYKVLSIVFPNMDSAIKTNSEKSIDAQVKRCVDEHKVQPNVVLLDWINVGQAFRVAKTINGL

SEQ ID NO: 1270 - protein, 904 aa, Unknown
  Kingdom: Fungi, Phylum: Ascomycota
MPGRQAHGRSLTAGPPKSKNKPGKASKARSQKNALNAFGIAQDKFATRQKLTPRARQLDAQHEARDGADDEEDEDDDFDEEDGPRRKKMKGPRGPVNGDVEYGSDSEGNEWQLGGLAEDDEDSEIDSDEAFGDSDNEKFQGYSFKGSKSAKHDDEDDDTEDDSNDDEGETLGAEAIDLATALDQYESESEEEGGKDGDSESDQDSGSEGSDESEENSDDENDDEDDEADPEKLAALQGIVSGFGTSKDDGDEDGDKPARQKISLGDLGLSGVDDPHMRKSLKLLRKEDKEKRPGATKKLDVPLSRREQGRIDRRVAYDKTNETLARWDDTVKQNRRADHLVFPLPENAANYGLAMNEIRPLAPKDTTNELESTVLGIMEQSGLSLEKEKKERPPDYDAEGNPITRREAQNLKRKEREENAREAKRQKRIKKIKSKAYHRVHRRERERNEAEAAEGMELDSEAEREAQDRRRALERVGQRHKESKWAKQGARAKRAVWDDEFRTGLSEMARRDEELRRRKEGRSGVDDDSETSSEGSSDEDSDGAIRRELDALEQESEGEGRSRLDNLKFMRTAAARKRAEEKELLRGIRRTLDGEDAADLEEKEITEVGRRQYGTDSTKKPFGAAIDTSSREAPEPMDEDDDDVEVAIKTNTKATPTGGQASWSSAPRSATTEKTSSGADKKGNWTVTDPRRKRKNDESLTKTTLLDTTALTARQPATTTLSNSDSETSASESDDETAAQTSKPSESSKSHSSRSALLARAFAGDTETEAEFAREKAEVTREEDDKIVDNTLPGWGSWVGDGVSQRDRARNKGRYMKKEEGVKAKDRKDAKLDRVIMNEKHAKKNSKYLATQLPHMYESRQQYERSLRLPVGPEWVTKETFQEGTKPRVLVKQGIITPMSRPQV

SEQ ID NO: 1271 - protein, 324 aa, Unknown
  Kingdom: Fungi, Phylum: Ascomycota
MSLTKTPASLVEASRVTRLDSHTYRAHLHQAYCVAAVPNGGYVATTILRAARLHLESRDQTDTISAHWQFANKTSVGPVILSVEDAKLGRGLSVLHITLFQNDLLPQYPWVSPTSVKAAFAYITNGNIEKEEGVTLPSGWTLGPTPPPPVDLGKLSQGKDPNWTKWMHPLRPKIQSLQNVDLYLPRKGHPLKATHDVWVRLANGELWMQDDLGFLLDVGPPLIVESFRPPQGSDKVPEGGFAHSTWMWYPTIVASLEVKKRLPCAGVQWLRYRVVCKSIKNGRFDAEVLIFDIEGDLIALSHHVAMAVGIERNLKSKPKVEGKL

SEQ ID NO: 1272 - protein, 425 aa, Unknown
  Kingdom: Fungi, Phylum: Ascomycota
MARLHIPLRLLLLIVPFTTAIPASSLFARQSDDTICPSAQSRCPPSLPTGFCCGTNDRCIPLAGNTTVLCCPKDNTSDCDKINPITCNVEQQSPQKNPLAPIKTSVFDVELEKCGDATCCPYGFSCEDGKICSMNKDQDKKPGEKEEESTTTTGPSTTAPTSSSSSSSSAGQQSTSAGSEETPSSLPSDEEDQDNNDKGSSGPDTTTIIGGVVGGIAALLAIAIILFVCARRRASRRTPSSTPSGTPPSSSRPSHNRNLSNGSGPRGNIISEPIMQQNAYRTDFILKNPGTTASVASTPQIRNSVHPHISTIRDYDDQNPFASPSPSRRDSMLSTSESHGDRPSSSRSLAPIRGMRGPRTPRQQPSCESINVFADPGTVERQNRFSMGTTVSGLMIGLRGESEPERVPARKAGARLNVPGTTPRI

SEQ ID NO: 1273 - protein, 221 aa, Unknown
  Kingdom: Fungi, Phylum: Ascomycota
MDIDDILREVDPSPRQFALETRDLQALTRLWVAERSAPELLEWPQDGLFERVNDRIKDQIETVETMTGDMDPKTNFALIVIQTELERFKFLVRSYLRARIAKIDKHTLHYLSSPDLRSRLSSTELAYATRHQALLHNHYLSSFLASLPQGLQNLNDTAGNVSMIDAPDLDTAVFVRMLKDKDVHGKGTDADNTLPSNIGDVLIMRWSSAKDLVDEGSAELV

SEQ ID NO: 1274 - protein, 558 aa, Unknown
  Kingdom: Fungi, Phylum: Ascomycota
MRLTAELLVCSSRPAMRPPTLGAVPRRHLRVRVRVPAPRRQYSVRIPADSPSASSITTVADLRAWHPTANVPDVQVCGWVRSVRKSSGVRFVDVTDGSSMRPVQAVVDKKLSADMRPGAAVRLKGTWFNVKTARVSQATDGEAASDPAGQPRAQDSASSTTHELQVSEVDILGASDPQTYPIQNKYQTPESLRAISHLRPRTPLNSTLLRLRSDATALLTQFFFAEKFQQTHPPIITSSDCEGAGEAFAVKSGKEEFFRDAKYLTVSTQLHLEALAQALGNVWTLSPTFRAEKSDTSRHLSEFYMLEAEMSFVRDMDEVMDLVQRMMKALAQGLKERDAARELELNRLDSRDPAERLAFADLVDQAELRRRWRGLLVPGKWPRITYTKAIEMLRPVADRFEHEPVWGSGLQSEHEKYLAEEVGYDRELDAYVPIFVTEYPRDIKAFYMLRSASPPPQGETVDCFDLLVPSLGELAGGSMREHRLRELEDNMRLHGLQVPQGRKAAGNDMAWYLDLRRWGCPPHGGFGLGFDRLLSYLTGVPNVRDVVPFPRHHERCDC

SEQ ID NO: 1275 - protein, 436 aa, Unknown
  Kingdom: Fungi, Phylum: Ascomycota
MREFMDYVHSAFYDATSWNRDNTYAALNATSDALLNFQTPRGLRLSLSALASPNFATSYQLGSVGVVDGSISYLFSSVPLDLLVTPQSETVNLPDILRSYRPINQPQRVAPEATRVQAGRNPWLLYGRMYLPQSLLEALAVRRISPELQIQLSAVSAKHLRNGGTAVAMAQYDAGRYAGEGLASTDGGLLGLRGIYNFGSEDGAALPIVPEASTASRTGVTANGTGNGDRERIYGRFSAGGEIYYGTLNKSGGMSIGTRFATLPTHGGTPLAATLTLNPLMGNIAASYAVVAGRHCSLATRMEFNVFSYESAWAVGMELWRKPFARPASDAVVTGYPERSFQAKLEWRLDEAEALPDISQPEADLSCSIMDQQATKGDKAEEYAGVLKARLDQNLRIGLLWEGRVKSLLFSLGSGIDLKQVDKPFRTLGLEIQFSS

SEQ ID NO: 1276 - protein, 611 aa, Unknown
  Kingdom: Fungi, Phylum: Ascomycota
MDAVLRQSKAVCPFLKTASPATLRALSTTARPQASPCGGTMSKLQLYAHRCPVMGKALAVQTSRQHGIVGTIRALTTQSKAKIHTSANKEARAVDGPLFDRREKTPVYPTAPVARRSAPASVLTHPITATGKFNYEEFYNNELEKKHKDKSYRYFNNINRLAKEFPRAHMANKEDKVTVWCANDYLGMGRNQVVLNKMHETLEEYGAGAGGTRNISGHNRHAVELEGTLAKLHATESALVFSSCYVANDATLATLGSKMPDCVILSDSLNHASMIQGIRHSGTKKIVFKHNDVEDLEAKLASLPLHIPKIIAFESVYSMCGSIGPIEAICDLAEKYGAITFLDEVHAVGMYGPHGAGVAEHLDWEAHKEGMPRGTIMDRIDIFTGTLGKAYGCVGGYIAGSSKLVDMVRSLAPGFIFTTSLPPATMAGAKASIEYQMAYDGDRRLQQLHTRAVKEELEQRDIPVIPNPSHIIPILVGNAEVAKAASDMLLQDYNIYVQSINYPTVPVGQERLRITPTPGHTKEYRDELIAALEEVWTRLGIKRTSEWAAEGGFIGVGEKDNIQKPLWTDRQLGIEQASREILASGRAPAGKLTEALLAQEAGRPSVVAGAA

SEQ ID NO: 1277 - protein, 375 aa, Unknown
  Kingdom: Fungi, Phylum: Ascomycota
MELPVLLAALAAFLPLAYGAPVEQADIVLSPLVLSALERDMGLDAAEATARFTFESEAGNVIKELRNALGDSFVSAWVEDGKAIHVATSNEDDTATVKKAGATHKVVKTDLSKLEKAKKVLDDRIKQPRASNNSKSGIALYYVDIVTAKLIIDALPQSVDEAEALAKDVGLSESEFEVRQVEELLKPVTLLGGGGYAINRAAACSVGFNVRGGFVSAGHCGRAGDSVTYLDGTPVGSFQRSDFPTLDMSYISTLPSVPGPGYVGAYGIQGDQAVRGSRTAAVGAGVCRSGTTTGWRCGAIQAYDVTVNYSQGPVFGMVLSSACAQPGDSGGSFISGDQAQGVTSGAGGDCASGGNTVYQPLNPILQRYGLSLTTA

SEQ ID NO: 1278 - protein, 115 aa, Unknown
  Kingdom: Fungi, Phylum: Ascomycota
MAENGTAIPQEATNTETFAEDKGKGKAAAEAQPQTVVEDDDDDSSDDEDDEKEEPAAEEDGMEEIDLNNIVDGGRRTRGAVIDFAKAAEENPADDDEDEEDDDFQPPDEDTAMSG

SEQ ID NO: 1279 - protein, 672 aa, Unknown
  Kingdom: Fungi, Phylum: Ascomycota
MADIEDYLQEGWNPNSVTIPKLRSILVTHNVDYPSTAKKAQLVQLVTDEVLPQAARLRAQRARAHRTSFGIVNAGSAEDDSRWADEPPTPARRSKTPRKSSARVKVEEEEHAPPPATLPSKRSSRSVSRALSHADERELVEPEMAKGGRRSSRRAVTPQIKAESEPEEEEASADDDNPFSDENPFQSGSSPPQAKTPNSRRRTAGEDVIKSSRSARRRTDGFADTSSSRKSSAFSAQALREPSTELALEPGEEFTPDEQLELEEAASKGELTALSRQPRRKQGRKTNLTVPFFVLFTALLGAYAIWYRQEKIAVGYCGLGRPAQSLIPANVRLPDALIPFIEPQCEPCPQHAYCYADLSVRCEPDFVLQPHPLSLGGLVPLPPTCEPDGEKARRVQAVADKAVEELRDRRAKFECGDLVDEEGHQPDSPAIAEEELKATVSQKRSKRLNREEFDDLWAAAIGEVTQREEIEVIETPQRPGPGGSEGRRLSSTSLARLPLTCAVKRSVRLGLARYRLAIGLLILTGFFVLYMRYRYRQHVATSAQVPALVDLVLGRLSNQKVLGEEDIDDPWLFLPNLRDDVLRSVHSLSERDRIWQKVKAVVEQNSNVRTSQREGRSGEVGRAWEWIGPVAGDGVRRRKSGRVSWGADAKSESPVPEGMREAKKWDEPRPIY

SEQ ID NO: 1280 - protein, 363 aa, Unknown
  Kingdom: Fungi, Phylum: Ascomycota
MAFSFGFSGDDIDIDTEPIANPPAPKPSSVPAFPVPGRPQLPATAHDLSTLLASLPSKIAYDFLDVDLDDGTTLRLPRRELWDVRVQLMAEDDGGEGGSAGGDVTEGLGKHDVKTGVYEGGFKSWESSVDLVKTLATDKELFSPGQSQPLRVIELGCGTALPSLALFHWAAEAAKSSLKRPCSFVVADYNPTVLQLVTLPNFILSWALSNADSEALKDSFSIEGEVELGTEVLQAFQAFLNERAIDLRLLSGGWCSEFCHLVEEVSPKASERRTLILGAETIYSPFALQAFTETIFAILEREKLRQDPTSAATAIIGAKRLYFGVGGSLDDFIAAAQERGAHVASLRDETEGVRRGVVRCMLG

SEQ ID NO: 1281 - protein, 243 aa, Unknown
  Kingdom: Fungi, Phylum: Ascomycota
MASKALIPRFLLPLRGPLWRGVHIPLSQTTVCVRFVSSSGKDKPIVLEKPLKFNPPSHGSRLKRNTTPKHYGPVLTMEERAQQDRKHYPGMMAPKGTWSHWIWHSRIFHTCITLGTLLCLGIFTFFMNYAFNSPYKALVPPISDLWNRPTYFFVAWKEVITLHEKDKAQKAIEHRNASLDDHAKRRYFMKMHGIEPKDPVTMVFGKGKEESVEDLEAEVLGTPAASVGEKTEPEQKKKRFGIF

SEQ ID NO: 1282 - protein, 1205 aa, Unknown
  Kingdom: Fungi, Phylum: Ascomycota
MQQDPTATSTQHIRPGSYATTASPNHENGSLIHDDASRGNSSASARSRSRGSAHAAHGSRTPSISRCLSDEEVPAKQRLGQRITEYERALSRGSNTPQQPLGFKVIKRPDGSGNPEGAQLMDLPNEVLTRIVTQLRPDARAAASLVCKRLREVIMTPYAWQLAFMQHFPGSDVQRPKDTGQNGLWHGASDVQVSYEQPSAFARLTPQASWRSEFLLRSELMQGLSLGRPGIGKESGPGYYYKKARKSQGTLIYFPRRSSRILTHLHVLYGKDTASRAMHGSRFGGTTSISDPSTGRVDRWGDEDDWEHLLLPELLDEEPFGVGDGGVLHVPHPMDVSAAYGRLGGWGMPGGRAFFLGVHANTQRVSNRVTRYLDDGYLVDDERLDLPHIADIGDGVSSVWLAKSSDVPATTRSMIGILVGTTAGIVTAYSLAPEGSPNKSALNGCISTRWVVSPGVPIIAFKIDDQYSVRRRRQGRIWAVALNALGEVFYLDAPPHESLHNTGEKTHAQLTVDAWEAGRTAPWHLLEHTRRTRKDGSAVQERELSFGRSAVQISQLSPEQLRREAEEVKHLCRLPYWHFRDTYNGWDMQRRLEVDFSSDDGSGAGELIFLMDSGAEGCGPARIQRFTRALSIRLPSSPPVTLPKSNSSPRPAPSIFGRAPSELTLSPTSSGTSSPMSKDLARASELPHDWTAEEMSLAGHQVDQLTASTLDNSYTSLLTFSEDPLLNESRSDSNDGERSPLRAIPGGRARNLVVGTSSGAVLVWNCRARGSKEQPVQTLRVIQTTSKEITAVAATALYVVHGGSDGLAQAWDPLASTLEPLHTIHSKNSIQPSRHTQPGGRRLTKEDMNVVRAISVDPNPLLLRGCLTCGPGIHSWSFRSQDNIVKRKRRMRNIHGRPVNRRTGTEISEYIAGEEAEVIREQKERAAEFERLHRNFGLGELTEEEAIVYAQMLSQEAAEEERLRDQQALLLSESEAELARLARRSSDDDQISDDTASVDTGYISTSDVASSHDPLDQAIISQSPRATYITSVADGRGVQAMYSPGGERSSDYPITYKARQDKHRHGKKNKRQGSSSASSTSGDAAGANAISAGYSQYGHTANASFGSEGDFSVSGLSADEQLALALRLSAVEEEGENTARAGRTINGNQDDEFPSLAPRDMPGKGKGKALTAVPQESWGQGLASTSGMTEDEELALALERSMQSQ

SEQ ID NO: 1283 - protein, 1939 aa, Unknown
  Kingdom: Fungi, Phylum: Ascomycota
MPNGRHKHSIGGTCQLPEGPGPDTRGTLNFYLGLAVEDQHRSLQPVAGIAMILEVQHGTTPRLVFVHGLGLGPENTWHDDSSGKNWIEEADFVLGLGWRVRVMSFRYNSDIASNMSAASIAIHANDLLYHLEKAMASSDNIGLFFIAHGLGGAIVKKALRVRDLASNCPRVRDATTGVVFFGTPHADTNSDALLQTVRNTVQLLRRDHHAVDDDDIRHFSAAVSSINSTYISTKPRALQSISYWEEQESTWKSAEGVECSGLIVPKSCRKPDLWNNMDTSIDCQHLELPHFPSMFDPRFTRFTNDFAGLVNRVLEHKSVVIKPVKSSLGQSPSVGGAALSSRNGGRRTKSGRARSARRGEDTDYSDTEDELFSSWQKRKQYEEDRSHLISFLQSLKGWSPDNTGHDVFVATGTCEWILSSQALSTWLEFVLYGTFFWLAAPGSGKTHIAKALSAHIERTNPDDVVLSFFCRRNDPTPRIWEYFTWSLLQARPAWFSSMPKRYQGRDGNSEPLALGDYVDIWTGFRQFEGDDDKKETVWLVIDGLEACGDGPFFRFWSSLEQLRKYQADSRKPLCSLKVLFTGTLTPAMAAVAGGVSRYFVSSEFIRQDIARHVDARLNRCIDEESLLDVKDNVESLRQEIKDVAGDYWPFARDATAEVEATTGRDRTKIRSFRGRLPHRLEKHVQQVLLSLRQSVGPARYLYPILGVLVSCQGGQDLNVAQLKDALSSLHGSDQMQKVDVADLVLRHAGGLLTWTATGSLSFCHSSFAEAVGRDITESRRKANLAYLCIGYLLQDRSKTMPLPSQFTDPLEWLNENHPFYPYAVRNCVGLLVGSNGEDERLPSLFLRFFLERPPQWRAADEWLKACPDYTPNDDEFDDLALGLVIQNESLLPLLRRVCPPPEDASALSLLQRSRHRWTAWRRPSDGRTPRHTWPTGWLESQSRRGYSPLLAAARQGNVGLVRYILQWNPNVNERGGPAMSPILIMLYCSSTNGNSDQRLQRLTAITKDLLERGVNINLSDARGSVPLHVACDQASLPLAQLVLDHGAIIDVADQDGCTPWQIACERGSPDLLRELLSRGVDADALFSSGETALTFLTRRGWINSLRVVLEEADVNLVDRTGVSAVHRAMQTEGGRYEVLDLLISQPGIDLDVMQSRIHGSGNPERATALLIAVSTNDHRAAEKILGAGAAAGSLPGLRVLPLELAARHGNRGIAELLLRHHAPVNEFLITTHKRTALATAAAACDVDMLQLLLDHGADPTVEDGLRLPNAAHLVLGSPSPTVEALKLLFESPSPPSITQARCPDSEGGKTYSDLFIRACGIKDTAFIQVLLDSGIELPTWLDIPGTPSPLHAAVRAGNIEGCRLLLEKEPRFLDMFCRSGTHMFTPLHDACFYGHVDIAKFLLDKGANVKLLTPQEEKSCLLLACLGAHSEMIKVILAADPSMVHVPSYLGSSPLQVCSVRGLVKTSEELIRAGASPTTCHHGLYASISPTLFRTLGPQAVPLLRMYIKHGLNVNAPFNSYGHTPLDNAIRAAHPTVIRWMLKQGGHVVQRRRFPQKPEYWDSQLSDLGKHLPPDVIALLLTAHRNCLTDMDWQKQNALGDFGMGRPYLSELYWLCEEIRAETSQDVFADMMVEPDLYGISPVERSIGVKGCRAESRVDVVRTTVDLIDAYLLTGDRTILARIKVLLVAKLKYHVPEDITPILTLRYSAREIMLLPDDQGEVQSSVLKLHRCLTCRAGLFDKCASCVQCGHFSCARCLENEQQSSCGDAKEHLWIEFTLDVGVTFTSDVVTAALERVKTALQLSSDGGPQESLGECIKTLNLNDEEICLETRLQSSLQLAALHAFNMLAVRRPIGTKYLPLSMHALGLIAPFGRNIAQVRKWQDRRMLDEEMTMERRMEEMRYMSIGMGRTAYVDEELFRQEMILGDMPRLFAEAETEI

SEQ ID NO: 1284 - protein, 356 aa, Unknown
  Kingdom: Fungi, Phylum: Ascomycota
MAPPTPTFNLDVEAISGICGSISIACWVVVFSPQIIQNFQRGNADALSIQFIIVWLLGDVFNIIGAVLQGVLPTMIILAIYYTIADIVLLLQCFYYRGFTWKDAPAQPPKPSSSTIGEANERTGLLRNTHERRGSADWAGLSPAVPHIPETPPPAPPTALQTIAWNTTVVVMVCAAGVLGWFLGDRATSGKKDGSAPEEDNLTFNVVGQVFGYLCTVAYIASRLPQLILNYRRKTTDGLSMLFFLFACLGNITYVLSIFAYEPHCHGHEDGCAPGEAGRLYGRYVLVNLSWLAGSLVTLLLDLCVFAQYFMYSRNDEDDFAAYGTHYETIEEDSGSNDGDERPILQRGDSGSYHRA

SEQ ID NO: 1285 - protein, 316 aa, Unknown
  Kingdom: Fungi, Phylum: Ascomycota
MRYSNLAILAAATAVSAQRPADESICDYYTKALLKENTAKNQATLLTLVVNTAVIGNYTEPNVGIKVPGILAEGEANGEKVNLLPYFNGDLKSTNRNNKAVSVNFLDGGGAAPLQKNMAANDDKSNQYFLLTHLYEFFGSLLGCSQQGMSGFAAYTADPSMYDVHKFMNLNDAEMTYFITQVGMSAASFGVAEADVTAVGESLGKIFNVRCAPATEVIKAQGPQLQSICIADSCPLAENAVCDKYEKAVEPQPASSSNATASGTSTMEPTGTMKPTGTNTGTGTSTGAPGTVETGAAAAHGLSVAALIAGLAAFAL

SEQ ID NO: 1286 - protein, 469 aa, Unknown
  Kingdom: Fungi, Phylum: Ascomycota
MNLLLSDDYLLQDYPESITNTIRSGHATMLRFNRKGDYLASGRVDGTVSIWDLETMGVARKLRGHNKSITFLSWSRCGRYLLSTCQGWKAILWDLQDGQRLREVRFRAPAYMAELHPWNHLQFVASLFEEQPVLVDMTEPVDVKHILPSAPKRANTDGDAALKEKHAKEDAKQMTTSAIWTTTGDHIIAGTSKGKLNIIDARSLEIIYSEKICGGVITTMRITGSGRELLVNSQDRIIRTFRIPNLSVDDLDPDTIQVPLEHKFQDVVNKLSWNHVTFSATGEYVAASTYNNHELYVWERNHGSLVCMLKDPKEEQGVIEWHPTRALLAACGLETGRIYIWSVVSPQKWSALAPDFAEVEENVEYIEREDEFDIYGQEEIHRRRLDAEDEDVDVLTLDPTKFDDDVDGFRMPILFNLGESDSEDEFIAVSTGTMRRRSPGEGQSDGDGVTDAPPAKKGAAGRGGRSKKK

SEQ ID NO: 1287 - protein, 362 aa, Unknown
  Kingdom: Fungi, Phylum: Ascomycota
MATQTIKKEELSNLSFFLNKPNDVGYSELPKPTIQSEHDVLVAVNYTGICGSDVHYWVHGAIGDFVVKDPMVLGHESAGTIVEVGSAVKTLQPGDRVALEPGYPCRRCHDCLSGHYNLCPEMRFAATPPYHGTLTGLWHAPADFCYKLPDSVSLQEGAMIEPLAVAVHITKQANVKPGDSVVVMGAGPVGLLCAAVARGYGASKVVSVDIVQSKLDLATSFASTHSYLSQRVSAEENAAALKKAADLGRGADVVIDASGAEPSIQTSLHTVRMGGTYVQGGMGKSDITFPIMQLCMKEVTAKGSFRYGAGDYKLAIELVAQGKVDVKKLISSVVEFKDAESAFNKVKQGEVIKILIKGPNEK

SEQ ID NO: 1288 - protein, 371 aa, Unknown
  Kingdom: Fungi, Phylum: Ascomycota
MKFSSGIVALAALVTNGHAALQQISNWGTNPGGMTLHAYIPNNVASSPAVILALHPCGGSGQQYASSTRYGQLAEQYGFIVLFPSSTQDSNCWDVASTRSLTHNGGGQSQGLNTMVNWAKSTYNADASRVFVTGTSSGCMMTNVMMATYPDVFQAATCYSGVAAGCLAGSPGSSPSSADPTCANGNNIKTGEQWAQIVRNMYPGYTGSYPRLLTYHGLADTFVHWRNLQEQLKEWSTIMGVSYTRDVANTPRQGYTQHIYGDGTRLIGVEAQGVGHVVPAYEEGDLQWFGITGGGPGGPSTTATATTTRATATATSTRTSAPPATSTSQPPPTGNCAALYGQCGGNGWNGAKCCSQGTCKFSNDWYSQCLN

SEQ ID NO: 1289 - protein, 316 aa, Unknown
  Kingdom: Fungi, Phylum: Ascomycota
MATDTIMDEYLETLPSKHLEPLWSQMSLLAPSLPKPVAKPHVWKYDEAFPSLAKAGEIVPEEKAERRVLILVNPNMNAPFTTDTIYAGLQLVNPGETAPAHRHVASAFRFIIDGEGFTAVEGQKLPLVRGDVVVTPNWHWHDHGNESEKPIVWLDVLDLPLFTYAKVHFAEGYGEKRYPSEPVEVSDWRHPWSETQGALDVQPGDHAVHHYRNYAGKPLAGTLGAQAERISPGTTTTATQDIRSFIYHCYAGQGYSMVETVSGETIRLEWSSRDTFAVPAWSKVVHVNDSETEQAYLVGMHDGPFLDALALKRPST

SEQ ID NO: 1290 - protein, 1051 aa, Unknown
  Kingdom: Fungi, Phylum: Ascomycota
MAPHVSSEGPIVKRQKTSALVKRPKASDNASRIFAPFRTVGLVSPTDVPFTAIPLGGTTYQITTSVGRSLQTYDLARGLNLVFVTRPQTPTDITASLAYKEKVYAAWGGSKSGDHQGLWVYQRGRKVGELRLPSDLTQPIKQLLVFGSWLIACATTRVEVFKFATLEHYSTIQTMANTKGGNEITGGIVTMPTILNKIFVGRKDGWVEIWNVNTAKLIYTILPPSQDCGAVTSLEPTPALSLLAIAYSSGALVIKDVLLDKQILQVEAGTPEAPVNFISFRTDGAGAGNDGRKDGIMATATMESGDVTFWDLNGGGRVAGVLRSAHNPPAHDGRTSRGGVSKIQFLPGQAVIVTSGRDNSLKTWIFDQTPFSAVPRLLHTRSGHAGSVNCLQFLPSDFDGADAGNKWLLSGGQDRSLWGWSLRRDGQSTELSQGALRKQAKKTGVLSAHSLAHGPRTVSTALEDLKAPEITCIATSLNRDGGIGALPGKIKQWQKGQQQVKASDAELSGSTGWESVVTAHKGDPFARTWFWGRKAAGRWAFSTGDGSNVSTVAISPCGSFALVGSEMGSIKMFNLQSGQTRQKFPSPVTPQQAKKIREELAHASDISAAKPQDGRKFWPGTGKHTKAVTGLIVDQMNKQVVSCSRDGTVKFWDFLSGNLVEEIIWAPMTAPTMARYHPGSNLLAFACQAPSGDSSVRIVDMETKKTIREFLGGDYIINDICFSYDGRWIIAASADAVIRIWDLPTSHLIDAIRLEEPCKAVAMSSTGEYLAATLETGLGVMLWTNKALYKHVPTRQISEKEVATTDGPSLSGEGNQGMLEGAYDEQGEDEDDANVVAPNLEQLSSEMTTLSLVPKSRWQTLLHLDMIKERNKPTEAPKAPEKAPFFLPSTNGTANQAKEEKAAASTDVSGKSRITTLDRARFEELFATKLRDAAESGNYDDFVEHLKTLSPSSADLELRSLSLGDGDDASNELLHFIRALTTRLRARRDYELTQVWMTVFIRLHFDTVMERKELLGALKQWKSVQEKECKRLDDLVGYCSGVVGFLRSPRT

SEQ ID NO: 1291 - protein, 493 aa, Unknown
  Kingdom: Fungi, Phylum: Ascomycota
MASTSQSSASSPHTKPPLASLISTHDFEDAASRTLTPKAWAFISSAATDLTTRRRNVSAFADISLRPRTLRDVSSIDLSASMLGRRMRMPLFCSPAAMASLVHPDAEKAIGTACKASGIAQCVSTSASYPLRDIVAAIDAHPVDTPHDTPVFFQLYVDKNRDNTRRLIQGARSAGAQALFVTIDAAVPGKREADERVPADVPITSPLSGTAATNDAKGSSIGRTMGAFIDPSLCWADIPWLRSVAPGMPIVLKGIQTSEDAVLAMEAGVDGIVVSNHGGRSLDTAPATILILLELRKNCPEIFDRMDVCVDGGIRRGTDIFKALCLGAKAVGIGRGPLFAVNYGYEGVLKYIESMLVINIPVTCATAPPLRLLTAQSPERRAGNDNEAVWSDEPGPTSPRISEYARRRPPHPGEAKCRFGDAHQEPTVVPCLFSKCLSARSGATHHVRRPCLLPRLFSSVNSLTIDYLKRLQTMRIESCESFALNMDMLRPDP

SEQ ID NO: 1292 - protein, 377 aa, Unknown
  Kingdom: Fungi, Phylum: Ascomycota
MPTSIDKDDAPSAAVTLEDSSPTPKPKGESHSGPKNSKGWDGKLRVAKSAVLANPEALSDPEYSDDENIMEGEEIEPDEDLLDDEDPDTDEIMCAHSRIKSIPSLRLERFQKVVRICLRQNNIQDIEGLSALASTLEDLDLYDNLIAHIRGLDELTKLTVLDLSFNKIKHIKNIGHMHDLKTLFLVANKISRIEGLEGLDKLASLELGSNRIREIKNLDSLTSLEELWVAKNKITEISGLDKLSNLRLLSIQSNRITSLSALSTVPSLEELYISHNALTSLDGLESNSNLRVLDISNNQISSLAGLGPLKALEELWASYNHIGDFVELEKELKDKKELTTVYFEGNPLQLRSPALYRNKVRLSLPQVRQIDATFVRV

SEQ ID NO: 1293 - protein, 394 aa, Unknown
  Kingdom: Fungi, Phylum: Ascomycota
MSTFGKFLRVTTYGESHCPSVGCIVDNFPPGVPISEEIIQPQVTRRRPGQSAITTPRNEADLVAIQSGVEGGVTLGTPIAMIVRNKDQRPGDYKGDTMKQYPRPSHADFTYLEKYGVRASSGGGRSSARETIGRVAAGALCEHYLKLAHGVEIVAWVSSVGNIHHLPPTPEYPTASHNPKFLELLQGVTRETVDKTTVRCPDPEVAAKMEQLISDLRDGQDSIGGTVTCVIRNVPSGLGEPVFEKLEATLAQGMMSIPATKGFEVGSGFQGTEIRGSQHNDLFIRNPVADAAIKNGFAKPKLSTATNNSGGIQGGITNGQNIFFRVAFKSPATIGLPQETVTFAGETDGVLEAKGRHDPCVVPRAVPIVESMAAICIMDALLQQGGRRQAMLTT

SEQ ID NO: 1294 - protein, 845 aa, Unknown
  Kingdom: Fungi, Phylum: Ascomycota
MAPTTYRLMTVNKVPERAKRLVGRVTEILNNSQEYNIEHVANCETIAEVEQKATECKPDIVCCASMWTAEEADEILTIARSVRPDVKTHIIPHGLQVEKGPDAIVEHLVEKLPALIAHYVKNLEDEVRRLREQKERSPSARQRISNSPAPAFAQLHHTPYSSSREIGPRQDQSASPSPRPGHRTTNPGSGQQEVSEVNQHTRNVEFYGSSSVVALLSVVESASGGGGGGGGGGNGRHSSGNVGGDDDQSTAATGGNEDAAGSIVSALHNPAYSPASNNPGSTSHEQNPTAKATHPILQDSCGPPFPDPAQCHIFVLNFFSSIHYIHPILDKAGFLRELAERARNSDSSSPTDSSFDALYYAILSLGALVGPRDDEPVGGVSNVEWSRAFFKEACYFILAKVCQNELNPHLAYMYIGLAVRTALAMGINRQPRSRTARNAAQMKAETRTWWGLYSLEVEMSFSMGRPDTLGADRYHNRHFPVMETGRAAANSSSTSDLDTPEPPHCAIIKVMVDLSRIMKGIGAKIYLSDEIDLRTVDLAFTLQSELDEWAETVPAEIRPRPNPSDLVSLKSARDPQWVKRQRLVLTLRYLNLRILMFGSLLLPSSSSPNRDSAAAMMRSQNAQRGIRICIESARNTIEIIFMMYQHHDFFRTWFYNTTYVSFAASIIVVYVLKLSSHIEQTEVDDLLQVVSRAIEVLETMDECIVALKSAKLLRGAMERARSSSRHNRGALLAEPTIFSGSGVSPVISNTRESRQAAFQDGIMAANPHRLGGSGGGLDGGSSNYQAAALGQADGVRGPSPINDPGLLLNHYWGPVNFLDVDNAMAMDFCFQFDELHGGHTGVFNM

SEQ ID NO: 1295 - protein, 313 aa, Unknown
  Kingdom: Fungi, Phylum: Ascomycota
MAASHSTSGTLAPFLIRDHILNGSNAIRMPKLIYGTAWKREATPHLVIKAIQNGFRALDTAAQPKHYEESFVGDAVRTLDREGFVKRDQLFIQTKFTPLSGQGPIPPYNPTASLEEQVRQSVDSSLTNFTMDRGEPYLDSLVLHSPLPTPEETLRVWRVLETYHPTQIRVLGISNTTLPILQSLHASATIKPAIVQNRFYPATHFEAELRKWCRERNIVFQSFWTLQANRTMLSRRPVIHLAERVGVERDEAYFALVLGLGGLTILTGSRTPETMRRDLKGVETVAIWAAGEGREEWDTLLDEFRIIVGDVEI

SEQ ID NO: 1296 - protein, 309 aa, Unknown
  Kingdom: Fungi, Phylum: Ascomycota
  misc_feature (133)..(133): Xaa can be any naturally occurring amino acid
MDALPVDAVIEELLVGFNELNPTHVEELEEDPSPLEFMRSVARNTPFVIRRGASSWKAVRNWDAAYLRAALSGQSVKVAVTPTGNADAPTYSRKHDAVLLAKPHEEDRPFDQFLEFIQGGKDVPPNQSSNEVXIALQRPPDAINLWIGNEKSVTAMHKDPMENIYVQVRGRKHFTLLPPLCHPCTNEKMSATATYRREANGELSLEIDEAGEAVPLATWDPDEPDSNATRFSHLVKPLKVTLEPGDMLYLPAMWYHKVAQSCIPGGEGFVLAVNYWYDMDFSGPLYPLTTFVRNIGLSLRNDREQTGTT

SEQ ID NO: 1297 - protein, 379 aa, Unknown
  Kingdom: Fungi, Phylum: Ascomycota
MASSSAETVVKAAKNRGAKAKAPASAAAPKQATDDSQHDFFWTYTEEPHRTRRLAIIKAHPEITKLCGPEPLTKYVVAGVVALQIACAWYLRSAPFFSLKFWAIAYVIGATSNQNLFLAIHEISHNLAFRSPMANRLFAIFANLPIGVPYSASFRPYHLTHHKSLGVDGLDTDLPTAFEAFVLDSILGKAFFCTFQIFFYAIRPMTIYRIQYTWVHHLNIVVQLAFDFALYYLAGSSIQPVLYLLLSSFLAGSLHPLAGHFIAEHYVYESVTPEQRDPKNSIPVPETFSYYGPLNWFTYNVGLHNEHHDFPAVPWTRLPAVREIAKEFYEDLPRHDSWIYVIWRFIWDENVGMTCRVKRKNGGRMVGAAASWTENEIQA

SEQ ID NO: 1298 - protein, 156 aa, Unknown
  Kingdom: Fungi, Phylum: Ascomycota
MEPRARAGKNVGKMNFPHNELAQLLFAHGDVRNPMPETVRVLDEILTDFMQSIAFEATRAANYSGRQKIKYEDFEFAFRKNPNFLGKVQEVFEKQKEIKKARDLIKEGDDEIMKDAIEEEEGKKKDKSSAKASRVEEELGEGDDDAEADADIGKKK

SEQ ID NO: 1299 - protein, 531 aa, Unknown
  Kingdom: Fungi, Phylum: Ascomycota
MTSAWLTNTGFTPPATPSTSTAGLLQVSTLHWIGLVTVLVDAASHWGASQPRLRQPLVPADHSSRHRAALPFPSITTCIPSSSTKGRPHSPTMANQTPAVVMDNGTGFSKLGFAGNDSPSFVFPTAIATKGPAGGGGGSGSGRPAVANKPSFLTGGAGSGGHLGAKRGTEDLDFFIGDEALAASAGPGYGIHYPIRHGQVENWDHMERFWSNSIFKYLRVEPEDHFFLLTEPPLNPPENREATAEIFFESFNCAGMYIAVQAVLALAASWTSSKVSDRSLTGTVIDSGDGVTHVIPVAEGYVIGSSIKSIPIAGRDITYFVQSLLRDRGEPDSSLKTAQEIKESYCYVCPDIVKEFAKYDRDRSRFAKHVVTHPGGRQVSVDIGYERFLAPEIFFNPEIYSSDFLTPIPVVVDNVIQQSPIDVRRGLYKNIVLSGGSTLYKDFGRRLQRDIKQLVDARIRASEVRSGGARSGGLDVQVITHKRQRHGPWFGGSLLGQTPEFRSYCHTKQEYQEYGPSIVRRFSLLGGPGGS

SEQ ID NO: 1300 - protein, 1545 aa, Unknown
  Kingdom: Fungi, Phylum: Ascomycota
MTSRTPIGGQVRPPQRTLSASSLSSVQRPSQQQQRTLSQQFIPSSPVRKDAASEPSTHDLTVGSSEMANPNTPRLVKGSKLRQELSVETMGSSGWLPDVPSPLNTSTPSRTQVFVDPTDAGRHSPAPSRSSQLDPDNLPMPMPQRRPRTQPPLHRTQKNDLAPAPVKKDPRPKPYVVEIPSAAPRCPPPHKQDKPPRDPFSKGLYSGFADFHPWTGKHHEDEWSSEGIQKGTWDRGTQNETSSARVAIYTPLRQQKSGLNALSQLFMTVMNQRRAKGQVTAASTFKPPPRVTLTDTKREVWMKELANPAMSLRRLSRTIPHGIRGRTLLDQCLNKNVPTERAVWLVKCVGANEIRAVKRKGVNGAFIMGGELKWIREWTVLVETFVESIVSSFNDTEWKAKVVYAIRLATHLYNDQLLERDHYLDWVLANLENSSQAKMPLWLLVVQIYQHDIMRLRKQGRRLAFVLCMHLNTISNDPDRDILIQLSDKIVGLLSALLKHCPESFVNPLNWSKYRHMLRTFFNPGDRDLHVAYQEVDARNNRLSTSTTTTAPAGRQQLVAALDATLRNPIDDTLATRCWETLEDKDEIVRTTIQWATSRHRPGAVKVLVSANLLRAWTSSLGATLTTQILLEIDCISLEDGIRKDLMYHLVAELVRSGHFSMPRYLQWLIARGGYHGASEIDRVEGPCGMRLLVELPLDSIAEEWKRERANLLRRAGGYSTADEQLDISMALKHVAHTLGIPGPPHDPVFQRKPLSVQKLLVRLGKSSRGLRYAVGAYLRDIVVNQSSASKGSFLLPMVLLTSIRTILERLGDYQMLSEILLACRHASDVDLLASCVDTINRNLPTLLATDTGGQLLDAYVERLRMLYAEHPLPARPLLSALAHLATRIPNRQNLASDLQHQLLQSDRTNPIDACSPVSDNMVTQMHTAESELSEEIEKLFGSGNVIDQPTMNRLFRTMIPKLDAGWKKLDDTRRVFASLLQRLRIYDTKHFDKLLADWISHIRTLQSRPPLAELYPLLVSLGCLPVATLLHTATATQTDQGSSARAASVEARPPSATYLQELLQLMLLELDPPTVLTADETYRFGIYQQSARLEQSKGLLALIRNAIAEHSLIRNIPGPKLPLDEDSLQNQVLETLQLLVVGDADAVSTALSIKTLPPEATQLVCHLTNRLLVPSDKNGSNATFDDVLSLANELTMPFCQLKLNMDLSIEQPPSPSPTMDEPQSHSRFDLFAKAMDRAIEADNISWTRMLPCLSNDITLHLKSQAYERFLAMLPSMKSQTAAADSTSGERIRMAENLLGVLSVIVSGQPPPNAAQLTQTMVEKLSDLWEFVAARDETLSSAQSVVIGSWLPILLQFITLHSVSASEAMPAPSTIAAAGKAPPPPAQEARARIILVLCGLLLDLESRPNSSTSTTPSHIFDTATSLVDSLPDDLRAHCIKSILLTPGAPSSANLSTDPRLYYLLSAPALSPVDGLLLGRRREMPAQPHSSTARLFGNLYGCGPAMLDRFSPFVLKRWELLSEPTPNVGENDTSLSLGLFEAIKIQ

SEQ ID NO: 1301 - protein, 1154 aa, Unknown
  Kingdom: Fungi, Phylum: Ascomycota
MKFGRNLPRNQVPEWASSYINYKGLKKLIKSAAQKAKLGEPVDPAEFFFALDRNLEDVDFFYNKKFGEACRRLNLLHNRYGRIPDVVATLDRDEVEEVMGALLELRSQLRNLQWFGEINRRGFVKITKKLDKKVPGIPTQHRYISTKVDPKAFAKDGNTARLLSEINRWLSILGEAQTFDDSTSDRSTRSLGRVSNKAMLKLPQTQLDILDNAVRTDSLESLKEGLHDVNTQNSNESTQTLLLNLLQRSISGRSRKCITYLLENLQDLDESEDINGRNCIHRLVIHIGRVKSAPQHHDANSYPVPVGSAFDHRHPQGTVPNAANRKPDTLVLLGKDDEAIQILMYLLDNLRPRQRGALKARDSFGRLPLHYAAQYGFVVVCQIIMAKMQEWDQFDSKDGIDAPEWHDHDGYAPLHLSVMGGHALATEALLQGENWQGSSDSKDHIRKTASKSGAVLAMATKSNFKVIVDLLVNAGVDINWIDQQGESALHLAARFGHHECAAIILRGGGKQKADLEIAEKSYAWTPLHVAAVDGQLRIVEMLIEAGSDLAKPDSSGWTAKEHAALRGHMSIARLLAKHTKDEGPQTRTSPSLTPTNPPGALSIGERRSNGTSNNGNLRASAEPVKTFGHRYLTNESLVLVSLGSMDMRKTTEAVSLDQVPLTEAHNTQLDTALSVVVSANGAQGEPSIIDLPVSENISTEPIVFTTKEFSKVKLLFDIVPTYSGSEKNKIGRAVALLSSVKPTIGSQRMNLQGDVCVPIMSSSLDVIGVVNFNFLVITPFHHPRMEITSRQTYWKKLESTMLIGHRGLGKNITSNRSLQLGENTLPSFIAAANLGAQYVEFDVQLTKDHVPVIYHDFLVSETGIDAPVHTLTLEQFLHINPDSTRNGYHSNGHKTRVDSVKRNRSSSFTPRRTNSVGFIGEQNDELEERMKHTRDYKEKGFKANSRGNFIQAPFATLEDLFRKLPEHIGFNIEMKYPMLHESEEHEMDTYAVELNSFCDTVLSKVYDLAGERHIIFSSFNPDICLCLSYKQPSIPILFLSDSGCSPVGDIRASSLQEAIRFASRWNLLGIVSAAEPLINSPRLVRVVKENGLVCVSYGTLNNDSTMVQRQVKEGIDAVIVDSVLAIRKGLTTHSAESAENSDNGAKSDGESAVL

SEQ ID NO: 1302 - protein, 513 aa, Unknown
  Kingdom: Fungi, Phylum: Ascomycota
MPTAPVDSKPASVASSKPSSLKSQDAPAKSPLVTPQNGASSPVNGATSPLPTPDGSLKPLEPKTSVKGRFSRMFSNKGDTPKVNPPAQPAAAPSQQAESSGRSRGSSVNGSSVNGSAAPVPQRENSQRKESSSDQGSDRSATPVKSQRFVLIPDSQGGGHEHHLKSSRRQEKLSDMWRSLIGKKQEPQPDNDLSLVSSWVDTLRQEKEAANNEKKTGVPAPTTLVEKYGKCQEIVGKGAFGIVRISHKKLTTGNGEKLFAVKEFRRRPEETEKKYSKRLTAEFCISSSLRHPNVIHTLDLLKDAKGDYCEVMEFCAGGDLYTLVLSSGKLEVQEADCFFKQIMRGVEYLHEMGVAHRDLKPENLLLTTRGAIKITDFGNGECFRMAWETDAHMVSGLCGSAPYISPEEYTDKEFDARAVDVWACGVIYMAMRTGRHLWRVAKKDDDEFYARYLEGRRDEEGYGPIESLHRARCRNVIYSVLDPHPTRRLTAAQVLRSEWVREIRLCKAGEEGL

SEQ ID NO: 1303 - protein, 469 aa, Unknown
  Kingdom: Fungi, Phylum: Ascomycota
MSFGYASGVIGPTIAQPSFVAYFDLATRSNTTSLISAMNSLFFAGAAIFILTIPFFADKWGRKAAVGVSAATIIIAGAVLAGSVHVAQFIVFRFVSGAGTYMMISSVTLWMTEIAPPSVRGVFVGLIGASLLLGYSSSVWVGYGFLFLDSPDAWRAPFVFQGLPSLILLGLLYWLPESPRWLMIQGRYDDARENLLKLHTPEEVAVEFVQIRTQVEIDRTLPSSYWAMFTNKNYRKRTIIGMGTFASIQTSGILVINNYGPMIYGALGFGLETQILYAAAWLTLGWGGGCVALLVVDKIPRPKFIGYGLIACQVCLIIEAALVANFAGSDNKAALRACVAMLFLFVFIYEFALDSAQFVYLGELFPTHIRAKGVSLGCGTLALMNVMWLSVAPTAFEAIGWKFYLCFIIPGFLCAGLILYYFPDTLGLPLEEINAIFEDKKSIVGIAEEDVSIPYPEKSSDAKSPDSNV

SEQ ID NO: 1304 - protein, 221 aa, Unknown
  Kingdom: Fungi, Phylum: Ascomycota
MCTYAVARFSCRHEIWGRRTKLCTIGEDFRDGHLEADCTIRGTHPLKTMLVSDPCYNCFKIKALPMLCREKLQHARSVFKERWPEELPSKHADSMASLEQEVEAQLLEAKVDLKDQASAITRPQRLLRKRVKSVPISGKETSNTPQPKGGLPAVPKITPPKGVTALPTLKTASSNTTPPRLSRLALPRKKTPEKSVAPPKMSTDPPEKVATKLPKPGFLRK

SEQ ID NO: 1305 - protein, 317 aa, Unknown
  Kingdom: Fungi, Phylum: Ascomycota
MIDQISIDVVVAALLPSIDSHQKKIERAFCLGLSGLQGSGKSTWAAALAHRLTDKHNLHTRTISLDDLYLDHDDLLSLKQNNFGNKLLQARGQPGTHDEKLAQSFLTEVLAPSLGSDRRARIKWPAYDKSLNNGQGGRVPVSEWELVSLDERLDVLIFEGWCLGFQPLPEDELREKRRMSESSPPSQTQKVTERLTETLQFHDLEHLLLINASLKRYCETFMGPETFDSFVHLTTDDLSRVYCWREDQEEALRRKGKPAMAKEDVIKFVQGYMPAYELYLERLNERSLFQSSPLAVGKKHIRVVLDNNRNVVSTNVL

SEQ ID NO: 1306 - protein, 335 aa, Unknown
  Kingdom: Fungi, Phylum: Ascomycota
MGSEINAWTYGPGGYPAGLKQVKINTNTAPLRPTEVLVRVKAAALNPVDVQLMNYPLLPSIPSLLVPVKGVGEDFAGVVEQAGRESGFKPGDQVLGIIFPFPNGTLQEMVRLDTARSDNAIVRKPQDWSWEQAAALPLAWSTARTVVQEVESYVGQDGHVAILGGSSATGLYAVYLASQRGWKVSATCSAAKAELVRGMGANETIDYRTCSVADELAKTSPDAIIDCVGGTECIGLAKRYVTIVGDKTSRVSLGGSATYLFYPQMVWRSLKGLLGLGPSYICVNFKIHRPWLQELLSLPKEKIIIDSVYSFDEVRGAYARLNTGRTQGKVVVSME

SEQ ID NO: 1307 - protein, 512 aa, Unknown
  Kingdom: Fungi, Phylum: Ascomycota
MSTLDEKTAPTPSSAPAPAPGSHQAASFDGPAEPMVIDRPGGWMYKGFRIFGREYWYASPKIQLLMVSFVCFLCPGMFNALGGLGGGGQVDPFAQNVANTSLYSIFAATAFFSGTVANVLGLRITLSVGGLGYAVYAASFLSYNHNQNMGFIIFAGAFLGFCAGLLWTAQGAIMVSYPPEKSKGRYISTFWIIFNMGAVIGSLIPLGQNIHKKAGPVTDGTYAAFIALMAVGLILGLFICDAEKIIREDGTKPIVMKNPTWLTEFKGLYETLKNEWWIIFLFPAFFSSNIFYTYQGNGFNGSHFNTRTRALNNVLYWLAQILGAIITGFGLDHMKASRSLKAKISYGMLIALTFIVWGGGWAWQKQQVPRWRTREDDWEDMKVDWTDDGYVGPLFLYFFYGFFDAVFQTCMYWYMGALSNSSRRSTFYVGFYKGLQSAGAAVYWRLDSWYTEFDVMFGSTWGLLGGSLIIGAPIIWLKIKDHVSLEEDLKFSDETVEDVIVGRDIKKGEETA

SEQ ID NO: 1308 - protein, 721 aa, Unknown
  Kingdom: Fungi, Phylum: Ascomycota
MDRQSVYSTHVYEPSQGESRDTRLQLQAQLETFILDFRLDNNFVYRDQLRENALLKKYYCDVNINDLISFNEELAHRLASEPAEIIPLFENALRKCTHRIVFPHEKQVDLPDHQLLLHSDAEDVSIRNLDSMTISRLVRVPGIVIGASVMSSKATELQIQCRNCQHSQYLPVLGGFTGVTLPRQCGRSRVANDQTPKCPLDPYFVMHEKSRFVDQQIIKLQEAPDQVPVGELPRHVLISADRYLTNRVVPGSRCTVMGIFSIYQNKASKNSSTGGAVAIRTPYLRAVGITTSVDQASKGHAAYTEEEEQEFLEMSRRPDLYNIMADCIAPSIYGNRDIKKAILCLLLGGSKKILPDGMKLRGDINVLLLGDPGTAKSQLLKFVEQAAPISIYTSGKGSSAAGLTASVQRDQSTREFYLEGGAMVLADGGVVCIDEFDKMRDEDRVAIHEAMEQQTISIAKAGITTILNARTSVLAAANPIFGRYDDMKTPGENIDFQTTILSRFDMIFIVKDEHTREKDERIARHVMGIHMDGRGAEEVAESEISVEKMRRYLTYCKTRCAPRLSPEAAEKLSSHFVSIRRQVHAAEMEANARSSIPITVRQLEAIVRITESLAKLTLSPVATEAHVDEAIRLFLCSTMDAVNQGSNQGSRELNEEVNRIEAELKRRLPIGWSTSLATLRREMVEGKGYTEQGLNRALMVLQRRDTIMFRNQGAQVYRNGA

SEQ ID NO: 1309 - protein, 926 aa, Unknown
  Kingdom: Fungi, Phylum: Ascomycota
MRSTWLTLGLLVAGVIAQTGPGSTRRVPSNGRRFRRDELDDTEPGENDVVNQRFIVEFTGDVQVASAAASLAKDSNIEVLQVFDSDVFRGCAIKALEDNLDSIQERPAVATAWQSRKITLGNPQIQEFGKELQVDGYSNHHMTGVDELHKAGIKGKGAKVAVIDTGINYRHVALGGGFGPGFKVVDGYDFVGDGSWPTDGHAKEPDEDPNDQAGHGTHVAGIVAGESEFFTGVAPQASLYAYKVFTEIDGTDEETIIEAMLRAYEDGVDIITISIGSVSGWPDGPWALIASRMVEEGVLVAVSAGNDGGPGAFAANGGASGHNVLAVASVQPDVRAVPSFKYTATLPEEEPEDAWIPYDAVSNWYPTQVKGWPIWAFSLDGLDNEACEPLPEDTPDLSDVVVLVRRGGCLFDDKQINLEQYNATHVLFYSNEMPLTKPTSRLARSKSAMITADDGKAIIQTLSNGGNVTVDFDYRPDLHTVAVKNSELAGLASPFTSIGPTNDLNIKSDISAPGGIILSTYLGDGYAIFSGTSMSCPYVAGVAALYVGQFGGRDNNQKGWAKDLAMRIVSSGEAFAWDDGLLEGNTYDALAPVPQVGTGLVNASKVLRYETSLSFAKFALNDTAHFSRYQKVDITNRGKSPITYSFSQQDFGALATIITDPDAWGTPRMAWADEMMTIPLEISPRISFPRAGFTVQPGQTRTAQFDFHLPEGSYDPKTLPVYSGKVIITGNNGEVLSVPYMGLAADLKRDVAPMIASLDPYPTIKSGVDGIDIEDKSNFTFNLDLDKQDFPRMVCRSLYATRELRWDIFESSWRERQWRYPPKVGEQGYVGSIASWARAWSSTVFDPEIHDPDEVTNLPVTSVPRSLAGKRGLDLWWLGKLSNGTQIAPGRYHMRIAALKPFGNPKAADNWSIFETPEIEVLPPVA

SEQ ID NO: 1310 - protein, 415 aa, Unknown
  Kingdom: Fungi, Phylum: Ascomycota
MPSTCHTAFNRGKSLHWLLATALCAGSLISPATAQSLSDYQGGEQIWQSKYFPKHKRIALPAKRGPPPEDWDGKIPLVITNRCDDTIWPGITTQSGTGPGTGGFELVAGNSTRLWVAPDWQGRIWGRTNCTVDGDSCSCQTGDCLKKLDCDASGEVPATLAEFTMEGGLHRGQTFYDISLVDGYNLPMGINYIPAKNTSFIPPNLTNAACIATPGWLYKPNKTGTYYSNSTFPIPLEDSESNESIKRWCPWPYLVFPPTKPGDGVYPYPDDDIQRPTFSPCKSACAATGRDSDCCVGKWHDPKKCKPGRYSNSIKAICPDAYSFAFDDQKSTFIIPKGGGWEVVMCPKGRSTNILHQLFQEMDELNTNGNLSETSLKRLRDVQYITSDRDAASGVRPMLSRLGIIALTLGMWFVM

SEQ ID NO: 1311 - protein, 205 aa, Unknown
  Kingdom: Fungi, Phylum: Ascomycota
MCPNLSDCTLKLQTSLKSSGLVPGPAEALVPQDFTPTTALNVSFDGRAVDCGNLFRAGECKRSPSISFAPESPQAKTSPAASYLLMLVDPDAPTPEEPKFAFWRHWVVPGLQPTGGDGAELVAETKRPLTDYLGPGPKDESTPHRYLFLLFQEPAGLDLPKEAVGGEEFAQRRSFDPVAFVKAHQLKLVAANWMRGAGDGWTKEQ

SEQ ID NO: 1312 - protein, 377 aa, Unknown
  Kingdom: Fungi, Phylum: Ascomycota
MDAIENLLEWAKAGGVEMNGIAPKPLPGRGIGFVATRRLEVGEAILVVPSALLRTISNTRKPILRKLKGTSVHGILAASLCLEKDPAFEVWRAVFPTKEDITRSMPFYWPRELQDLMPEAGKVVLKQQQTKTAKDWKRVSAAYPEIEEADYLYNWHLVNSRTFYHVTPKTEKLHKDDHMVLQPVADLFNHDPNRGCSVAFDANDYTITTKHTHEPGDEVFIQYGNHSNDMLLAEYGFILPSGLNRWDETTLDAYLCPRFSATEKAKLEEAGFWAGYKLDSDTPVCYRTQVALRALFLEDRQWKQVVSGIRGEDRDREAADKELLAVLRVYEKDIRATLKRLDALKIGEDGARQALRSRWLQIKELVVSGIAGIEHER

SEQ ID NO: 1313 - protein, 1047 aa, Unknown
  Kingdom: Fungi, Phylum: Ascomycota
MVWIALLLLCALQPWTAAAMRADYLAQLRQETVDTFYHGFSNYMKHAFPEDELRPLTCSSLTRDRDNPGRIELNDALGNYSLTLIDSLSTLAILAGGPQDGRYTGPQALSDFQDGVAEFVRYYGDGRTGPSGAGVRARGFDLDSKVQVFETVIRGVGGLLSAHLFAIGELPIPGYEAKPLDGFPTDDPLGLPPIPWPNGFKYDGQLLRLALDLSQRLLPAFYTTTGIPYPRVNLRSGIPFYVNSPLNQASADTAEPEGRPEITETCSAGAGSLTLEFTVLSRLTGDPRFEQAAKRAFWEVWRRRSEIGLIGNGIDAERGLWIGPHSGIGAGMDSFFEYALKSHILLSGQGMPNASTSRRHSTTDWLDPASLHGPLPPQMHSADAFLEAWHQAHASVKRHIYTDRSQYPYYSNSHRATGQPYTMWIDSLGAFYPGLLALAGEVEEAIEANLVYTALWTRYSALPERWSIRENNVEAGIGWWPGRPEFIESTYHIYRATQDPWYLHVGEMVLKDIRQRCYAPCGWAGLQDVRTGEQQDRMESFFLGETTKYMYLLFDPSHPLNNLDAAYVFTTEGHPLIIPKKKNSRPQKAPRGNRKDVSTYSYYDEAFTNSCPAPAKPDSLSGSITAARPHLFDASRFTDLHNTPNLHGPLEMVQIEDKKKGRIIQRRALSNHTLFPWTLPPSLLPQNGTCAAPIPRVISAIEFPASDAASSLMSKFGASLVWYNYAGPTVKNLEGLRLQLEREPGDDPGGDNVWRITHVGSTQLGRHETVFFHAEHVSHLKDEAFTCRRRRDSVEIELLVDVPPQQNATMPIVADSTAPPTQSASDDDAHDDLIPIPSESLLKHLLRAVSSVFEPSHTDAPSADEPSAAATILSFFGHTAVGAGAHPVPALAADTPILGSPGYDATDPAANFPWTTIYLAGHACDGPLPDAAPREHQLIVMRRGGCSFSRKLDNIPSFSPARSALQLVVIVDEGDEGSRLDAGVDRPLLTSEQRTPKGMKRVHGVPLVLVGGERGDYERFGEAVAAGMRRRYRIESQGLVIANAVVI

SEQ ID NO: 1314 - protein, 299 aa, Unknown
  Kingdom: Fungi, Phylum: Ascomycota
  misc_feature (71)..(72): Xaa can be any naturally occurring amino acid
MESPFPKSSSAAGDGKIVAKLLPAGGTGLETMLYQYPLKLISPSTHSDLKSVLVFLLSYGGGLVGAEPRDXXMNVHIGSGGALCLLPDPVQPFEHSVYAQTQIFHLAEGASVCVLDWVTQGRTARGEDWDLIKWTGRNEIWVEHSEPGDRRKDRLLVRDNVVLSEPGSAALGRSLRTSMHKLGIFGTLILRGGCYSSLGDFFLAEFDALPRIGERDFRSADAKLKEDTNKSEHDKWRARRNEQEKINGLLWTAARVRGCVVVKFGASSVEAGRDWIGTMLSKEGSVESQFGSDALMCLR

SEQ ID NO: 1315 - protein, 834 aa, Unknown
  Kingdom: Fungi, Phylum: Ascomycota
MPQLRRPPVPAVVFFFFIIWLFIPGDDLPAQAIILSDVASQRIESYHDALDILNQTRWGDFAPGRDAEHAATIGDGFLNLTGFRGEKDGFAWEDLERFRERGSELSHYAVPPVDGQQLWDVAAGEAMWTNVSGIVQGDWVRKPGSVVKRYDEYNLTDSVPGLDWMGDKADWARNITGNSGSILLRVDGNKTIEVYEQLAVDEAPLGGGLIRNVKGTATIEDTTGSGHTWEMRLWGVHWPRQGVILMTTTSEKFEGIFGLPHLTPSADYFQSSQRLLNSTLAGVIARKEENVLIDQTMPWNSDIDNPLYSAYPSPHCEFVVYAQVHPPLLQNHEMTPLESERVMHAIESELEHPMGAPIEKIPRLRMSTVIYSPDCGFFLESKGPPDFPPGQAQHLVGLRNEVHVHHIKTWLLMYALVVSGQVFLLKDQMKETFTPSTMGRVSFWTISVMVVVDGMTFLAAATWVSSAASTFLPTLALMFAAFLSMTIGGSFLGKIHEVQLPESRNRQAADRTTSNSGNTTSTPSEGATPGPGASLLPGPVTATPAPSRVNLPQDQTGAAPSVADGASAVPNLARAEPEEAPTQTPRQAFQDIIVRYIFTGLCLSALAISSTTWYPVLRSIFLNLCAFSYLALWLPQIYRNVIRNCRKALRWRFVVGQSILRLLPIAYFWIYKGNFLFATTDLRAFAALSAWLWLQICVLAAQDMVGPRFGVPVGWAPEAWDYHPVLREDNLEGGGLPIGLVADDNPGLDRTHEGHDDQQKRRSSARVIDCSICREILEVPVVNAGDETTSVANAFARRMYMVTPCRHIFHTECLEGWMKFRLQCPICREELPPL

SEQ ID NO: 1316 - protein, 84 aa, Unknown
  Kingdom: Fungi, Phylum: Ascomycota
MNNSALDDWEPWPMMAGKHEAIRDCHWGKPAPFPPKLAGDLGTDEAEAGHRRTMDTAQPGGAHAHTIFPGVPGYVRLMVAGKSA

SEQ ID NO: 1317 - protein, 221 aa, Unknown
  Kingdom: Fungi, Phylum: Ascomycota
MNTHATPRPFPVRSIPGGPTQQHQQSLHQQQQQQQQQHRQSSAPPQQQQQVTEDEYALIPEEDRMHIDEVFDLMDMKKKGYLNSYEFRHSLAALGFDLPKPTYFKHLESYGSIPADWPSTSAASSCPVNRLIMPLDQFRLCAARLILDRDPREEAAKVFNMFDYDQDGIISLDDMRRLAQDIKEERAMSDEEIQGMIEYLDHDGKGGVNLEEFIQMMEEAG

SEQ ID NO: 1318 - protein, 225 aa, Unknown
  Kingdom: Fungi, Phylum: Ascomycota
MTDKIKYAQVDSDASEDGEGFRRPARQHRGWLSTLSSFLLGLATMGAVMALYSALTMPAQHSHARNLPHAANGTDPKTGLPLSWSHGDCGNSPEDAKARGCQYSIVLHSWLPESCLTDDDAQDAKDMYHGRHWPYEIASGRNLTMEELGAGDYGHFTTTFDWHVTHCMYVWKRLHRILMDPTLELDSYTANYHHTSHCVKMIGGHPEGMKDSGTKIFVKYPKCAK

SEQ ID NO: 1319 - protein, 520 aa, Unknown
  Kingdom: Fungi, Phylum: Ascomycota
MATFPLLQNSPFAALPSLKVGASYAIISLFTITTIYLVQNEIYRYTRRIKKLPGPRGWPVVGNLFQETTFLILSLEKKSDEIPAETYRKWATTYGPVFQIQLGNTTAVVVNTADAARKLFVTNRTGMMSRPIFYVLHKKVSKAVASIGTSPWDESCRRRRKLAAAALNRPRVESYAPILNLESRELLRDLLSVLSKGSDGDGDVDFRPAVQKFALNLSLTLNYGTRVSSANALHEDPLMAEIIQVESAVSRFRDTSRNYANYIPILRYWEPVAAVLRLGSSPAGYASEIGRRRLAYNDVLLDRLKDQVSNGKDKPCIQGAVLRDPESATLTREELISVSLSMMAGADSNQPTLSWAILLLAHRQDVQDKAFQAIKESGVLDLPSDAYAATNVTYIDAFTREVSRYFAVLKLALPKATYTDVEWQGATIPANTLVFLNSWAINRDPSKYLDDLREDLLVHFANHGHADPALFTDADVFAPERWLPGSPDHQAHQYAFGIGGRMGRRRKRSIRFWVCKGDLS

SEQ ID NO: 1320 - protein, 392 aa, Unknown
  Kingdom: Fungi, Phylum: Ascomycota
MASSESYPSSDASVTSANRPMKPAELLSAARQQVDSLAPNLDLSTALLARFPWNHGPNLVKHTSVAMLASARASMTRPITDREAIAVMRATRAKVSAEGQAHWLSVVLAGALWVKGIKTCRFPFWTPKKPPFGGGPFTQTMRMMAYSMVCMFAMRPVEQAIGAGFAMSSVKEDREVMDGLMKAVMEGRRSMQGQQMGGMGMQGMLGQQQQSQQQEAQSATYTTRWPADDSTQSQQQGSGSYGSRWPEDPSTQYNQEQTQASYQSSATTPEQQASDRWASSSILDDASPIAPEESVQNQQPSTTSWARLRQQARADQPQQQHGSWQQVRKSGVDQKQNGWEAEDGQRSGQPRDSYTYSAADVERDTAKTQAQKEFDAMLERERRGDAGAERKW

SEQ ID NO: 1321 - protein, 328 aa, Unknown
  Kingdom: Fungi, Phylum: Ascomycota
MSKSLKVGILSMGEMGVGIAKLLIAHGFPVATNCQGRSQDTIDRAREANVELLSSDLELVDQCQLILSVVPPRDAEATAQRVIDALSGGPKREELYYADLNAVAPSTCRGIAATIEKARVPIRFIDGCIIGGPPRSKDAPDPGTNQTASDDSHASWKRPRIPVSGPDSLADLPDGVEVADVLNFRVISPSIGAASGLKMCFAAMTKGFTAIATQAFTTAHSLGVADELHTEMAELIPRQLQTAEGSVPSMVPKAYRWVREMEEIAKTMEEDGGWTRGLFDGAAGIYREVASDLTLKEEKSGKRKRGTTIEEVATIMSEGLQKKKKKTV

SEQ ID NO: 1322 - protein, 1125 aa, Unknown
  Kingdom: Fungi, Phylum: Ascomycota
MILTSFAAGTWLQIYALEIWSCQKLRQHPTANFKGSTTSPTTPFITNNPSSPASHATVAHWRIIRHSLRFQMHAPGIPALPKAAWAARIPRAAAAGLPTRHASPTRQPGRPDQGLHTYSRTQRIRPGLHTTREPIPRVSRSFHASAMRSAATEAGAAPTSEGDGTGNPKPGSGSPVLEQEGDMDSQVLTGGRSKLSAANSLRSRQARRRNASVLPPVHLPPTFLEQNIQLHHQTNQPNMPLPISYNAKKTSKPSAALPKRLSEADRRSREQYFQARIRVLTERLLPLHNKDAPTQAGDITSAVSQLQYVTRLQDILLEDMTQYVAALSNTSKPSEKPDSPPYWLWEDIGGVLQKSQPFVTKQELEDAIERQMLLAQHFDLTPTQTMSDFDPMTFEHLKRHLQVELDTKPPTNFDPKTSKRPISILLTSGYSGKAYSSAIVRNMAHMTPANLIELDAYDLSSIVGTYLGQDPAYSRGSLSMLGYRAAELNGRLPTPESSPGKGVRSSDDDDFMESQFITVRGPSAQSEELQKINNGDFDVFSKWDGLKIDKLLDQILRSPEPKTMGGSAQQKTIVHLHDYVELSMTLEGSFLISRLRALVDAAWHQGRHIVLLGTSSCANLSEEYQNMVREISAQDTVVTRHFHEMWRLDRWDVERADRFLENVTNIKRMIEAMDPTHGQSAFKAKEDILDFAFKLDSSEGISRFLEEILPAPEVYRVAQVYRSQLLRDIQKKSDAQHEISALVDSSSLLPDAPLAGRERVRRSNMDNDSVKNKEESSADQPELDPTGLRGLNEYEKRIAGGIISKDKLHVTFSDVHAPHDTISALKLLTSLTLQRPDAFSYGILKRDKINGCLLYGPPGTGKTMLAKAVAKDSGANMLELSGATINDKYVGESEKLIRAVFTLAKRLSPCVIFIDEADALLANRGMGLNRTVHRELINQFLRQWDGIVETNAFIMVATNRPFDLDDAVLRRLPRKLLMDLPTKSDREALLNLLLRDETLDSTVSLPDLAARTPFYSGSDLKNLCVAAAMSAVEEENKAMADYVSSGGKQEDWRYPDKRTLRADHFEKGLKQIPASISEDMPSLKAIRKFDEEYGDGKKGRKKSKGMGFGMMVEEEKAVAEVKVRV

SEQ ID NO: 1323 - protein, 2222 aa, Unknown
  Kingdom: Fungi, Phylum: Ascomycota
MPNTSLRRPQKGTRRGGKVAYHGRSTRTFAASSRNEATSADERWERTRLAHSIDEAMGFARYDAGKKREGWLVNIQPTAIEDDRIPGGRSAVDFYFIEESGSTFKATVEYEPYFLIAVKKGHESEVEEWVKRVPGDGVVKGVRRLEKEDLKMPNHLMGYRRTFLELKFANVNDLLAARRDILPLAEKNRKTMTTMDAYAEVATANGNFDLFDDLREDERNVNTSISDASDFIIDIREYDVPYHVRVLIDLDIRVGSWYWVEIKHGVTKILPNPDRSLPADPVVLAFDIETCKAPLKFPDAAVDQIMMISYMIDGQGFLITNREIVSEDIADFDYTPKPEYPGPFMIFNEPDEKSVIERFFLHIKEARPTVIATYNGDFFDWPYVEARASINGIDMYQEIGWKKDSEDQFKCNYSVHMDCFHWVNRDSYLPQGSRGLKAVTVAKLGYDPDELDPELMTPYASERPQTLAEYSVSDAVATYYLYMKYIHPFIFSLCTVLPLGPDDTLRKGTGTLCEMLLMVQAYQREIVLPNKHISPKEAFWDGHLLDSETYVGGHVESIEAGVFRADIPVDFVVDPAAIDELLRDLDAALKFVITVEEQKKFEDVENYDEIKEKIAAQLLKLKETPNRTERPLIYHLDVASMYPNIMTTNRLQPDSMIQESDCAACDFNRPGKTCDRRLPWAWRGEYIPAKRDEYNMIRNALENEKFPGKTPNAPMRTFQELSYDEQTALARKRLQMYSQKVYHKIHDSTVITREAIICQRENPFYINTVRDFRDRRYDYKGKAKVWKGKTEALKSSGAPGSEVDAAKKMIVLYDSLQLAHKVILNSFYGYVMRKGSRWYSLEMAGVTCLTGAHIIQMARQLVERLGRPLELDTDGIWCMLPATFPENFAFKLKNGKKVNISYPCVMLNHLVHARFTNHQYQTLVDKANLKYETHSDNSIFFEVDGPYKCMVLPTSKEEDKNLKKRYAVFNDDGSLAELKGFEVKRRGELKLIKIFQQQIFKFFLEGEDLAQCYAAVAKVANRWLDVLHNKGSTLADEELMELISENRSMSKTLEEYGNQKSTSITTAKRLADFLGEGMVKDKGLNCKFIICSRPRNAPVTERAVPVAIFSADEAVKRSFLKKWLKEEPSDTDPRALLDWDYYLDRLGSVIQKLITIPAALQKVRNPVPRVAHPDWLQRRINTKDDKMKQKKLTDLFTKSPLEDITNRASNGMSDMEDYGSKLLKPKTISAAIASTQPVATVQKRKSPEPAENADPMAALPKIMPSPSEDYPAFLAYQKQKWKLQRQARIRRRQLFGDRRGNTGSDIQHTFMKQAHATFMNTWQLLHLKATETPGVVTAYVLIDAKIHTMKINVPRQVFLNLKSKDLPDVDVPGCEVEQVNYTLPNGHPSTHLFKLTVPEDVYFAQSEKFSMLFNHPSVEGVYERQVPLNIRAVLRLGNLCVIDEQQHAVLGKGLEQGFDLNGLKRPKVARTYLDSAPLAYIYISHITAGERQIFGIFSTTSDQAHVVILQKSRDSGQDLPNVTKIYSEMWAKRVQEAAGTNWQDCFAYQERVTFKITQVTTRRKAHLEIGDVVKKMRKDESRPQMMVIQSSQRNLLVHDVPILGEFPVLPLRYDAADSSLPPLGWQAVVARRLIGHYLGLGSWILHLTALARYGDVPLCNLERDDPRFLIDIAYARRLQANGVVLWWSPGSRPDHAGYEKDDILGPLDVVKMPAINNPGTFSSVCIDLDVRNLAINTILTSSLINDLEGSDSISFNPSADGSDSLASENSFANAGVLVLREMVKAWWAEACRGSTMADVLVQHLVRWVENPDSFMYDRALHYYVQMMSRKAFQQLMADFRRVGSQVVFASANRLILQTTKAEVANAYAYSQYIIKSIKTKPLFHFIDLEIKEYWDYLVWYDEFNYGGRGCQEVIEADEQNLETIMHWQMATFLPTRLQPTFQEWVIEFVQLMHSMKRPHNGDPDATPRLTQLPSRTELGEGEVGQIILGKAFEKPLKKAIIGLINQQKRELLHPELAGDYSFPELPGTHLHTKSNQPRDPILELVKSLMQVLSLDKNITMEARLLRKELLALFEVREFSKEGTFTNPSESLRLPQVSCDSCTMARDLDLCRDEDLVASAGNASAAWTCGFCGSELDRVALEERLLGTVEAFAVEWATQDLKCERCGALRVNEFMEHCTCSGQWKEVVDRGEVLKRMGVMRRVAKFYGLRMLGDVVEGMYVAI

SEQ ID NO: 1324 - protein, 504 aa, Unknown
  Kingdom: Fungi, Phylum: Ascomycota
MAQETVTPANGNGRTQYERTQSQPENPFAALIPDQQIAIIPEFTLESGITLYNVPVAYTTRGRLSANADNAMVICHALTGSADVSDWWGPLLGGPGRVFDTSRFFVVCMNSLGSPYGTASPVTAKDGDPAKGRYGPEFPLTTIRDDVNLHKLLLDDLGVKQVAAVIGGSLGGMFVLEWAYFGKDYIRCIVPIATSSRHSAWGISWGEAQRQSIYADPKYDDGYYPFDDPPSTGLGAARMSALLTYRSRNSFEARFGRNIPDPSKVQTIRERPRPSTPSEAHFHIHNDGHNVKRTALSRTSSGASGSPETPGAQGSGGAAATAAQSATPAESPDPQFHGPQKGSLTGGEKLPTSTYFSAQSYLRYQGTKFVKRFDGNCYIAMTRKLDTHDVSRNRAATIAEALALIEQPTLVLGIESDGLFTFAEQEEIAQHVKDARLERIDSPEGHDAFLLQFEQVNSYILAFLKEVLPDIMSQAGSAPEETGVGQLTKSSTFGEAEVEDITAW

SEQ ID NO: 1325 - protein, 762 aa, Unknown
  Kingdom: Fungi, Phylum: Ascomycota
MGVSGLLPLLKSIQRRSELKKYDGLTLGVDAYGWLHRAAHSCAVELGQDKPTTKYISGVMHKVRMLKHFGITPYMVFDGGHLPSKAGTEESRAKSRNEKKKLAMELLRSGKPAQAAQEFQKCIDITPEMASAVIQQLKKMDIPYVVAPFEADSQLVYLEKQGHIHGIISEDSDLLVFGAKRLITKLDQYGNCIEINRKDFCACREVSLTGWSDTEFRRMAIMSGCDYLDGLPSVGLKTAYRLLRKSKDPERCVKMLQFQGKRVSENYLTQFYQAELTFLHQWVFCPTKQEIVHLTELDGTRTAEEMPFIGPYIEPKTARLIAKGDLNPITRTAINHQTTPSKRRHSQMGVQAAPQPPAKPISTFFKGQGRIPMGAMDPNCFNIDRERLAQLTDGGLVPRVFPLPRPYLDDAQGSLPDTANGPRPTRTSPRLQRHRTEPIANMLSRVSGESRQSLVKESQTKSAGSASQRLDTAGRPSKKARLCDDEDIADISPKQSKFFSAGPATAKAKRKSSSRSKSDAMLLLSDDSINEALISLPDLEGWSEPKAKKLIAVFDDSTQKNEESSAEETGQGPSQEPTQPSVTESTLFGTQNSLTTISDTPPSSPEAAMLPPRALPLSHKLSTPASSTIRSFSYTGSSAACSSIASRCDSVFSATSTPSTAPSTAATSRMTPLQRLGARAVNASPRMSSYRQDPQKRKSFLNNIPVNPAMVALPKVDLDEVEALNRPLEGSEDQIIPDSDGEEDEVIDAPPRKLNLSRFAYV

SEQ ID NO: 1326 - protein, 551 aa, Unknown
  Kingdom: Fungi, Phylum: Ascomycota
MSLNRVASIETLAGYQARRGSDASIRPRKLSFNPLPQEWDPVYPDSKPGHHQPEQGGVSAFDVPQWKRILQILAAVTYCLFAAGVVFGYAAIKPVLKSQGAYADICHDSATCIEIRLNFMFTVAAVGTNVAALPVGAILDHYGPRVCGLIGAVFLFLGALLLAHATTLPFDGFMLGYLMLALGGPFTFISSFQLSNAFPRNSGLILALLTGAFDASSALFLVYRLIYDATDGTYDLRRFFLTFLAVPVVIVILQLTIMPGSSYKTVGELVDLADEADAANRAQRSMPRPMDDQVDEHTALLQEEGIEAYQHRDSVIADVESILGSVTGGEQLQAEERKNSRSGVWGVMHEKTVLQQLASPWWILICLFTVVQMTRINYFVATIRPQYEAIFGDENKAIEINNFFDIALPLGGLLSIPFIGITLDHTSTTLVLSALVSIATVIGILGVLPYTWAAYTNVSLFVLYRPFYYTSISDYSAKVFGFRTFGTVYGLIICLSGLLNLSQSGLDVLFHNTFKGDPVPVNLALLFAGLIIGTALVVFVTVQTRRRQRHP

SEQ ID NO: 1327 - protein, 333 aa, Unknown
  Kingdom: Fungi, Phylum: Ascomycota
MFNALNRFISRLDGDPGQQRQQERGSFGFQVLRNTNLELAIEPWFDFIVGINGRPIDTSDSGLFAQEIRNCAGGSVTLGLWNAKGQRTREMHVSVPADTASLGLSLQFSPISLAANVWHVLDVPANSPADAASLLPYSDYILGSPEGALHGEAALGELVEDFIGRPLRLYVYNNEYNVTREVTITPSRDWGGQGAMGCVLGYGALHRLPAPLSEPVSAPGETLFDGGLNEKSGDAAFEQVAGHTEAGGDYLVPAQMVESTPISAPPRGGKKKDRHGASPNKLMDDYFKEEEAKSRENDNAPQSKAAGVPPPPKAGAGPPKAKAHAEEAAAEDK

SEQ ID NO: 1328 - protein, 419 aa, Unknown
  Kingdom: Fungi, Phylum: Ascomycota
MKLTELFMGFALASGALSAPSNTKRTDDAKFDQGQPISADGKGGPILGKTKSTHVLPCGTNEQIDLQNPDNLGQQPTDNGVVPNLKWSFSDSKTRLLNGGWVREQVIQDLPASHDIAGAQQHLRKGAIRELHWHRVAEWGIVYSGEVIVSAVDENGVYQAEKLGYGDIWYFPKGVAHTIQGLEDENEYLLVFDDGNFEAAGTTFNIDDWLAHTPKSVLAKNFGVDESVFDHVPARNPYIVNGTVTERNVTDAQTPYANGNSSFVYRLFDHEPEEIGGSGGTFYKIDSTNFPISKTIAATFVTLKPGALRELHWHPNAEEWLYFHKGKARASVFIGNTNARTFDFSAGDTAVFPDNSGHYIENIGDEDLIWIEIYKSDRVADIPLTQWLALTPPEIVSQVLNVPIDFVDKLKKEKQVLIA

SEQ ID NO: 1329 - protein, 262 aa, Unknown
  Kingdom: Fungi, Phylum: Ascomycota
MSDSQVFEWHPAKFLRTHDPSPEFSLLVLNQPLRNGNNLRKLWRNSSMRVAADGGANRLHALSSFQAKFSNLQAIIGDLDSLSPSVRDFYSSQPTPAAIIHDHDQESTDFGKAVNWIRENRPRGADIIALGGIGGRVDQGLSQLHHLYLFHADPAYEAGRVFLLSGSSLTFLLKAGKHQIHVAEEGEDGVFGKYVGLIPLKEPSRITTKGLEWDVTDWETQIGGRVSTSNHVLPDVKCVEVETTKDILFTIALGQLDGDDDS

SEQ ID NO: 1330 - protein, 749 aa, Unknown
  Kingdom: Fungi, Phylum: Ascomycota
MTAVQTQKPSGLATSSSTRALLRVVILSLIAGAAIASRLFSVIRFESIIHEFDPWFNFRATKYLVANGFYKFWDWFDDRTWHPLGRVTGGTLYPGLMVTSGVIYHALKAVAIPVDIRNICVLLAPAFSGLTAFASYLLTNEMTTSPSAGLLAAAFMGIAPGYISRSVAGSYDNEAIAIFLLVFTFYLWIKALKLGSMLWGALCALFYGYMVASWGGYAFITCLLPLHAFVLICMGRYSTRLYVSYTTWYALGTIGSMQIPFVGFLPVKTSEHMPALGIFGFIQLIGFIQYVRSAITGKQFQTFLVTILVAAFGISLAGLVGLTSMGYIAPWGGRFYSLWDTSYAKIHIPIIASVSEHQPTAWPAFFFDLNFLIWLFPAGVFLCFQELRDEHVFVVVYALFGSYFAGVMVRLMLTLTPIVCVAAAMAASQILDNFLFAKTPETTESGEEATEKAAKKSSSSNGLRSASQPFIGIYKISSKVAIVAAMVVYLVMFVTHCTWVTSNAYSSPSVVLASRMPDGSQHIIDDYREAYQWLRQNTKEDAKIMSWWDYGYQIGGMADRPTLVDNNTWNNTHIATVGKAMSSREEVSYPIMRQHEVDYVLVVFGGLLGYSGDDINKFLWMVRIAEGIWPDEVKERNFFTARGEYRVDEGATDTMKNSLMYKMSYYNYHSLFPAGQAADRVRGVRLPDQGPVLDTIEEAYTTENWIIRIYKVKDLDNVGRDLSAAAAFDRGQKKKKAAKKRGARVLRVD

SEQ ID NO: 1331 - protein, 481 aa, Unknown
  Kingdom: Fungi, Phylum: Ascomycota
MASLQRTRSLRRPTAASTESPPDDSSSANRNASPSRLPVKFHTRSRSTTTSETATTTTTATNTRARPTSTILARSSATRTAGASSSTSTQEPSKRETSRYPPSTTLTRQQQPGYARPGSSGSGAPPPKRVPSHTRAKSTTASVNLSNVSRPPSRDQVTGPAARTTVGPHRRTASVEKSNTNNGVHTPTKTTAQAPQPRLRPAFSTLQQHYSPAKSLAPKPLTASYLAPPSPSKLPANVAASAETNRLQAELLQLHLLHRDAAAVEEAWRESAKQKLGDRFAELDEAGREIGDLERNRAEVENVLALRRWGGADGDLDQKIQALDVIVNGVWAMSDPGGRYARTIRRFERWIDQVNEIEEARRSGTALIQGSGNLFISELEAAWKGECPGLIRKLDGWQRQLQEIGEVPQPPEDGSQPPSLVRMLKGCAGLIRTMLAELMVMQDIEGEALEREDGWIERVNREDDDDDTPRAGAIWRTFHGR

SEQ ID NO: 1332 - protein, 808 aa, Unknown
  Kingdom: Fungi, Phylum: Ascomycota
MGFTAGTRYILARRTLLRLDPPTYRRTISTQPKVFPTAGFEKLPADEPIEEEKLPGYKAERYYAAHIGQVLQGRYQIIGKLGFGGGSTVWACRDLKEDALVTIKICTTGERGTRDALQEVAISNHIKSIDAPDHPGKLRLRVALDNFEVEGVNGNRHHCLVFAPLGQSLTEFRRPFPGNALDPDGLRFTLLWVLMGLDFLHQGGVIHTDLSPNNILVSFNPGEECVFEQIEDLELTTPTPRKVLPDRFIYLSYKLGISHGPAVITDYGAARLTDPENNERHSGDVMPGTYRAPEIIMGADWDSKIDMWSLGVMVWDLFEGGPLFRAVSAKTLDDELHLAEMVSLLGPPPRKFLERHAKSRQYWDSEGNWIASTPIPDQFLESRETRLEGQEKQQLLTFMRKVLCWLPEDRKAADQLYDDEFINGYKRHEGDTSSGSDSLGSDGDRGGRIASAFDAQIKAYPRTSSLACRISRGSTLAFAVWGNAGTDRHGEPQDSDVLGRRQSQEPGPISRDISHQLRGLHSSQTVQPIMSPTAAAVHQVATDGFAKGDLYDQHRPTYPAEAVSRLLTHLGLAGKQGARIIDLGAGTGKFTEALAGRGENYEVLAVEPLGSMRDVLAKKGLKGVEAKDGTATEIGVVDGWADAVVVAQAFHWFATEEALAEIHRVLKPGAKLGLIWNIDEFNRPKDWPATTQWEKAMGDYVHTLAADQLVTRFRDQRWPAVFDKQAEREKPLFSTPIESETLPWAIHVTRDGFVSRMSTLSHIALLEGEEREAFEAEVDEILKGDVKMDEQGRLEAHGLTYFAWSEKL

SEQ ID NO: 1333 - protein, 356 aa, Unknown
  Kingdom: Fungi, Phylum: Ascomycota
MAPPPEIAIPSTSISSDSSKPYTLYNITLRLPLRSFIVQKRYSDFSALHDTLVSQVGEAPPAPLPGKHWLKSTVKSADLTRKRQEGLEAYLKAIAGSPDRRWRDTSAWRAFLNLPSRSTTNSAVSAGGMVANKAAGAADPGTWLDMHRGLKQCLHEARQSLSRRDHASDCGNSSAAAEASTAAKRSIVKAGTSIAMLADGLRKMQESNLLGEGELRRRRDLISTARMERDGLDKLSNSMSSTTGTSTGGAQPSSSDTAALFSGARPSGRVLGGPAPETDKTRELDNQGVLLLQRQEMESQDQALDALAAIIRRQKEMGVEINDEVERQNEMLSQLDNDADRVQGKLKVANNRIKKF

SEQ ID NO: 1334 - protein, 464 aa, Unknown
  Kingdom: Fungi, Phylum: Ascomycota
MPQVRRGSARLSSEQSLAAAVAATAATPATPTSPLRDDFSPTEPALAPVPSASNATIPGDPESSQPVSRAHRASSFSPIRTTSNDPANRPTVSFKTQSVDQVPSDDHNSPRDSSQNIPRRHTLDFPSSRRSLSYAQRPREDAYYDSRAATREEYHRRGHTLQEYYDRHPDLLPQLPFTWHHGRQRFKLWLFAFLVFVDASAVPIALYYGLHYAGHVEGWIIFAVVTTIWGGPTYLELAIRTLRLIKKERFYRPLGTDSRWCFDMTTWVSLLTIFVVTTLFIVGSAPHNVWLRVLCMPAPALLYCLGGWLLLLNLYNYFGWPAPFRISSTAKGEKVLPPVYYFMEDVVAVNASAGRPYREALASRYAASPRFRRMLLIQSWFWAIPALVLAIPLTIISVIPQVPATGAYGVAWAVPFLWAVLWGLITIWWCKREMVRERLEWESGEVPAGKGAVMRSEENSVIAA

SEQ ID NO: 1335 - protein, 513 aa, Unknown
  Kingdom: Fungi, Phylum: Ascomycota
MDAETKKMNDDAIQNVRTAESVQFDKISEQDLATLRRVPDKMPKLALLILAVELGERFTYFGLSGPIQNYINNPYDPGSDLPGALGKGQAVATALGNFFKFWAYTSTVIGAIVADQYLGKFRAILLAGAIYTCGLIILVATSTHAGITSGAGLGGLIAAMVTIGLGTGGIKSCVTPMCAEQYAHSQPVLKRLKSGEQVIVDPELTVGRLFMWFYWVVNIGALSPLITVTVEAHHSFWLAYLIPLIAIILSLGVFLLGRNKYIKVPPMGSAILDAVRTARVAIQERGFDNAKPSALREHGHQDRYPIASQERYTDEYVGEMFLFFPFYFICWNQMWNNLISQAGQMALHGTPNDLLQNLDPIALCIFIPFLDVVVYPLLRKYRINFDPVTRIFVGFITASLSMVYACVLQHHIYNSPPNSIHVWIQAPSYVLVAFSEAFVIITGLELAFTQAPKNLRSVVSALFWLTIGIAAAICIALAAVSQDPYLVWMYGSLAIVGFVAGCAFYWCFYPRKK

SEQ ID NO: 1336 - protein, 406 aa, Unknown
  Kingdom: Fungi, Phylum: Ascomycota
MGANPNPAHSPTLTETLPPPPLPTSPSNNQRLSSLPFTKSHPRHLSHGLALDRMLPPIDNSLLQSNPNFALLYSKLTNTLLNPDASTKDDDTPAAKQREAVKKELDRHRLKAAKHHLLTQAIATATPPEQKPSSRSIKPQPRHLQSQPQQAQKQDAAHLPDPLIDLLLLLPPLLTPSSTSLPSSSLKLLLASPPLRDLDALLPQLAPVISSSLHTSALTLTRLAHPSTNPSYLHRQIPSLPDHITTHFLRPQTTLRTSLSLARLQTLSSLLTLLTSHSQTLTVLIRLLEQKHTLVSRNLTLQASAASLASQRTEIDAEQALWTIRREVYDREAVQALRNYGAHLRDAKVRAEERVRGLKAELAEYGVGVEGGEAKERTMREMARVWQQMGRQMSDAKGDLDRLQRR

SEQ ID NO: 1337 - protein, 506 aa, Unknown
  Kingdom: Fungi, Phylum: Ascomycota
MRGLLPIVAASWASGALAAKPSSTEANVAACCSKLAKGFLSQVVSTSGPLYSSWNHRWADTAELKPNCIFRPQSSADVSAAVKVLARGAGKSPEDRCPFSLVAGGHTPWAGANNIHAGVALELSQLNQVVISNDRSYVELGAGARWHDAYVKTDGEGLIYPGGRCPDVGVAGLTLGGGYSWFSGEMGFVADNVVNYEVVLASGEIVNANEKQHTDLWKALKGGSNNFGIVTRFDMRATEHDQQVYGGLVIVPASLTGEVLRALHNFTDDSTGVHKTAGLTIEYYIDTVTGDEQILLWLIDTDVSASHASLQPFFDMEPKYLNQVYQTSIADYPASIPPVSRVLMADATFVNDLEAIKAVHKVTMEVKDSLSHVADLVWDFQFEPLSRHIIEASNARGGNVLGLGDAKEDMLIVFIMPLWQDAKYDADIDNAAARWVECVQQVTSALGKGHRFEFANYAAGFQDVMKSYGPVNYKFLRNVAKTYDPKGLFQKAVPGGYKLDKKPAKT

SEQ ID NO: 1338 - protein, 320 aa, Unknown
  Kingdom: Fungi, Phylum: Ascomycota
MATVSETSSDDSPFLRLPAELRLMVYNHLLSSRSEDRISVKTRERYWKKQEERGNGETSRRTNYYALDRRSLGRCSYKTTYGLDGGEGEDATTMHPAIMAVNRKIYGETAYLLYASHEFHFGHHLDAIGPFIGDLTSSSRNLIHSLSLTCFLHSPSCCAASDWRFWSSMSHRLGKLPKLRRLRITMQGGRPTADWDGPKNLSVSDIKLLYATHHECLDWARELAAVDSLEDVEIEADIRPIPKPETTATLIYAALSASIEGSLINFLRDELNVPARLKEKKPSEEVDDEEKADKDAGPGPGPEPNQQSSGEPAVESVQNE

SEQ ID NO: 1339 - protein, 907 aa, Unknown
  Kingdom: Fungi, Phylum: Ascomycota
MLASPTPAPTGPVRRTSQRQALRRPASRSMLTRAESQQAFASGGAGPGPAMENVADQSKQYHDDSSEDEIPVPMKLSALTKALLNDPDEPAARGPSPPRTRRQASILNSSTNSAPSAEERRHLRSRSVQRQESSRVEREPSPGQSREQSPVRKRVVRLSRDSSSLNQMGPVPTKRRSTSVSRGPRKDSQQPPSRPSSRAESYGEDKVESQRDVNTPSQQPLRVVRISSSSSVKRRLAARRSSGLNPDASAADGSALDLGQDHHTRKEEADGVARIGSSASKGSGSRYGSASLRNRTEDNPNLHSSMRIKRVGKTPGGFLSGPARRGKRRQSEEEGGDEIGDGEALYSSHERGMHASEDGVVPSHVREFNSGSPVSSSAVARASHRRQASQADLQLGSRQPSPRGVDLSKKEDLLTSFETGFPSPKGIEMPLRTQDRNHMDARQHARPDLPSNHDQENEVPGSWRRSKPSVDLIMEKIPSRPFQADIPPSKPAASPERKPLAAIARNTPSQAAPPPPPKMSVLETATSNAGAAATTQAKQRRNVLRVNGKVYTRLDCIGRGGSAKVYRVSAENGHMFALKRVSLENTDEIVLRGYRGEIDLLTKLNGVERVINLFDHELNSEKKVLYLLMEMGELDLGGVLKARHALDESKFDPVFVRFYWKEMLECLQSVHQYAIVHSDLKPANFVLVRGRLKLIDFGIANAIADYTKNVHRDTQIGTPNYMSPESLLDSNSPANNPGARMNGLPKLMKLGRPSDVWSLGCILYQMVYGTPPFGHIANQMARCQAIINVNHNIEFPLHAPCGTRVPNSVIKTMRGCLIRDPSYRPTVDQLLKETDSFLYPRELPNDSLPVDREMLGRIVQDAVRKYIDGQDHPDPRKRPNREDLRKEFSDDYWHSLRKAAVAKGAMW

SEQ ID NO: 1340 - protein, 313 aa, Unknown
  Kingdom: Fungi, Phylum: Ascomycota
MSFPYAPPAGVWAPAITLFDPATDSLDLDAQRKYYSYMSKTGLAGLVVLGTNSETFLLTREERRTLLQTAREACGPDFPIIAGCGGHSTKQVLEFLHDAKEAGSNYALVLPPAYFGKQTTPAVIDNFFGDVAKESPLPIVLYNFPAVCNGIDLDSATIARLAQQHDKIVGVKLTCGAVAKITRLAATFTPDQFTTYGGQSDFLIGGLAAGSQGTIAGFANVFPKTIVRIYTLYQEGRFAEAMELHKKAALAEQPCKAGIAAVKYGAGLTTAKAAGITDAERLKPRRPYLEPGDAEKKKIEEAVATLIEMENSL

SEQ ID NO: 1341 - protein, 595 aa, Unknown
  Kingdom: Fungi, Phylum: Ascomycota
MSTAKPTLQVSPEDETSSGSDRDSQQGKQNAGNKDATGLSPPGPLDLATRETVRMEAALGDAILRFLRIRKTPKSDEYDLDATATQPSIWDSENVEEYRKLYIHPQWENASAFDPGFRWTFREENQVRRKVDWKIMLWVCIMFAALNIDRGNISNAVSDNMLDDLGLTQSDYNIGQTIARLGFLVAELPSQLISKRIGPDLWIPIQICIFSAISALQFFLNGAASFYATRYLIATFQGGFIPDTILYLSYWYTGTRLPIRLCWFWMSSKLVDIGVGFAAVGLLSMRGVLGYAGWRWLFLIEGAFTFAIGLASFFLMPQSPARTKSKWFPKGYFTEREEKIIVNAVIRDDPQKAGMHNRQGLTVGQIWKCAKDYTMWPLYMLGLLFGLPKYPVGQYLTLSFRGLGFNVIETNLLAIPETVGGSITMLLITAFSELVRNRGFVSMAQDAWLLPCFIALITLPDPIGAWAYFAIATVLLSAPYTHPIQVAWTSRNAGSVQNRTVSAALYNMAVQVSGMIGANIYQPSDAPRYFKANKGLLVICFWMCFIQYPGTYFFYRWRNRSKAKVWDAMTPEEQHHYRTTTTDEGNKRLDFRYAT

SEQ ID NO: 1342 - protein, 788 aa, Unknown
  Kingdom: Fungi, Phylum: Ascomycota
MRFLSSKSLLSAPVVLLLLAETIGFAAAAPKAPWVKQRAKGQARRALSAAMEKRETDESECAIREALLTTAPKGNIWDSLSGEEASGVVHWLFAQPDLNLTKADDAGSWDNTLLLVELQHPNKTDVLAYLDGSGPAPPRYARAVIDHKADEEPYIQDILVGPLPVVNGTTTWTPLEYTLTRKTEGKVRSLEADSDAYYEWLIQVSTSVADITMDLWNASALGLENDTLAVWGIDPYYQDEGRVKRWDTFWGQPADVFESMTLLPMGLFFMSDVTGRDPSKWAVEGWYYNGVFYETTEDFRDAYWGGKVEKLPGNIEGPWAQTDQQGTIPPLDTTAPPVMIAPGGGRYHVDPQNKYVEWMGWSFYIGFQRDSGMSLFDIRYKGKRLVYELGLMEALAHYAGSDPVQSHVAYLDTYYGFGPFAFELLKGYDCPAYASYLNTSFYVDETTHTHLNSICLFEGDADYPMSRHSSSAYVASAKNIYFTVRSVSTVGNYDYMFSYTFFMDGSLAVEVRASGYIQSAYYAKNDDYGFHIHDALSGSMHDHVLLFKVDVDILGTDNTVQFMDQVATTTTYPWSKGKVFNTMKLERSFLENEDQGQFNWKENNQQQVFIVNQEEKNKYGEYRGYRVLPYTGASHLAIKNSSIIKNSAHWAEHDIMVSKRKDTEPRGTHAFNNQDTENPPVDFSKFFDGESLNQGDLPNTVFTTAHSGIQLMPSNYFEVGVNSETVNMVRVNYDKGVVSDVIAFGSSDDSCAVQYEPVFVDLWNYKGDVVVRKLPYSPNDPYYETDSI

SEQ ID NO: 1343 - protein, 213 aa, Unknown
  Kingdom: Fungi, Phylum: Ascomycota
MYGDIGLKLVQHAKRTQNLAHLPPYQTELVRASTREVRDLDKDVSDLLEPFQGSFDPSADQATACTLLVNHLAMRRNKRCLLAYHRTRTDKLEELVWNGTDVGELSGQQVREASVAGSGGPDTSTSSLSPQEEDYVRQYSDLLAAYKGQWTDIDLTGSLEPPRDLFIDVRVLKDAGEIQTEYGAITLTRNSQFYVRQGDVERLIAQGYLQKLN

SEQ ID NO: 1344 - protein, 486 aa, Unknown
  Kingdom: Fungi, Phylum: Ascomycota
MKSILAASVAALLAGNALAESMSVLKELKVKQWAKQEAQGAFDLDRYEALEAVTPCTNGRAGEYRCSNVDLVSFLRHQDIGSATRTGNDVWGWTSSTGREFGAVGQTDGTAFVEVRSDGSLVYLGRLPTQTVNSSWRDMKVIGDYLYVGAESSNHGLQIFDMKKLLTINPASPRVFSTTSDLTAHFRGFGNSHNIVAHEATNMIYAVGTGTAAGCRGGLFMVDVSNPASPRSAGCLSAGGYVHDAQCVIYTGPDTRYRGREICFNFNEDTLDVTDVTSKASPVTISSTGYNGASYTHQGWLADPEMRFLLLDDELDEQRRRGPAANQRTTTYIVNISDLRRPVFTGTYQSPAVAIDHNQYVHNGLSYQANYGSGLRIIDVRSLTTDSTGRGIREVGFFDCYPEDDSVGGRAEFTGTWSVYPYFKSGFILLNSIERGIFSLKYTGLEGGLAWRTTIKFRKNTNFVACDFAFPTKASPLTLYGKTVLQ

SEQ ID NO: 1345 - protein, 261 aa, Unknown
  Kingdom: Fungi, Phylum: Ascomycota
MSWAGFKKNVNRATTQVMMKTGHVEKTNDRDYEVEERRFKTMEAAALKLQKESKGYLDSLRAMTASQMRIAETIDAFYGDSGAKDGVSRSYKQAVEDLDAETIKALDGPYRQTVLDPISRFCAYFPDVNECIKKRSHKLLDYDALRAKVKRLVEKPDKDATKLPRTEKELEMAKAAYEQLNEQLSTEVPQLIDLRVPYLDPSFEALVKIQLRFCAEAYSRMAQVQQYLDAETRDLYAEGHLDARVEEVLQQIRELSISGTV

SEQ ID NO: 1346 - protein, 902 aa, Unknown
  Kingdom: Fungi, Phylum: Ascomycota
MFSKASSKLPNALTGKGPSPVVASNAEDALRLMAEMDLVPLLANLETSQKGLTRAEAARRLQVAGPNVISFRKAPSWWLLLLTVIPNPFNILLCCLAIISVASPEPSWETFGVLLVMIAISSLVRFWQEHKSIISVANLQNSVTTNVKVRRLLEQKSTEPIDSEVPERNIVIGDIVRLTPGDTVPADCLILEANYLRVSQSNMTGESMPITKAPASALDQKKFDTIFDIENIAFMGTSVVSGSGLAVVLKTGDNSYIASIIKQLSATRELNTFQKGIRNVSYMLIGFMLAMVPIVLGISGTMTGDWSSAALFAISVAVGLVPEMLPAIVNGNLARGAHLLSKKKAIVKRLDAIQNIGAMTVLCSDKTGTLTKDKVHLDDFVDCEGLPNTDILKLACINAVCQEEQGNAMDAAIMNHQKLVEKTVTIPQYTKFATIPFTFERRRASCIIRGFTKYQMLVCKGAFDEVLSLCNSVRRAGNDEPLDTATRGKLELYAARLARNGFRVLLVARRHVTTEAMEAAESIEDLETSMVLEGLLTFLDPVKDDALESVTRLREAGVEIKILTGDNLAVAINICHQIKLVGDVDSDDVQAITGPDLALLEGDEFDETIQKCKVFAKLTPTQKAEVIHRLKKADHCVGMLGDGVNDCLAIRASDVGISVDSGSRAAKDAADVILTEKGLNIIAEAVRIGRVTHGNSIKYIKMVASSNFGNVFSILIASAWFPFTPMSSVQILVQNLLYDISQIAIPWDRMDEEYLQKPRHWRQWDLLRFIAVLGPTSSVIDVATFCINRYYYGIATADDNVALFQTHWFLQSLLTQTLIVHLLRTAKIPFVQSRASRVLVFSTCTIMLIGFCIPYIPPLRDTLSMTTPGPVYIGCLAALLLAYCIEVQLIKMVYIKLFKSWL

SEQ ID NO: 1347 - protein, 325 aa, Unknown
  Kingdom: Fungi, Phylum: Ascomycota
MSRYNGAEALDFDNTGSAHYAPASIAPPGSRKIHVSGQPSSSRSGSVPADYESQIPYRPFQPPSHFSWLRLAVPSWLFEIDAVVVCAGVFCCSASPSVCLAARLKGLINDVSQSKVYALAKRYGAGVLEQNITGKCVLEDKNGVISTFEYGQLPDFEAAAQRGVARFRDMVEADCQALDLDRPASTELDSMTLEAYIRSRGATEEAIRLSQPVTCITQQQNGAVEVLGEYGKAFRGAKGHRHHSHAGHPVHCVPAGTALTPGVLDLLGGDALRAPSGNLRWAGTETAAGWKGVHGGCTRERRACGSEVVTGLTHVNARLLRYGRV

SEQ ID NO: 1348 - protein, 315 aa, Unknown
  Kingdom: Fungi, Phylum: Ascomycota
MPPRISPSLRLASFRRLYSTAADSGPLIRVTNLPAPGSGHIRILELNRPSARNALSRSLLAALRAELDDLHQQYTPEGDEAPHAVSTSNGPTRAVVVASAVDTCFCAGADLKERKTFTKQETADFLANLRDTFTSLSALPIPSISAISSIALGGGLELALTTHLRVLTSNAVVGLPETRLGIIPGAGGTHRLPALIGLSRARDLILTGRRVAAPEAYFLGIADRLVEVKPDEGKKGDEKQDVLDLARRAALSEAVRLAQEICEGGPVAIRAGLEAVMWARQEKENQMYERVVATEDRNEALKAFGEKRRPVFKGR

SEQ ID NO: 1349 - protein, 503 aa, Unknown
  Kingdom: Fungi, Phylum: Ascomycota
MSSDLLQELTAPNGRKYTQPIGLFINNEWVKSSDGGKIASINPTNEQTITSVYSATAADVDKAVDAARAALKNPAWRDMPGTERGKLMRKLADLVEEHKETLATIETWDNGKPYSVALNEDMIESSETIRYYSGYADKIFGQVIDTTPAKFAYTVREPVGVCGQVIPWNYPLSMAAWKLGPALACGNTVVLKPAEQTPLSILYFATLVVKAGFPPGVVNIVNGLGSVTGSAIASHPGIDKIAFTGSTATARQIMKSAAVNLKNITLETGGKSPLIVFNDANLDNAVEWAHIGIMSNQGQICTATSRLLVQSGIFDKFLSAFLAQVKTISKVGDPFDENTFQGPQVTKAQYDRIMSYVDIGKSEGAQLKMGGQPFKASGKGFFIEPTVFSDVSPKMRIFQEEVFGPFVTITRFETEEEAIALANDSEYGLGSAIFTTNLTRAHSVARQIEAGMVWINSSNDSDPRIPFGGVKQSGIGRELGEAGLAAYSNIKAVHVNMTVTSKL

SEQ ID NO: 1350 - protein, 987 aa, Unknown
  Kingdom: Fungi, Phylum: Ascomycota
MSEPGSKEPPPRRKQSKSQWLDHFNAADLKVFARCWLAAWASMLLIFIQPYLEHVGSAAFFGTIVLFIVPPTGTVLIYLLAAMTLLLGMCLAWVWGLLTMKAAFAARPASTTNALLAELQKNAIAAANRTGETPQWEAQILIHQGALFDTRVTVIFYVMGCVFIYALCRLRSANPKFTLTQIFGIVVTDIFMEFGPSLPGYVGDIPSVMVKPAAIGIGIGAASCVLICPQSTSYLALNLMTKLVRLSKQALEVTRKRLAEEEVTVVEARALRMQMISTIKAAQPHIAFLPLDFSRGVWNADDVQALQEDIRKLLFSSLYLIDFHIGRLNAAEMLRQRVESQAGEENGLTAKEGTYHVGQRHRQQSTKLLLALQRPDQTDIQHETQQAMRETTEDILRLSSEAVELAADAMHMANSCRWIGTPKPAQFDALIAQMQEMRDNVRVAREESIKMTAERVLEAHSELFDEKGMLKVKGNDHPILPSMVVAMVLEERIVSAASAIEKLLHHLQQLCEKQKTPRIWLPSRLQYAIAWVGHGRTAVPGQATNGEVEGTMYQDPDDLFDQTEEVRRRLEITRSIRGSAARRNKLSKALSAIYQWFTDPAGMYALRMVIVTIALTIPATLSSSAGFFFREKGIWATISAQTVLVVYMSEFTFSFVTRSLGTIIGGAIGMVAWYIGAGNGPGNPYGMAASTAVVLLFILWARLFAPPTFLMAIIMGAATFALVIGFSWDEGYLRQYGLPGVGYTAFWKRVVTVLIGFLAAFIVQIFPRPPSATRHACKTLANSVRTLSDHYALLVSHWGRQDDNTRALRAVSGKITLEVAEVLASLDSTIGMLPLELSSSPFDQKTLKQAQEQCQYMNQALGGLLELVSDLPINLQDRLSKVIGIKDDRGIGDIMAILGILEQALRTGSPLPERLPAPLVARAVETYLSMGETGMTTESIMVANYHQRRYCVAVTLYLKFLTAVDDLLLTLKSALGERHIVYEWSDA

SEQ ID NO: 1351 - protein, 482 aa, Unknown
  Kingdom: Fungi, Phylum: Ascomycota
MASKTATKKKPEYEFLGPPGAFCISFLLPVLVYFFTFACNDVSGCPAPSLLSPRTLSLEKLKQEVGWPADGIWGLGSWKALWASLAYIGLSLVLYRVLPAHEIEGTELRFGGRLKYRLNTLNSAMTTFALLAAGTFAQGADFPVWTFISDNYVQLVTVNLLISYALAIFLYVKSFSVKPGNKENRELAAGGQTGNMLYDWFIGRELNPRVTIPWIGEVDLKEWCELRPGMMGWAIVNWAWCAKQYRTFGYITDSIICISAIQTLYIIDSWWNEPAITTTMDITTDGFGMMLTFADFVWEPFVYSLQTRYLAHHPVTLGPVKLAMMFALIGIGFYIFRSANSQKNTFRTNPNDPSVAHLTYIETKTGSRLITSGWWGMSRHINYFGDWIQSWPYCLPTGLAGYQILSAGTIADGAIVMRDGRQVVQGEAKGWAIPIAYFYVIYFAVLLLHRERRDDEKCHKKYGKDWEKYRQAVRYRIIPGIY

SEQ ID NO: 1352 - protein, 314 aa, Unknown
  Kingdom: Fungi, Phylum: Ascomycota
MDDELQHCEAPLEENPGSLLTLETTLDDGTTINLTVSPVPTASSPVTASATFTKTSFSFHISTSLPDKVLPSRKASPPPPSDIFTCHASSSVKRPLTTTSSSPPPPGKRSKPSKMPYDLPEDVVAIDTGAKSLLFYVYKDLKGSYQLSYLESPNDVATGKYQVNKIRRARDPWESNKDDEMIDIKVSPNNKQIAAITWQGFRGTEIRVYYVDKDTEHLREVCRSGDAGWYIGALSYNDDASNKYKVRPNTSISASVHQYGTEGKKFNLRVFAAEDGEVNKKGLPQISVFKFLHDESETTQSWQGVYITNLVTEY

SEQ ID NO: 1353 - protein, 467 aa, Unknown
  Kingdom: Fungi, Phylum: Ascomycota
MPRSELPLPEFPYPPGTPAFASWAAEDKGPTSVALCWTFTSAAIMFTAARLYTRWSMFKSLKSDDFWILAGLISAILATIFTTIAVDYGNGKHYQLLTIHQATEARRYTLAAFVPSVMTFTVTKFAVVSLLTRLLNPSRAHRMFLWAMCIALFLSLMAAIGILFGQCDPVKALWDVTLLPFAKCMDPEIYVNYSIYCGVFSAFVDFYLALYPGFVLWKLQLRTQKKVALTFALSLGCVGGALAIYKTVRLPQGLENPDFSYETADLINWTIIEGCAIIIAATIPVLSPLMDKIFRQYNPFASTRKSSRKSTSKGQKYHHGHSGSDDSHRPDMEERAPRRAPRDPYDLDMDLAETVIDHSEEDLGAAKKSDDPEAQRSVRYARMSSSSSGSTQVGDEDHDLALRPHTTPVSTGIIRTNEVTVKVDPSISRDESLDRLDRNIPWETSVNSPISPPPHARTWGKHEGGSH

SEQ ID NO: 1354 - protein, 1019 aa, Unknown
  Kingdom: Fungi, Phylum: Ascomycota
MLRQRKPNGGDDPEAGDAGGLARSESSTGPNEKDLGEYPALDRYISTYRDPRDMAADDNDKNHSKASWWQFWKTGIETPQQPEKKPAAPEHWLDTDMHQGLRQQDVEERRKVAGWNELVAETENMFAKFLGFFTGPILYVMEIAALLALGLQDWVDFGVIVGILLLNAFVGFYQEKQAADVVASLKGDIAMRCTVVRDGREQEILARELVPGDIILVQEGDTVPADAHLLCDYTRPEDYEIYKRLKAEDKLGTSMEGEEDYGDDDDEEADKRRASVISNGRRRSSAVPASNYRTVPLVATDQSAITGESLAVDKYLGDVVYYTTGCKRGKAYAIVTASAKQSFVGRTADLVQGAKDQGHFKAIMNNIGTTLLVLVLFWILAAWIGGFFHHIPVTEPGSQNLFHYALVLLIIGVPVGLPVVTTTTLAVGAAYLAKQRAIVQKLTAIESLAGVDILCSDKTGTLTANKLSIRDPYVAEGQDVDWMMAVAALASSHNLKSLDPIDKVTILTLKRYPGARDILQRGWKTLSFTPFNPVSKRITSVCTLGPDKYTCAKGAPSAILKLTACSEETRQLYKEKAQEFARRGFRSLGVAVKKNDEDWVLLGLLSMFDPPREDTAQTIMEAAHLGVPVKMLTGDALAIAKETCKMLSLGTKVYNSDRLIHGGLAGTVQHDFIERADGFAEVFPEHKYTVVEMLQQRGHLTAMTGDGVNDAPSLKKADCGIAVEGSSEAAQAAADIVFLAPGLSTIVLAIKTSRQIFQRMKAYIQYRIALCLHLEIYLVTSMIILNETVRVDLIVFVALFADLATVAVAYDNAHWEPRPVEWQLPKIWLISVILGVLLAIGTWVIRGTMFLENGGIVQNFGSVQEILFLEISLTENWLIFVTRGGKTWPSWQLVGAIFAVDVMATLFCLFGWLSGQPEHIAVADHFKQRTDGWTDVVTVVIVWLYSFGVTIVIAIVYYILNQITWLNDLGRKKRSKKDTMIENMLGHLQKLAVEHEIDEKTGKDRYLLAEKGADEEDDM

SEQ ID NO: 1355 - protein, 310 aa, Unknown
  Kingdom: Fungi, Phylum: Ascomycota
MASNLLDLITRVDNVPLDFQQNFHPYYRLFVHPDPHPHGYIHPKTIGSLTWPSTFTISHPDRTLTLTVTPSTAEAINASFQEVIDFALASPLFPSLTIHSEPFLIPGLSHFPDSLVHIERFASSLFGIATRGSHLTAYLPATATSPLKIWVARRSRHLIAHPSLLDSSVAGGVKATHSPLDCILAESHEEASLSRDFVARNVRAVGTVTLANINPKTELFHAEILYVYDLEMPPDVVPVPEDDEVEEFVLMDFDEVMGRMLKGEFKPNVCGIMIDFFIRHGIITPENEPDYVDICSRLHRVLPMPTKPPS

SEQ ID NO: 1356 - protein, 696 aa, Unknown
  Kingdom: Fungi, Phylum: Ascomycota
MAPSSRNPVTWDEYEGRPSPTASTTSLSASAAADEETALIDDGDDVSPSRGPSNHPLAGRRRSSVTNHLAAIVDIGGVNSLASFARSWQRAAGFQEVLPRRPSFVYVDTDSSTVEPTVIQYGRSHVEPSTPGPETSLLRQHLQASPPQQGPSAPAEQQLSAGPGASASENDGFRERESKALDAEMASGALLGNGIGSPSTRSSIFNIPPHLSEAPVIGSYGSWRSSHYGTIGGGSLRARPRTSVADVWPAAEEEGDDDAAHGEHEPILVREVKQGDKVVLTVEGQSTLPQSVFNSINAIIGVGLLSLPLAFNMSGWIVGLILLTLTALVTAYTSKLLAKCMDYDASLITYSDLAYVSFGTKARVIVSALFTLELVAACVALVILFADSLHLLLPSVASVNSWKCVCALLVLALNALPLRFLSYTSVIGIFSTFCIVCIVVIDGLVKPTAPGSLWEPAKTTLLPSNWLAVPLAYGLLASPWGAHSVFPSIYRDMRHPHKWGKAVNVTFSFSYVLDSCLAVVGVLMFGDGIKDAITSNILKSGGFPQALTILMCICVAIIPLTKIPLNARPLITTADVLAGIHPSTLHHHHPHNMPATRRAQLLIHLTRFAIRLCVVAILLAISIAFPAFDSVCAFLGAALCTLISIILPISFYLKLFWKDVSAREKMVLYCLLGLFSVFGTAGTIWTFLPKPLIGLE

SEQ ID NO: 1357 - protein, 456 aa, Unknown
  Kingdom: Fungi, Phylum: Ascomycota
MSEPNTQPPPAPTPAAAAAPPKPPVKAPVENPALRMLGLPKLPKKLPSRNWMIFWAVTGTISSAIIYDKREKNRATAKWRRAVAPLAEEILPSATQLPRKLTIYLESPPGDSLRVAQDHFIEYVKPVLSASGLDWEFVQGRQQGDVRAAVAEKIRMSRRETERPDEELPQTDDTLLAQMRKRMGVPEYQGAKGDIVIGRHTWKEYMRGLHEGWLGPLDAPTPPAVEVKPAQPETTTPEASTTDGDATEEKKEEPKKEEKPSRPPQPIPHNTPEDYSSAVLPAQIPAEFSPSTQIPFPHRLGFRHTFVRLGWFLNRRKLADDIGREVAAVCFAAAREYRTADGQYEQQLVLQHEERDWPKSVWQDEVPEKDEDGNDKPIPVKEKIWTSPIVTDDRIAQRMRRFEITPEDEAKATKIVVPEEEIEGWIKGSLRSAWRWGAASLASKPKGPNVGNLDDE

SEQ ID NO: 1358 - protein, 345 aa, Unknown
  Kingdom: Fungi, Phylum: Ascomycota
MPIIVKEQAEYTPLDPNYEPLPKYSHYATLDPLFATLKPAIDASLDTIWNPDSTIEQFRAAWSANSPSPAGCPVEGEDVVTEKRMMKMRDGAERELRIYRAKEEREGSAIVLRCHGGGWVIGGPNTEHPESLMLAGKTNSVVVVIDYRMAPEYKFPYAVNDCFDALKWCHENAASLGGDPSKLIVNGGSAGANLATVSALLARDAGIPLAGQVLTWPSVCHPKFQPKDKYEMGSYQQNHFATILTAPRMEWFLDMYMPEPTDDWRLSPLLAPTLKGLPKTLVTVAGYDILRDEGLAYVERMKGESVDVEHKVYQGLPHCPYGMVEHPEIIDYYNRIVEFVKKISG

SEQ ID NO: 1359 - protein, 248 aa, Unknown
  Kingdom: Fungi, Phylum: Ascomycota
MVTKEYRGPKRRFYLSPPDPDITTVRRSITTYVPPEPEPQPEPPREPTPPPPPPPPPIVLPLPPPPPPPPVVEPEPDIEVISVDVEPEKRRRRRRSRSHSRDHRHTREVYVEKERVVPVPYPVYRERERRVEVPVEVPVEVPVEVPVEVKVPYEVKVPYEVKVPYAVHHHHETVKYLPPPPPPPRKVIEEEDRTKVIHDRRIREYWEQPRDPYRRDYCEEPPRRDHVHHQYWEEPERRERRRYYDDRC

SEQ ID NO: 1360 - protein, 603 aa, Unknown
  Kingdom: Fungi, Phylum: Ascomycota
MMEVGDVLKFAELAWFVYDYGWSPELNANRQYNEFFRDVEQLAQSLEDLAGVVKTARQSFTSRCLTPPPATFGWDRDTMLDIIGDFDATLRECYRLIKQNKSYAAASGPIMGPVVNVRWNAMVMPSVDRLRQRLLMHQAKIQHMLRPFEIDLHIRIHRDLAQRINDVHEDVRLTQTDVRTILREIKALKRHFDPSPLLDGEPTQQDNVPNTVPIPDVILQRLEHSFAMHPERVSNSGGAPPLRDMADAFVKNLDSASPLYESNGAFLEEEEDGHTAAQYVALLTCQFLMPKMLESDEVTQAPAVSHWPRYVQSLHQQLQNACMRFNQSMTAGSLMDEISDLEISPIWEEEAPAPYIESATLPAAIEHILELPLKIDNPRRWRKMNVFRYCDGTDRRFRLLLTAGNDNQPAAETRRVDFDLEHTSLVPRYASPDGKEPLEMVLKPRDEMFRLEFFTRSDLYLFQQALTGYEVVDNYMSYRVKTIFVADRSAQNMKQYASIQLWQPARLDGNRTTEEADATDGEDDNDSFTSAHNTPSPCAYLIQSATKLHEHEQYPNITDKRFLEHAERCCLEIFRTCNITIALESRSPKDGNRAGQPDTTTAT

SEQ ID NO: 1361 - protein, 562 aa, Unknown
  Kingdom: Fungi, Phylum: Ascomycota
MSEAITSHGWWRSRYLIVLISMPDHTKARAGKIGGCPTLQRLQTPRLRPNVLSIPSDEPYPRRESSTAGTRSSAEKEEGFSPTVRTKHSATREPKPLSPDRNSNDVRNPPSKERSPRITMPATKDQTQPQLLFVDGSFEELAAEMADYLKAEEAKQLLEKDPKKDEVLAKLVAAASGLNSVPEKEFTAASNLMIHLVMQSADPKKYLPSLCSVLAKPLANSPVNGPALSLNALTTVFNLLEPSSPIRARVFMEILKFLKAHTMFDALRPYLDKMAAWMEEWDISEEMQQQIYEEVADVALESGEETQAYEFILRALRTLDADDQEELTSEDAQRLSLRALKMALLSPTHYLFQDLRAIPSVQALSDSHPIYAQLLDIFAEQDLEDYNDFNEEHEGWIDQQKLDHDRLHRKMRLLTFASLAAATPSRELEYTRIAKALQIPSEEVERWAIDVIRAGLVEGKLSQQRGMFLIHKVTYRVFSQTQYRELANRVDHWRSTLQNVLTVLRQEQANAKAQRERELQEIERKLNGVGMGGERNQDRRRAHQQREPREPREPRERNDNDD

SEQ ID NO: 1362 - protein, 391 aa, Unknown
  Kingdom: Fungi, Phylum: Ascomycota
MASRTLEARFEHLTVGDENESSYARTKNLITTTTTALPQADGKPNIFKVALKSQTSNAVASVALPSQIAQQKGGPMSPPRKAVGSSTTTRKSEETIEEYKGISLTAYQPSIPKQFHLGMFEIGRPLGKGKFGRVYLARERTSGFICGLKVLHKNELQHNNVEKQVRREIEIQSNLRHPNILQMYGHFHDSKRVFLILEFAAKGELYKHLRRENRFPEWKAAGYIAQMASALRYLHRKHVIHRDIKPENILVGVHDEIKISDFGWSVHAPNSRRKTMCGTLDYLPPEMIKPGTKDNYYNEKVDLWSLGVLTYEFLVGEAPFEDTPVMTQRRIARADMSIPSFVSPEASDLIKRLLVLDPEKRIPLEQVAQHPWILKYCVKGERATNRDKALR

SEQ ID NO: 1363 - protein, 259 aa, Unknown
  Kingdom: Fungi, Phylum: Ascomycota
MPRVRQFKCKGRSSVRSAGERRGGPGLGCLFHAGSDYGGGTGMSMTLLAGVVTTFGLAPPIKHQRYIVAAIEIQRLETSVLPYQPGKLLSSTTFPHVFTARFDLEGNTFWEFRPRGAEKWRRIVHYPRSTHYSSVKVSPLWHQWLRYTREHPPTLEEQQNEVVRQARMKHLASAADARWEAKPRLTDAPGAATGQRAPAIGSAQHAQEASKGPVADTGTNAQNVQQEKQTSDPWAKARAQGPGEKWQPEAWTPSPAKKS

SEQ ID NO: 1364 - protein, 809 aa, Unknown
  Kingdom: Fungi, Phylum: Ascomycota
MEQDAEVTLQPPSPSRLPVESPGGSALGALGNSQMAQNVDWFSLNWLSPNGATVLGGFDQTNIVVDSSYQTQGIYDLFNFPLAPGLGPAEQWAWPASAPNVDRTLPPLDPSPVSAQIAEGQIHNSNSRFQDVVDGTDTSSASRGTPATLYVDGEASRAPFKGLAAQRGINIDDEESVEGSDIDHPSVTGQCAKGVLSREAVGNILSGVKNSVSLEQLRGGCFPTSQQLQTFFRLYFRYFHPSFPFLRPDSRYYDDESRWPLALAICAVGAQYCTKSDSTLTRHFMTEVLHQYNCNVNEQASVHGWCPPSVEGSTSEDTVERQLCVIQALLLDLICHFYAAIEPLVQHTSTSHFKMVQMCRDMGLLKKFCPKIELPVSPDVASSVNTWVLQQSCLRTGYMVWLLDSILSIENESETLLSLGDIQCDLPCRENVWRQPSAAAIARGGANTLGFLDAMEMLYIEKKLPKGLDEFGTIIMVHAIIQRTKAVVKQYQTGLASWIPSASSQKRAPSRRVEETWPPCLPILSRWRNSACDCLDVLHWNANSISARDGGWETFTIFHLHFSRLVLLAPVGPLRVLACPSATGRSTSVRHALAIQEARQKILNWAINDQYKARLAVIHAGALFWHVRRYSINSFVEPFGIYMATLVLWGYSMASQDNTQIGLTQNEGANHPLTHTEDSYDRSNPSPNLTSSIRSTVESSPLSGIDEDPEVMQFYVDRPCDDEIVQAYVRHGRRMTARLSHVGELCHIDAPQKVIIQGQRILEARQRATKQRSSHGDASSPLSPGVPVTWGITEHYLKILRGFLQAECT

SEQ ID NO: 1365 - protein, 198 aa, Unknown
  Kingdom: Fungi, Phylum: Ascomycota
MSTTPTGSQYGGDHETHPTTPRGLPPRDLPEQSVQQSLGDIRREAAVHMDHPSGSAPLAALQSTRRPDDQSLNRAASEPVRLDMLMSQQQQNGRDTPSTSSHLPDFDWEDFEARYERALEDADDHEREILKEAESLSKYFRAWASAASVQDNERAVKRLQTRQRFVNISEEKMAQKQQHYEEVVKAFESALALLRSHA

SEQ ID NO: 1366 - protein, 165 aa, Unknown
  Kingdom: Fungi, Phylum: Ascomycota
MTNSITSAPFLQRELSWHAHTEDADNVRGRSRVRTLSRGSVGKSVHPDESSTLRGRSRRRAASPNGLASRNSSPALGSILYYRLKESGRREHCPSRPASSSSTRRQNSPRRRTQRTRSRSRNATRAAVESMLLETPQQQQSSGLRNEVLQEDAIGQSPMDSDKQS

SEQ ID NO: 1367 - protein, 939 aa, Unknown
  Kingdom: Fungi, Phylum: Ascomycota
MDAGHDSLVTVRLSEPPILTVDTTLAEAHDQPLRPATMMSPNDGSIAGTPGAESTTDTATLRDSMTHPPNPDANRTLDEELGDFAADDQSRRSVSSEDLDEVDWEQLERTEDEQTKDEETDNSTALLLARLEQENAKLATNPKSVKVETVEQSSASRPRPPSMAQLRQMVTGPTPPNLRYSMLPPPPMTDLEFYAALVKDYQQTAARLPTLLSNKIRKGIPPPLRGVVWQSMSGARDATLEDQYDRFGGESSPYEFIIGKDLGRSFPGVDMFRDPEGDGQRMLGRVLKSFSLYDTKIGYCQGLAFLVGPLLMHMPDKQAFCVLVRLMERYDLRSCFLPDLSGLHVRIYQFRELLRQLLPALAAHLEELQVDPAYVSQWFLSFFAVTCPLPMLFRIYDVIFAEGASETLMRVALSLMRKNEARLLACTELEDAMQLLLSRGLWDCYHYDADEFVQDFASLTGEVSREKLSHLEQGYRESLIATANTVRTSAITTAASRFLGRIWANSTVLSPKSTLSPGLAAPSRPLSLLRRSTSKQSLASTLNSMEAGSNSVVSSTSTDATHMSRDSSNAEDESGSRESTPVGPKVATSARTTDERHLHSQIEDLLTALSELQRDHALLSSQLQREREDREEDRKAVQSLLESLKSQQNEGTESHDEAGTTTEANNEEEKSVAPTLDEMVEMVQNRFYVDGERPRSSLMHTKLQLRDELASAKEQLIGAMSQSQELSRRIHEQDQELAALKDQVRESHAHVRSLHQDKQRLEKQVHNMRTRSSSVSANEAAAHEGGSDWSAKGAGGGLRELKLGRSRSSPSQPAGFNRRVSSMPRGHESLVQAVAPTSEHDGLLLELVQAKTAEAIAKQEAEEAKQKLEAFRKAFGLAPGDTPKGAPTAAAGAAGAALGVFGRLTGQTTIIPTSESQPNLGATGTAGNTASGGFWGWRK

SEQ ID NO: 1368 - protein, 750 aa, Unknown
  Kingdom: Fungi, Phylum: Ascomycota
MAKDKKKGGADAKKARKAEKAAKQASKGEKKIKAKTAKIEGSDAEDVDLDEVLEEYRRQQEQFLKVTETVLEGPPRVRAHGTFMANPADSNTLLLFGGEYFNGSLAQFFNDLSIYNINRDEWRSVTSPNAPLPRSGHAWTRAGNPNHVYLFGGEFSSPKQGTFHHYSDFWRLEPATREWTKIEVKGKDKSPPARSGHRMTYWKQYIILFGGFQDTSNQTKYLDDLWIFDTVNFTWHSPKLPPAQLKPDARSSFTLLPHEQGAVLYGGYSRTKAAVALKQQKGGKGAQNAGSKNVLKPKVHEDCFFLRMTQPAADAGPNALPAVRWEKRKKPANAPNPPRAGATMTAHKGRGILFGGVHDVEQSEDGIDSEFFNQLFAWNIERNRFMPLALRKPRQQKKVSVESRGGRRGRGQANEDELLRNLAALNAGASLDDADDMELDKKEEVEEEDKPTKEMPVTMEPPHMRFNAQLTVQDDVLYIYGGTFEKGDREFTFDDLYAIDLGKLDGCKEIFMRPNEDWVESEDEDEDEDEEDEEDEEDDEDDEEEEEEDRAQFHTPSKRKKKQDEVSDTSSEAGTAPSVTSDEDDTETTATSVDDGLPHPRPFESRREFFVRTSAEWQEILMTSLRWKGIQPETLAIKEIKTKAFELSEEKWWDCREEITALEEEQEAAGISEVRSSSTTPSADQPALFPFALNTTEAALLISHEGCFAMGGYCLPSRSTLGSQLQRSSVLMVSMTIGTWLPQPHQVVFS

SEQ ID NO: 1369 - protein, 429 aa, Unknown
  Kingdom: Fungi, Phylum: Ascomycota
MSFPTPLWMNLPTNPMVPPATAASSRPVTRDGSQTPSQLSQPPTTPTVLTKDRERKSSIYSRRASFSSQRRRGSTVGASTDGIVTDASAPPALPYYALAAAAKVASQQPREQEAGEFIRSPTFPEVLGDGWGSKMLSRTATNTSNGERPPTTPGGSLAPSSGFWAQHEAQVVHQQVIDIANKRINFLDYLRKVHEGRRYWFNTYLFDKPDLARMPHFDPRKMSRKATNFLLLGVSLPVVVDLYSSNAQEFLRSLNLLLAEFDSFQQLHNDSASRNRLPNMFRRPGVKSRRSTSNTDVHSVTEDAFGGPSPGGVNTAPASVMNFAASESDLFPGEEYTHLLTPALPFEPDYFETFATLCDVLIDSYTRLLTLIPTPRECSSSLSEQFSKMDSKIKKLIFQGVVKEFEDHSRASIKTEVANIGKAVLSGLM

SEQ ID NO: 1370 - protein, 123 aa, Unknown
  Kingdom: Fungi, Phylum: Ascomycota
MSFFKKLFSFSAPSPEAMAKAAEKAQKLIDENSVVVFSKSYCPYCRATKKTLTELGADYKLIELDQESDGAELQDALQQISGQRTVPNVYISQKHIGGNSDVQAYNSKGQLTSLLKEAGAIAA

SEQ ID NO: 1371 - protein, 545 aa, Unknown
  Kingdom: Fungi, Phylum: Ascomycota
MTGARLEEKFSSSYDNGSAEQQPVQSNEYNLAAEHDQLERGLKSRHIQFLALGGAIGTGLFIGSGAILHDTGPAPLFMAYITMMIVVWCVMNVLAEMVTYLPMRGITVPYFVGRFLDPSLAFAAGWNYWYAYAMLVGAEATAAGIIIEYWKPPVGIWLWILIVLIVTLGLNIIAVSVFGEAEFWFASIKLITIMGLIILGICVAAGVRQDGPRGFRYWNDPGAFAEYNATGATGHFLGYWHAVVAAGFAFITSPELIAIAAGETVAPRRNIPKAARRFIYRLAFFYGVTSLVIGFMVPYNDDRLLGGSDASASPFVIGIKNLGITVLDHIINAAVLTSAWSAGNSFLYSGSRVLYSMSLDGNAPRFLSRTNKQGVPWVAVLVTWAPGLLAFLNVSNTGAQVFNWFVNISTISGYIAWIVVLITYIRFRKAMIFNRMLDALPYKTILQPYASWFFLCFLIVLTITNGFQIFINGNWDYRNFIAAYVTLPIFLCLYLGHKIYFRTRWAIPVHEIDVITGKEEMDRLEQMDEERVPSNIFQRFWYWLA

SEQ ID NO: 1372 - protein, 594 aa, Unknown
  Kingdom: Fungi, Phylum: Ascomycota
MSAPEPSSIEAPADEPKLIYKTKSIHSGQVDWQIRATHRGLSPRHVQLMAIAGGIGVGLFVGVGGVLRSAGPLPLLCGYLIYGLGFIWPLGLMVAEMVSWLPIRGSIYELASRYVDPALGFAMGWTYFFAGAMLVCAEYSAVATIAQYWTTSVSPAVFVAACMIICYFFNMVAVRWYGETEFIMCSTKIILLVGLILATFITMVGGNPRNDAYGFRNWMDGNLAHPYYTEGATGCFLSVCISVRYAVFTIGGPDFISLAAGEIQNPRRTIPRVAKMIAVRLVSFYVLGVLAVGIICPSRSPRLLGAIEGGPSGAAASPWVIGLLTVGISNGLPDLINALILLSGLSCGNAFLYAASRTLYSLAQDGQAPKILLRCTKSGVPWVAVTTVTAISLLTFLTASNQASVVFGWFVDLTTVTLIVNFTAMTVVFIGWCRVLKAQGIPRLGKNNLTTTWWIRWTGRAIESSPRPNDEHSEEGIVFPYIAPFASWIPYTSFGLGTVITLCIGFDIFHPFSVRGFITSYFGLMWFTGMFAFWKVFKRTKFVNPATVDIYADGLKQQIDKDCRMWEKPGAVEREQEMLKKMNPFTRLWIKIWN

SEQ ID NO: 1373 - protein, 719 aa, Unknown
  Kingdom: Fungi, Phylum: Ascomycota
MFLAYIPPSVVETRLKTSQGKVAELRLELNSGGKKDKNYAGKKIALKKIVANMTMSNNDMVALFPDIIGCMHIPSLEIKKMCFLFLVNYARMKPDVAVKAIPLLELDMEDSNPLVRALALRTMSYIHVREFVESTVPIVKHLLRDSDPYVRKTAAYCVAKLYDHDRGMVEQSDLIDRLNSLLRDDNPTVVASALAALMDIWERSDAIKLTIDYSNASKMVAILADCSEWGQTYILEALMSYVPQDSGEALLLAERISPRLSHSNSSVVLTCIRVILYLMNYIADQKQISALCRKLSPPLVTLLAKGPEVQYLALRNALLILQRRPEVLKNDIRVFFCKYNDPIYVKVTKLELIFMLANEKNIDEVLTELREYATEIDVHFVRKAVRAIGKLAIKIEPAARRCINLLLELVATKVTYIVQEATVVIRNIFRKYPNQYESIISVLCEHLDSLDEPEAKAAMVWVIGQYADRIENSDALLEDFLYSFSEEPVEVQLALLTATVKLFIQRPTKGQELVPKVLKWATEETDNPDLRDRAYMYWRLLSTDMNAARQIVMGEKPAITAESERLDPATLEEMCLNVGTLATIYLKPVQTVFRSARPRKLIDSPALQKQNLLVADSQKSISMFGNGSKPTDIDTRTRNAGRAAANGALSPQAVSDADAYFSSVGSAQQQMATMRIDGGDDLFSGGAGGGTGYVVNAHAPQAVIQPAQGAGSNGDLLVL

SEQ ID NO: 1374 - protein, 595 aa, Unknown
  Kingdom: Fungi, Phylum: Ascomycota
MSLSRTSQQAALRLAARRPLRACSSSSSTSSSASSAAAAAQFPCRSRTTATTRRGVAGLTPPHQAAAISRLPTNVDPSSDEYRDNAQQMGEVVSRMQELARRVQRGGPDKARDKHLARNKMLPRDRVTALVDPGSTFLELSPMAGHELYPEADVPAGGIITGVGVVEGVTCVIVANDSTVKGGTYYPITVKKHLRAQAVAQENNLPCIYLVDSGGANLPHQADVFPDKEHFGRIFYNQARMSAKGIPQIAVVMGPCTAGGAYVPAMSDESIIVDGQGHIFLAGPPLVKAATGEVVSPEDLGGGKMHSSVSGVTDYLAVDDAHAITLARRSVANLNWPRGTQASTVPPAETFAEPLYDPEELLGIATTNLRKPMPIREVIARIVDGSEFSEFKRDFGTTLVTGFASIYGQKVGIVANDGILFASSSVKGAHFVELCSQRGIPLVFLQNISGFMVGSASERDGIAKHGAKLVTAVACADVPKFTVVVGGSYGAGNYGMCGRAYSPRFLWMWPNARVGVMGGEQLAAVMETVGQKVDPELKARIDRESDATYSSARLWDDGIIPPQHTRRYLGLGLRAAMGGRNEVKAGDTKFGVFRM

SEQ ID NO: 1375 - protein, 610 aa, Unknown
  Kingdom: Fungi, Phylum: Ascomycota
MASPSISLERILAAVPATTRGQPTPLSTDSKGQRIAYAAGKSIFVRSIDDPSDCKEYTGHTATTTVARFAPNGFKIASGDSTGMLRVWEPETIESTRGEYGIISGRLTDIAWDGDSQRVIAVGDGREQFGRCITADSGNSVGEIIGHSKAVNAVAMKAQRPFRAVTVGDDSNVVFYHGAPYKFNEKTTLHKGFVLGAAYSPDGSLFATVGADKRIQLYDGKTGEPTKQIGEGEHTGSIFGVAWSQDGKKLATASADQTVKLWEADSGSLLQTWKLGDSVDVGDQQVGVTIPHGRSDGLIISVNLRGELTYLNEGKEAPVRVINGHDKGITALIAGSDGSASTLISGSFDGRVCQWDIKTGLATTVDGQAHTNQVTQFASVSGKTYTAGWDDTLRTVDESAKTFLGDAVKLPAQPKGIAADHGLLYVATTSGVAVYSGGKLVKENTLSYIPGAIAASGSFLAIGADNNSVKIYSSDSSGNLKEVKSLTNPTGTISALAFSKNGEHLAAGNSVGKIYVYATGSWDLVADRWSAHTARVTCIAWDESGAYAASGSLDTNVFVWCLEKKNQGKRIKAPNAHKDGVNGICWVDGGKVASAGGDASIKIWGVQNLP

SEQ ID NO: 1376 - protein, 905 aa, Unknown
  Kingdom: Fungi, Phylum: Ascomycota
  misc_feature (241)..(247): Xaa can be any naturally occurring amino acid
MAEYGKMDPFSFAGSKDVDHPVSIRIIDLEGDEPPLKASTLFERPDLRHIGSNTSPHSDLYVTAQVWAGSKPLTVPMQTAYKPFRSERRWNEWLHLPIDYNCLPADASIAITIWDLSPTGGPKAIGHAVPFGGTTLPMFDDDNQIQKGRQKCLIHRHKHADGTGNTKTPALVLSSKLGKNAARRGETPAIDKDTEELDRMEKLFKKHEMGEIPRVDWLDQMVFRKFEKKGLQAAKSSMKMXXXXXXXDGRPGVSTFLLNVELPRFDLPVVFSDHEYKAPPISAFQPLSASQGNLAQREPQVQFGPGINAMSDSQGDYGARLIKVFDPEVGQRDNPAEAKHRRLFRSSHRHGILDKDLKPNSKVRDELNLIMSYPPTHVLSPEETDLVWKFRYHLTRDKRAITKFVKSVNWADQSESKQAIQVLSRWTEIDVDDALELLGPSFSNPGVRSYAVDRLRKAGDQELLLYLLQLVQALKYEHISTDSEQDSTKDSSLARFLIQRAAANFMLGNYFHWYLMVECDDHSPEQGPENQSIYRKVAYEYMVELVKHEDGVEDRKTLLRQAEMIAILSKIGTDVKNSNDSIAKKVERVKHFFADPKNELLVFDPPLVMPLDPSIQVTGIVPDQVMVFKSSLNPIKCSFRTTSGAIYPIIFKIGDDLRQDQLVIQIITLMDQLLQKENLDLKLSPYKILATSTSAGASQFVQSQSLSSIVGKFRNNPALAYLKHHNPDDRQPLGVRLEALDTYVRSCAGYCVITYILGVGDRHLDNLLLAPDGHFFHADFGYILGRDPKPFAPVMKLSKEMVDCMGGVHSEHYRNFKQYCFLAYTALRKSSNLILNLFSLMVDANIPDIRFEPDKAVLKVRERFHLELSEEEAILHLERVIEDTLTAFAPVVIDKLHEWAQAFRA

SEQ ID NO: 1377 - protein, 530 aa, Unknown
  Kingdom: Fungi, Phylum: Ascomycota
MPPPRGSGLITRLSRPHIAPRLATTSLAYRRRHFTSNSKHTAAVSSTRVTDSHAPPPPPISGKHNDGDKTFYPGEPSGPTVKTEIPGPKTKELIADLESVFDTRSLNMITDYEKSVGNYIADPDGNVLLDVYAQIASIPLGYNNPVLHKASSSEAMVSSIINRPALGNFPPHNWANLLREGILKAAPPGLSHVFTAMAGSDANETAYKAAFMYRRQKERGGPEVEFTEKEMQEAMDNKGAHLSIMSFRTGFHGRLFGSLSTTRSKPIHKIDIPAFDWPQATFPQLKYPLDQHVAENEAIEQAALDEVSHLLSTWHIPPAAMIVEPIQSEGGDNHASPAFFRKLRDLALKHEVLFIVDEVQTGVGATGKFWAHEHWNLETPPDMVSFSKKAQAAGFYYKDKALRPNKPFRQFNTWMGDPARAILFSSILSEIERLDLVNHTARVGSYLFGKIEELANRYPDQFQNLRGKDRGTFIAFDNPKRDEFLKMAKGLGVNIGGSGDRAVRLRPMLVFQEHHADILVEALEKIAKAL

SEQ ID NO: 1378 - protein, 361 aa, Unknown
  Kingdom: Fungi, Phylum: Ascomycota
MATKRANDDGEIPDAKRQQLNGFHPNVLNLTAWSRSDLPASTTAAAAATTLPPLPPLPKPANPRLEEQAFNHISLNNNENYEELEWLGDSWVELIATKLIYETFRGKLKTGRLSQLRERLVCNRTLASFLRAYGLDSRIKIQSEILNPAQEPKANDRRRTKDALTTVQKIHGDVFEAYVGAIIESDRENGDRIAADWLKKLWSRELQDEIRTHAGNRDSQITAAPADSSNPSATTPTPTSSTSALAPAPTTTNVPKPSTLSPKVLLNQAIACPGVVIDYRDMPGKPKKDEMGHNLFAVGVYFSGWGVKDELLAVGRALKKSEAGAKAAEEALRNKKVLKTYGDKKQAFLKARDAVAASERT

SEQ ID NO: 1379 - protein, 534 aa, Unknown
  Kingdom: Fungi, Phylum: Ascomycota
  misc_feature (84)..(87): Xaa can be any naturally occurring amino acid
MADSKQPPQDPAVSPYGNLPPPPPGPPPFQQHQPPVQDESHPSPLSANPTQVMDDQQRQQQELLDYYNNQLKSSHYKLAQTSTXXXXPPQPPRPTQVQNPQQQQQQYSIPQYNPADPAFANKPAYAIPQDTQVNTAAPAATNPATGQPTTDSPSSAHPNSAVEDEHKGSKWSARFSNLGIKAAAPINQLAHKLGSQSFLPEALNKECDKAASILQSFCKSGVYADPTSNSKLPASLDPGAKESTGGIIDPNKEKPKSRVLVTIPPKVIARALGLAIFTTFRAGFNVTGATGSGILIARLEDGSWGPPSGIQVHSVGGGFTIGVDIYDCVCVINSKEALAAFTNTRVSLGSDLAVTAGPYGAGGAMDVGHGIQERKSSGSPPPPAETTQSLKPEEKKSHRRSLSASSFKPVFSYVKSRGFYAGIQVDGTVVVERKEANAAFYGARVSVGQIIKGQVPVPSQTAAPGTWPAGAQALMNALRSVEKGVVGGEGSPAPVSGPSVPGGAGPGPSVPGGDDLPAYDERLSQPAAGDYKYA

SEQ ID NO: 1380 - protein, 255 aa, Unknown
  Kingdom: Fungi, Phylum: Ascomycota
MYLRGVHADATIPMLRQLIRDNPLGILTTAIRSKSYPTIQSSHIPFILDVKDDADESELGVLRGHLARQNPQSKAMMDAAAQEPSAQNVLEDEVMVLFSAAAHHYVTPKFYTETKPSTGKVVPTWNYAAAQAYGKARIFYDSKADETGAFLSQQIHDLSKHAETSVMGYTGAGDRPGPWSVSDAPEPYIKLLQKNIIGIEITIERLEGKFKMSQEMQRGDRDGVIQGFENLGSEVGSQMADLVRERAELKEARKG

SEQ ID NO: 1381 - protein, 937 aa, Unknown
  Kingdom: Fungi, Phylum: Ascomycota
MSGQDSSGSQGAASPVTPRREKKKRVGFHAYSTSLGGSSSQNVRLDVHAPGEDTVSPSAPSSPHLLPGRLPPGAPDADELRRELTKVISNGEINRAREFAEPIPEDRDHLNPRIIISEPMTPVRPRPALRRNTSYDVQQEREEADRMEEIASPRQRQSLSNARRRADQLAVSLSSHSAPGSRRNSEDMEASFASFQSILRGSQDRDDETPELPPPRATEHRDAEQEFASHQPQPKPPTLRKRIFGKKHDDNDDSTDRYARAAKDLVRSHISSRGRSELYHQHHRESLHGSLPSGASTPVMHDNDPYDDYVPRPDRYRGNVLASLLKLYNDKGGLDSGRSTPTSAPATPVMSPMNSPPTSRSSSPVRKPKHHRTSSFFSYKTGSTSTLSVNELVKSSAMIAAPGSGKQISDSVVDKIKRSSTPKSKKDHAKITVHIAGIIFRHRYLMKLCRALMMYGAPTHRLEEYMSMTARVLEIEGQFLYIPSCMIISFDDMSTHTTEIKIVRVPHGIDLGRLCDVHDIYKDVVHDKLGVEDASKRLDEVMARKPKYPVWFRIFLYGVASVSVAPFAFEGRFIDMGPAFLLGAILGVLQLVFAPSNELYAHVFEVTAAIATSFLSRFFGSLQGGNLFCFSALAQSSIALILPGYLVLTGSLELQSHNIVSGSVRMVYAMIYTLFLGYGITIGASLYGMMDKNASSAVHCKEPLDRNWNFLFVPVFTVCLALVNQAKWKQLPAMVFIALAAFCVNSYSKAYYDGQGQICNMLGALTVGILANLYSRLGRHFSNAWLDALEFWEFKVRPRLSRLSRKSAEKWPTADDPESRPGTPTRDEQPKKTGRKTGYSLAAAAMLPAIFVQVPSGLAAGGSLLAGINSANQLTGNSTMDANKSADSSDPNANFDGTAFTVLLSVIQVAIGISVGLFLSALIVYPLGKRRSGLFSF

SEQ ID NO: 1382 - protein, 397 aa, Unknown
  Kingdom: Fungi, Phylum: Ascomycota
MAGPASPGTEGPTFAPPSLPAGWIAQWDGSSRKYYYVQLATGVSQWEVPTQPVQTGNTPANNGDPYAPPGSRPGQNGTGELITHPDGSQTVKHPDGTMEPIMDDGTRGGPGGPTGDRGMGTMALNALLGGKGNGGGNSNALSGLANQFLGGGHGSSNHHGGGGGGMGGKLVGKLASNLLSSSDKPAQPQNYHGGQSSGHQQNHGLAGSLMGGVASMFGGKPANDAGQNYGYSNSGSAGAGYSGQAPTYNPPGSSSGSTPYDQQGHSSAYSQQPSHHDQGSSYGQHGGSGAHMVSGATSGIPDHNSYGSQSHSTPSYPPPPSGGPPHGQSPLGGYPQGGGYASQQPPYGGQPPPGQYPPPPGQGGYGQPYQNGPGGHPQYGGQPPYGGAPSGGYGGRY

SEQ ID NO: 1383 - protein, 160 aa, Unknown
  Kingdom: Fungi, Phylum: Ascomycota
MRTYDDTFSGERIYPGKGKIYVRGDSKVFRFQNGKSESLFLQRKNPRRIAWTVLFRRQHRKGISEEVAKKRTRRTVKAQRAIVGASLDVIKERRTMRPEARSAARAQAIKENKEKKQAAQAAKKAEKAKNAALASKGQTVRNVSKQGAKGAQARIARATK

SEQ ID NO: 1384 - protein, 570 aa, Unknown
  Kingdom: Fungi, Phylum: Ascomycota
MTLAFPTIFLLPAHLQPEQLLDLEEKIPSLTYDIREAEIVLGRVSRPERAQFELRRAKLDTEPVEHHESEAADRSSEPSPKRQKLITGGAVEGTYVPKDASTVKVLKLQWLTDSLEKGVVLPIDEYLVYEGTICAETGASTASRVSPKGKGILERAGVAAANMSPRSSRRNGAGRDSQQSQPLRPALLHESTSDHDATLPPVPGFLHTAYSCQRPTFVNPPNADFVEKLKQVRTLRLLQGDQVGVRAYSTSIATLAAYPFVLQNITEVARLPGCGSKIAVLWEQWKETSTLQEVQEAAHDERLSVLQTFYHIWGHDMLIISEGWRDLDDLTEHAWGSLSRVQQIGLKYYDELLRKIPRAEVESIAATILSSAQVIDPGYQMTIVGGYRRGKEQSGDVDVILSHPSEDKTHNLVKKVAMRLERTGHIKWILSLSTRNSERGQRPLPWRGEGHRGSGFDTLDKALIVWKDPANESAPHRRVDIIISPWRTVGCAVLGWSGGTTFQRDLRRYCKKEKNLKFDSSGIRSRTDGAWVDFEDGDSGARAMNMEDAEKRVFQGLDLEYRPPEERCTG

SEQ ID NO: 1385 - protein, 642 aa, Unknown
  Kingdom: Fungi, Phylum: Ascomycota
MMSSLQPGMTTRARALRNLQGPKTPEPLSDGQGCPPSPPRPRFRLKRRNAPHLHAPTQQFLASVAAADIPIPSIEEPHVVDEEMVDMVYPVIPSLHDIESIDFMDNSLRGRTFSVPKTPAPGTVPSLSPKRYPDWSIGSTASDLESSPECGSSRPSTARSTQTSASLFSRYSVTSEELSQCVSPEMERPEPLAASPILGPGDKTLRPIHRTSRSRKAPWTKQMSQHLWFTYMMYLQDPKVTPFRANKSGIPPPGVCSRVAREAKRSWKGSKSQKANVAMSGSNTPTGDGATAFMQWPHTCAATRAHLRELCKLNASSTGLSRQFFAHSPTPFGRTTTATRFLNRRSNNARSPSVFSGKDMAVSLTVSTADSMQLHGPLAQLTSSQDDITPEPPMTPIQSIQVPPAAPQTPPPVMRRLGSPFAARSYGPSSSSSLGAAFGSSLDNPRQNQTLGPRRSLRSPVMMGDGNSSSQKRPFGQPSAEPRKSKRPSLATDLWTEPPAMAPQHVQPSPYSQPVPVEKRRSEDFNGPRTNLQELFDAPQPRAPSTTLVPQAKEVIRESRARLGSPFSASSSSHSFPHRVLSSSDMGLGVIRRPFATIQQTSEGQATPAARPSLASRLAYIDERLRDFRHRDRARQQNQPSL

SEQ ID NO: 1386 - protein, 637 aa, Unknown
  Kingdom: Fungi, Phylum: Ascomycota
MSADELKSLFSPNKPLEPDILSELQSIMRLHDLSAEDLFFKWDAYCIKMGTETEALTLQAIRNLKQGIQDSLEKSNNQRHTQVKTERRVQATPRAGAGGDVFGMLDGLVPSTPGSGPRLGKSGSGMKRKMETPGMMSSPAGIGDQLKAMNGLPATSFADRANAGDVLEILNSSLPAAEAPIAPFPESRVKLTAASDVKKMAYKPLAMKLSEASEVLDDRIDDFTNLVQEFHKLDDSAFGSAANQGTTEIVAVGRIASDSPEGGKLNAASIVLETSRRTGMGFRVPLKMDKIRSWSFFPGQIVALKGSNATGSEFVVDEILEMPMLPSAASPPSALEAHRERLRGGPDAMDSDSEPSPLSILIAAGPYTADDNLDYEPLHALCSQAADNYADVLVLSGPFLDADHPLIASGDFDLPEEATFDPDTVTMTTVFKYLVSPALNRLVAANPSITIILVPSVRDILAKHVSWPQDTIPRKELGLPKTARIVSNPMTLSINEAVFGVSSQDVLYGLRGEEVVSGGGGGQKLDMMGRLCRYLVEQRHYYPLFPPMDRSRLPGTGTEGGVAMGAALDVSYLRLGEMVNVVESVLAINPGTLSKRKGAGTYARMTLHAPSASGDGAAEGVLSHKVYDRARVEIVKI

SEQ ID NO: 1387 - protein, 2581 aa, Unknown
  Kingdom: Fungi, Phylum: Ascomycota
MDSPSCADRPASAEGNSTRPNPFDDTDASSRKRRRTGSPVDEAEPLITALDGSSDQANNFDIDTSVDKTRNSKEREPRRQPSSSKVTLNLRQTSTTPISLHSSPSRSDTLQEDKIPNQPSPEAVHKNAESVLEEAQTHSVEHPAPVTPPSGMISPSADVMSVQDDKEEDEDEEDDDLTTVLPVTALRAFHLEADAPIPNFPFHNGNDEVTETLQHIINHMNTQSPFASEVLASVNTWLGTFIPLLQNLDDRAVIHVCENGRFWQHMPELMHDIVKQTVSTPVILSTESRAAIVDFYQNYTMLTAAFIAFDHGSLREYATKADRNNAQLPDLFATNYLCQLVGPLGIGLPPIRNRETSLVADLLRARHDIAHCLQMIFRENTENNWDSLRRLIQIITDLIPSVPKLGNVLGPLCQTVELLARHTARLEQGDQGDTGVKRPLDVIHDFWKMLDASLRSTIEKRVSTLTQHAATTQLEALREGLKVYLVERPSVAFEMYSGDKSEEPPLSTGLEADIVSWEWYFDRLVQLIRSSQMQLRVYAATSMCQNLVNIWRRFSDWSDEEERNRLLNRIGSYLLRTNLVKYLFGPNCHPEIIVESANIIGFLVINKQYEAAHTEQLWSTITTTQDPRISEALCKMVINIASLFDYEGLLGLCAKLQTLPIRNFTPAIRQLWAAVLKHMTDKVHADDAAMTFQPYQLCLHLLRESSICTGGGSILAPELQSTALQGLREVLEVGDEETRRQHRQQLFTSCLRDLAAKSSSTLGSLWALSLAIRPAVASELSLLTEQHGLTQLVVEELHHAVQSSRDAGATSVLCGAHNHPRREFVAQIIQHEPLTLEGKLGTQLWDVLVGPQAACQLDRSAGWDILNTAVRKLSFKNHYLSTCFTDRLPVLPSSCFCQGVLEFVRAQVLPMACDANGSFFEDDSITSRVGLEQLWRIVTVSEDSKLAEVAIHTLSSDIYLDSPLIQTFPLSRTRQIHSSVVTRCLQLLRVSANNMRDRDQGGNAEANPTPSIKDECEETTEPQRVFDRTIQLLVNFLGRYRSKPGFAMPDLRSFMPEAPSQVEGDLTQLKYQSFDGKSQTDVKPLKIGNLNTAASLLARLREETGFDNYRAFYRGRPFVPTEDDVCKSLQDLQVREGLILVKKEEDELVSPSRVKAGSSPLEVELSGHFDELQGYLDLAEPMARQVLNFLTMLPADQYFMRIFEDSARSHRDIFPPSHPFRTLYAAHTLMPYLDAVQKAASRREEGTSMDKLFVSTHSDATQRCLHWISAAISDRDLSSFENLEVRFEIQTQLMCRFRRLLNVPRDPAASENVIHPPAEQLLELLSNVLSFGKANQVSELVGQTLAAILRLGLSSTTIWDKFTQTPGFAALFQDLILREPRQEVRLLLTRLIDDVLVLEAQRGHISDGNDVNRGPLTMFLWKNLSVLLEEAEDHAGQSFELFKTCTALLKHISASYTEEARTAIANTTRELAHILLQHESMEEPGRPEVFDVFTHSVVTMLLFCLDNDNISTAVEVLPSDFAASLIDRHLFPRLRQDEEEPVPKVILHPETRKQICEVVSRLVQYDRPSLKAVLPALHRLLPYYSNREDDVYHYDLPYGNFDRDKFIRASCGYTGLRNLSNTCYLNSLVNQLFMNPRFRSFLLSVKGNSRSKEPRLLNATKRLLSYLQESWHPWVDPEEFVSTLKTFEETPIDVHSQMDVDEFYNLLFDQWEGEMDSSENKRQLRSFFGGQLVQQVKSKECEHISERLEPFSAIQCDIKGKSTLDASLQAYVDGEIMEGDNKYKCSTCDRHVDAVKRACLKDIPDNLIFHLKRFDFNLRTLQRSKINDYFSFPLEIDMAPYTIEHLSDPSNSEPDLFELVGVLVHSGTAESGHYYSYIKERPTSTGRANWFEFNDEAVSQWDANFLEHATFGGYDYRSADDPNCAKSYSAYMLFYQRSSSLKAEQSAINRAELESSRISIDPSLKNHILDENTLLLRRYCLFDLSHPMLVSQCVQEARKTDTEGSMGLVRMRDVSPDSDSESSDSQTNHELQTSGIWLALNHFDQVVTRATGLPYLSLYHELLQSAVTSCTDCAAQVLEYFRRRAEAFRSLLQRNQDPGVRRFSGELLLLALQKLAEDRPWAYQPTAPLTPSGSSMTDGRSDDGKVAPRQMSVPESMRIILRHLWKGFHASIRAWDEIFSFIHGFGKLGAHETAVLLSEDWLLKSLRIVAADAAIETRPNYQRMLQALSRRSRPASFSAVISLIDFLLEALEQVVSAESIVEEPSDRLGVDPPFPWTSQEVSILLHHPRWRSSSLFVEKLVALEQSPIITDQILCRLMDAGDVMHLAVFSTLRNNIPGDAAAPLMNPFLRAAVCCVKNTQSLDFARKLVFHVACQAGKLQHGEGLAFVEFFKNVMSGGFAQDSFGRDIREKALENVPDWAPALLVSFEPIVRQVTSAFLDEQIFDVHAELDEQARVDDDESPEGPRALQAHMREVVQNLGVNCLVYLRDSHVKPQNPISKDAAESILRVITACRSFCHTDEVDSDMEHAAAYRVLYAEVLPALQPQIVEELDADVSEWDGSAASSEVGISDHLTRDITDVA

SEQ ID NO: 1388 - protein, 390 aa, Unknown
  Kingdom: Fungi, Phylum: Ascomycota
MANMNRYIKELESNLGPAHDAPKSSKQRDMSSRNKRGANRINNGNSGHGEEANIWENCKPALHDIIASINADNDNLNQLLEMDKQVGAMDSDRIPGSKLKSMEEACRKGVKNADNCVTKLQAVITQLEIIKGVVDAKEGQEAAAAGPSGKRGGRGDSATVAALYDFDNAGESPGPSPLGGSTSRKYGERANARDRERERDKDRARSREREKDRDRERDSMPPKADSVEPQGSVGSGAGGSSGGNRKSQAVFTKGDSVAFRPVASAEPVSDWILGKVAQVIGEGKARRYKVLDVEPEDPSKQKEYRTTAKSMIAITPASQAKGLKPWEAGQIVLALYPNTTTFYKAEVHSMEDEADVEEGEEPKVNLKFEGENDLDTVQQVERRFVIEYRP

SEQ ID NO: 1389 - protein, 287 aa, Unknown
  Kingdom: Fungi, Phylum: Ascomycota
MSSQDSISPPATRQNEAHHAAENPEQPGSAAQGRKKRVRNWTADDRAAHRVFERSRREAFKGRLTTLANLIPALQATDTNRLSKHVVLDESIALHKVEQQKLKALLQQCDRLLEEREELLSEVNRWRAGAGLGMREGRSIEPLPEPNTSPADHAATEQSQPDADEMASSMHSAPLQPEQEHDPLAAFEPLPTQMTPLNPPGVMAPTGVTTQNWDVMGMDMNMNTHGMENTMGYNDMFASNMVNYPTVIKPPGDLGPAPYVPNGPTFPPAPMNMLSPQYVGDPRVYGQ

SEQ ID NO: 1390 - protein, 1178 aa, Unknown
  Kingdom: Fungi, Phylum: Ascomycota
MVDALWRPGRMVLTDVVGLLHGNVWSSNGPGSSLSCPSVPYGATLTDPILRIVEVVLSEFENAVIRHPTEPEFTSSSLYNRHLRDLGMVVHRSQPFILATRLLLQAIIQQISDIASFADAVADMLDKVSTAHFMTARRLELETLSIGKSHLNTTRFLGHYVPIVQNLVNSLYARNPSPDCQRLSYLRDSASLMIAKTSPALNRIGDFLSTIPLSADNFGLQHGAGPYAIPVSPYAGVVAQDGEGLQPTPGFIAAGTSSSPITNPSTSPTGSMQNSSVATDSAAGEKIESNSTCTLCGYRPKGDPRWFGGSMAKHMKLQHATSPPKIYRSAYESTQVGRIGVPSQSVASGMSTVRPPLHLENFPITHRPVLLSLAFPLPPCVHASLLHASSLPSAVSINDTPKPGPGHYFHRWIVSISVWRLSSSIFREARCAYAVAFENSNALKIQPNTRLEGEHKTSRKNKTIYIDSKKRSTCLQYRSCVLTHDPDPSVTLLSTFVTQNLFFHVSHRVDPNAPITTCRAAAIRRGTGFASTHPNQNNKPSPAPHNASPYQSHYTSQQPTPSPYNQALFTQPQMNGPVPNGPSRNHGPHVSVPNGLGPRPRPPPPRQQMQTQPNPPSMIFPGSMGQHVQHDSLLSHQQQQHASHQGHPGHQGHQGHPQHTPHQSHQNPPHPGHHAQQQQQQHQQQQQQQQQQQHQQQQQQHQQHSQAQHHHQAQAQSQAHQHQPPPSQQQAHHQQHTQSQPQSQHPQHQQQQHHAQHPHHQQQQQQHYNQQLQQPQHPQQVQPPQQQQGKGTPQQQHRQTPQQQQAQLQNQNQQNKQQQKQQAQATPGSAPQQLAQPAGSAAIQRQRSQASRTPQQQAESIPQQQQNGKQADDMNLDGQDGEEAPGTLDSKMLQDPNYIPDGQPLGEMMSAPPEGGSYPTLEAVQKAVLRYCMSVGYAIVIGRSKKTVPGLKKVLFVCDRAGKPPSRVSPEFRKRKTSSRKCDCPFGFFAIEQRTQWTIRYRPDPTHLQHNHGPSDSPTHHPAARKLDSKMVAAVKQLKDNGAGVSETLQILQTENPDCHLLPRDIYNARAAINRNPAKVASGIAENKPAIYTKPNQSSEDRIRADLRRELAKAKEDLKKIEEEKQKEIDALKAKMAEKDEQIQRFEMFIDICNQRVMVQRERLSGSEGAAAAGRNPA

SEQ ID NO: 1391 - protein, 355 aa, Unknown
  Kingdom: Fungi, Phylum: Ascomycota
MDDKASPVLVTGGSGYVASALVQGLLKDGYSVRTTVRSLKNHKKVAPLRALQQEFPGKLELFEADLLEPSSFDAAMVGCSVVHHVASPFRMLEKIVDGQKEMVEPALEGVRSVLGSVERTPTVRRVVLTSTIGAIFGAYIDVVEKMQDQTLSEEYFNESSTVEHDPYHYSKVLAEKEAWKLYEAQATKRWHLVAINPGLILGPSLTSASESGSLFLLDELLSGQLFFGVPDLNFVLVDVRDVVAAHCAAQKVEAAHGRYIVSQDRMTPFIEMAKVARSQATGFRKVLIPTHKIPTWFVRLVGPLFGLNSKFIREHIGITFSVNNQRSITELGISYRPVEETLRDHSESWTKMRVK

SEQ ID NO: 1392 - protein, 772 aa, Unknown
  Kingdom: Fungi, Phylum: Ascomycota
MGRRGAPQPLRLSDPTAAATLTATTNTPTDANAAATLNTAGTSTSDLNSASSSQHHHRNPSPSNGLLTSSTTANAASSSAASPIDSLSPGSSPRVSPFTSRFSTRRPQTSRAASDERPHTLHSDEHTPPLPDHRPEASYPSINSKFDPAPLSAPATGSRQHPPVGGTRLQKSQTEHSKKFSRAGFFHFAKSSKANNSFYGSSPSSIGGDSHHRTSSRGKDTPEASSRTVDATQGDYSVQPVPSHPSNSELSISTTGDREAQSAPSSARKHKPKPFGLLTRTKSIRDNQSDSPSQHMAPPLPNNGTPAGHMRSNGNAPRTAPPIGQDRSFRDMMNSTARNRSEDRAPSRDASSNTLRDHHHREREHRAPPTAMRENGGSNFFSGLRSSSTKAADMISKGLFGKNSRSGHAHPAEPIIDDEHYELKVINLPLVEQTRKTRISKRLETSRDKTEFWMPAFPWRAIDYLNYKGCEVEGLYRVPGSGPQIKRWQRRFDEHYDVNLFEAEDLYDINIIGSMLKAWLRELPDELFPKAAQERVSRECAGAEEVPQMLIDELSNLSPFNYYLLFAITCHLSLLLAHSDKNKMDFRNLCICFQPCMKIDAFCFKFLVCDWRECWKGCLNESRYIEEEYRLFDQPPPRGLAEPAGPSNTGLEDRAPTTSSRMPEMEPEEEFHESREDPGTFRDRQMSSSASSKQSYQSAADVPAKPVKKKPLPLSTSNNSMASNEFSISTDITIGSEQRDHHSNRDHRNDNVRGTGDLRPLSPIKPLSPIGF

SEQ ID NO: 1393 - protein, 679 aa, Unknown
  Kingdom: Fungi, Phylum: Ascomycota
MDLSSDNNSEPGLEGSTYELISKEESAPNAHTMGTDSELQDDSQQDFDESVSESVGSLDQFRQDDVQSLASTDHIEDEEEDGFQNHYDDDDENDDVSTTPDDERSRLTDVTMVNQDGDHPVPHDFEGDQEVSDAESRSSIEYTRQSLGTPSILTPEASKILSPLRGDVPETIDRMRPSNMSSRNGESERNSELSISRKLRGLASSLLPPPPARNDQKAWRKYRDEHWLAHNTWQVFDVLRENPRQIVVSIFTVMLASVILAYGDGLRAQNAHQADFISVETATTTTTVIVESTILVPSVETKQAVHSSTGVALIPIHESRGEEGLFGYSLPLISFTPEGQTGVLIHADPSIPKTWKAQRECVKIHATRGEKTVPLNVSFTRSNIIAADIPKAEAYGIVQIKLSSKCRPKFEKSVKLHFGKGVIEQAFDRVGELAHALKGFQPEQLRNVDSSKALRSMSDNVDRTLTSAKEKGVEMVTSQWAVACQKLGPLGLSMMKASQEVSRRYHQAGEVVKTMSGRAEKPFLELKRQGLRITHNSIQTSRKYLGKAQDNLAGNVHSALQKAATSQRAHQIHLQQAVSSFDVEAMQKQLRFGLLDAQVAAKTWWLKATGRADQSKEYGRRAKEFIAELHAFASHESSSARKGTAHVKSGHCSKENCKNKCKSSGTGQGRKTHQCVAAA

SEQ ID NO: 1394 - protein, 603 aa, Unknown
  Kingdom: Fungi, Phylum: Ascomycota
MPHFYSSPGVSSRRRHPNSSLSSTAASSSFLEDMANVGGPTMLKRTLGLQDDRYSQYIGPTTDFEPSLINLSSFDPHDESLLSRGTLRRVGDNDTFLMLPDYNTPGHEHVTQDLDAIEAVVAPHGRKLIDLYFRVVHPGFPIIQKHVFIEKYERSYREFTPPILAAVYILAINWWHLSEELSHSPRPNVRELERIIRSTLADAMYRPKLSTVQAGLLLSQRPEGDQWAPTAQLVAIAQELGLHLDCSTWKIPPWERGLRKRLAWALYMQDKWGALVHGRPSHIFSTNWAVKSLTANDFPDVEWDENDIEEKQDIERGRLLFTRVVQLTEILAEILDTFYTLNAMQNVTEAGAQGTQLVLSMAKPIQLKLKEWYSGLPQSIRLDSSYGAGNIQNRLSSVGYLHLAYFATEITLHRRIIRSLASTASNVDPYVQHICRSAAKARLISAMDFVNRLTPNHLRAFWYFASKTNFALIGTFGSLLWATSPGKEEADWYRRRLGEYRWTLSVSSKPGESKGLTEFAMTMLDISTGLLKQLPEKPSMSRSESTTDFAPLSNPGSYSGPGSVIGHFSNVPSRDVSNAQSPQSADYDDSSDEEMDDSYATRM

SEQ ID NO: 1395 - protein, 222 aa, Unknown
  Kingdom: Fungi, Phylum: Ascomycota
MLRRTTSHRAYLAVSETPEAEARTHTFGPSIQHILDLALPHLQFVPQKNPPPEMASAGEKAQNYLGMLDSELSKYPAINNLEKQSGIPKAYAVIGAGALYFFLVVFNLGGQLLTNFAGFIIPGYFSLGALFTHNTEDDTQWLTYWVVFAFFTVAESFVNIVYWFPFYFVFKFIFLLWLGLPAFRGADLIFRSFMVPAFGRYFEKGSTASGLRSRASGADKTE

SEQ ID NO: 1396 - protein, 633 aa, Unknown
  Kingdom: Fungi, Phylum: Ascomycota
MAEAITEGAAKLQLDEETGEMVSKSELKKRLQKRAKKAANAQRAKDNPPAAKPAKENAAASKPAPEAAPVDPDAMFKQGWLAEVYKERPTKEVVTRFPPEPNGYLHIGHAKAIAVNFGFARHHGGKTILRFDDTNPSKEKEEYFLAIEDIIHWLGFKPDAITYSSDNFQKLYDLAEELIKLGKAYVCYCGKADIQLQRGGKDGKEGPRYRCAHANQDVETNLKKFRDMRDGKYERQTAFLRMKQDIESGNPMMWDIAAYRMPKDDEPHYRTKDQWKIYPTYDFAHCLCDSFEGISHSLCTTEFILSRESYEWLNKTLGVYEPMQREYGRLNISGAITSKRSIELLVKEKHVRGWTDPRLYTLVALRRRGIPAGAILSFISELGVTTAKTLIPIPRFEQAVRKYLEFSVPRLMLVLDPIKVVISDMGDLENTEVDAPFSPKDKTMGTHKLKATSVVYIDSSDFREVDSKDYFRLAPGKTVGLLNFPCPIKATGFTSDPETKKVTEIQATLDRETKKPKAYIHWVPEGSRKVEVRVHGNLFKSDDPASVEGGFLNDINPNSETVYPDAMIESGFDEIRKQAPWPKTEIEKISNGPESVRFQAMRVAYMAMDSDSTDDKIVLNRIVSLKEDSGKSS

SEQ ID NO: 1397 - protein, 355 aa, Unknown
  Kingdom: Fungi, Phylum: Ascomycota
MHRTYSMRQTRAPTASQLQNAPPPPSSTKSGRFFGKSSLGHAIRRNAGGAFGPDLAKKLSQLVKMEKNVMRSLETVAKERMDVAQQLSIWGEAGDEDVSDVTDKLGVLLYEIGELEDQYVDRYDQYRITMKSIRNIEASVQPSRDRKQKITDQIAQLKYKEPNSPKIVVLEQELVRAEAESLVAEAQLSNITREKVKAAYTYQFDALREHCEKVAIIAGYGKHLLELIDDTPVTPGETRAAYDGYEASKAIIQDCEDALTNWVEANAVVSSKLSTRSRTLSQRRRNNIRNRNEGHDLSGQDAPLNDGSSWQARDHDLDSEEDELDLDEKRQSSVLDNEGSLNGETRGRTQEAVVA

SEQ ID NO: 1398 - protein, 441 aa, Unknown
  Kingdom: Fungi, Phylum: Ascomycota
MTSQPFTIAFGPFAGLTLPYSTIEANAGHITSALIDAHLITHPHLDHIAGFVMNTAGLPGTRPKKLAALPNTIHAFKTHIFNEVIWPNLSDENGGAGLVTYLRLMEGGSPAMGDGEGKGYSEICDGLLVKGWSVSHGTCVEKHGRKGSVSSTSTRFGSHDASAQTPRREYNHPHQQSGARRPSLLSQVTMPTGGSGSPGGDSERASTCVVDSSAYFIQDKESRKEVLMFGDVEPDSISISPRNMNIWLEAAPKIAAGTLAAIFIECSYDDSQSNDRLFGHLKPVFVVEELTALAQEVASVRKELKAAESRKRKRTSVATEDGRTRSTPRHGMTPTAEIPLSPKSTLMRPSRGIDSTTVSQPETPHIATPTEGLSLGELEPFSISPQRQLEGLKVVIIHVKEKLMDGPKRGDLILEQLHEHNEDVDLGCEFIIAQQGQSFYF

SEQ ID NO: 1399 - protein, 464 aa, Unknown
  Kingdom: Fungi, Phylum: Ascomycota
MLSAALRRRVLAPTHNALRQGFSARVVRCYASFPDHQVVKMPALSPTMQAGNIGAWQKKAGDSIAPGDVLVEIETDKAQMDFEFQEEGVIAKILKDSGEKDVPVGSPIAILVEEGTDIAAFEKFTIEDAGGAAKAPAAPKKDEKAESSSDSSKSESSTPESTPEPEQYTSTEGRLQPALDREPNAAPAALRLAREKGIDLTGVKGTGKGGRINEEDVKKLVSSPAITAPGATFEDIPISSMRQTIANRLVESTTKNPHFFVTSTLSVGKLLKLRQALNASSEGKYKLSVNDFLIKAIGVASKKVPAANSSWREGTIRQFNTVDVSVAVATPNGLITPIVTGVDSRGLESISGKVKELAKKARDNKLKPEEYQGGSISISNMGMNHAVDNFTAVINPPQAAILAVGTTKKVAVPVENEDGTTGVEFEDQITVTASFDHKVVDGAVGAEWIRELKKVIENPLELLL

SEQ ID NO: 1400 - protein, 592 aa, Unknown
  Kingdom: Fungi, Phylum: Ascomycota
  misc_feature (203)..(209): Xaa can be any naturally occurring amino acid
MSRKLVDKALEDAKVLGIRNILALRGDPPRKDEYRDPAEAEGDDTDDFTWAVDLVKYIRKNHGDYFCIGVAAYPEGHAEESHPLGQSLEHDLPYLVEKVQAGADFIMTQLFFDIQAYEKFETTLREHPSGAFKTIPIMPGLMPIQSYQMIKRTTKLSHANMPDHILARLNDVKGDDERVKMVGVDVVSEMIEQIKEIKKATPXXXXXXXPKGFHFYTLNLEKSVSFIIERTGLIPDPPQEDVAVVDDPIPISVPLLRVNGTGSSRGRGTSHSRTSRRHSSVGSDPHNRVIVSGRATTHPEWEASGQEAAIPAGAINSRANTLAISEGEGVLGREATWDDFPNGRFGDSRSPAYGEIDGYGVSLHMSVTQAIKYWGHPATREDINDLFVKHIEGELAAIPWSEEELLPESSTIKPHLLKMNTKGWWTVASQPAVNGERSSHETYGWGPPHGFVFQKAFVEFFIPASDWAILKDRLAGPEVRDSVCFYASNAHGDFVSSDASGGASRGEEATSTNAVTWGVFPGKEIVTPTIIEEVSFRAWSEEAFGIWAEWAKVYGRGSESEKLLNSIRNDYWLVNIIHNDFVDKDALWNFLL

SEQ ID NO: 1401 - protein, 523 aa, Unknown
  Kingdom: Fungi, Phylum: Ascomycota
MHLNISTLALAAGLLATAGISTAQDIPADLPVSELLSTAQTHLARGETSEALTFYDAAIARDPSNYLTFFKRATTYLSLGRTNQAADDFNKVLALKPGFEGAHVQLAKIKAKTGDWDSAKAEYVAANKGPESVEMSELEEAKGAAKLAEQAAATGQWEECVNQAGAAIVIASRAPKLRELRGKCRFERGELEEGMADMQHLLQMKPGDTTPHVVISATAFYGLGDMALGLGQIKKCLHSDPDSKLCKKLHKQEKAVQKAVNKAQGQLEKGQSTSAGRALMGTGDEIGLVASIREQSDALRKAGHIPTSALPGLYNMVVEMTCHAYSESNHRDVDKYCTEALQNNANSFWGLLHKGKAQLRAENFEACISTLEQAKEADPSKRAKVEPILRKAQIALKRSKTKDYYKVLGVATDADEKQIKSAYRKASKQYHPDKAAKQGISKEDAEKKMASINEAYEVLSDPELRARFDSGDDPNSHESQQGRGGNPFHGSPFEGGNPFGGGGNPFVFQQGGGGAGGFKFHFG

SEQ ID NO: 1402 - protein, 492 aa, Unknown
  Kingdom: Fungi, Phylum: Ascomycota
MKTTSVLAAGLAVTGAFASDPLTPEKAVADIKTQELQRNLWNFNKIARDNGGNRAFGLPGYEASGDYILERVQKRFATTIDAHKQYFNHTFAQIRDISVTGPDGESVEVIALTYNPATPAEGITAPLIDTPVDDVRGSGCFADQWEGIDATGKLALVKRGTCAIADKLKLAAAHGAEGVILYHNVAGTPTAATLGFENIGLLPPVGTIPLSVGQAWSAKLAAGEELVVKLYVDSVFEERETFNIIAETKEGDPNNVIVLGAHLDSVQAGAGVNDDGSGSSAILEIIGSFKKYKGLKNKVRFIWWGAEESGLIGSLYYTRTLPEAEADKIRFYFNYDMIGSINPKFDVYVGDYAEADSYGATLLEDYLLAQGFPAKRAPFGTGSDYVGFIQIGVPSSGLHTGTSAGGYDPCYHLKCDGLDNINWDALTANTKAAARAAAILANSDLEHLPRRRKTTPAKRDAKSIRGEFQRWAALAEEVEHTHSCSHAKQEVV

SEQ ID NO: 1403 - protein, 155 aa, Unknown
  Kingdom: Fungi, Phylum: Ascomycota
MATQAMTSTSKLDIIHAYRRLLRGGLQAVQFSSPARFVVRDQLRAAFRETPAPPTSPPPSIISAQAVQAQGGVPPSSVSPSTGAAASSSASSFSSSSKAAGFDPGVAKRTAWFLEAAARDRGVEHRVVKNLIKVRLARQRATKKWKVALAEGRNR

SEQ ID NO: 1404 - protein, 88 aa, Unknown
  Kingdom: Fungi, Phylum: Ascomycota
MIAAEDDYDIPWTHSDHVFWHAVNAAHMTELTFEELEQEKLATRSEREAGGSVVEKKTAKGVIREEIAKYGLHDRIMSYPAIKAIDEE

SEQ ID NO: 1405 - protein, 217 aa, Unknown
  Kingdom: Fungi, Phylum: Ascomycota
MSHVSRVCAGGSPQPCRVPRLGNLGIHSPTLSAFAPRSAAWALFSFGTRSVSRPRRPGCRDTPSGLRIHPPLFRLQQPAPTFHGHASLQPTRSLTTLLTSVGCGSGVILLVPGLLHFCSLHQLDPICRQHPPTTHQPLSKATVADAPPFRFQPLRSSAALPYHPTKPSHALHAAPSPAILLEGRGGVASAAPYRGESGATLVCSNVLRRVKPRPIKA

SEQ ID NO: 1406 - protein, 161 aa, Unknown
  Kingdom: Fungi, Phylum: Ascomycota
MSTEEETPDITTKRTEHVQSLMDSLRASSPIYGFILPTMTLTSVTRGTVLTRLVLGPEHLNSRGGLHGAVSATIIDFTTGLAIASWDLRPATGASVDMNITYLSAAKQGDVLEVESKADKVGGSLSFVRITISKVAADGEKTIVTLGQHTKYLRPKPKTES

SEQ ID NO: 1407 - protein, 938 aa, Unknown
  Kingdom: Fungi, Phylum: Ascomycota
MKKISKILTARKRPDSESEGGSGGSSRSRSSSRSRSQTRSRSRGGGGKDGVAGGGAAGGVGGGGGGGFDATEVHQLPSRRGTPVSLARQKSGLLLAPAGGRDAALSTGRIIADADNDHHDDRLSDDADADDSSGTSNVPRLRARQRERLRPRYRVCAICAAINFPRLLAWQPGSPRPWIPLAHVLVPPPPLPPSPPASTDGTAASSSASTFASSTSPSASAATSPAAAHEPTPPQPPRCPYCAFFQAMLLDAGAGGTFTPYLRIRRAFERLGGVGERHALAGEVLGEVMTRNKALPWGYIIRAAEDDGDVDDDAQLKLYTASEEDGPPRIRGRNVTPLLDSRVPNCWLDYCRTHHADEPCCESNEGTPVSGLRLVDCKEKRVISVDDIDGDTPKYLTFSYASDEPHASNVLQPDNYLPKKLPTLFRDAIAFTTSLGFRYLWIDCYCLPAPEQRDQRTLHLDLLGDIFSRSSLTLIVAAGDDAHGIDAGIPGVSVPRPQQLSIKTPAGIFTTTLLRPDIEVATSPWSARAWTYEQGLFARRRLVLTPSQAYFQCRALHCHESIALPLRLAPGINLGRVFPPYAAPPRPAQLQDQIGAYMALEMPRNKDRLDGFRAVLREYTRLPGLAVDNFSGLPLFHPDAFVNVNVVSQTDRLAIGLGWTPERALTPSQSSVESDLPEPGYSLAPDAAFPSWTWLAWAPREEARRRSAASGSMTAATAVQSTAFHFHLLGEASPIVDGACSAPRMEISVGFADGAVLSWEIDGDAIRKKGESVEFLRLETYCFNVMVRRDGSNSFVLDEGGLPAPVAATILSWVRASPPLPARTSSAAASPSASSSSSSPPPNRGDSPKAPSSPPTASAPQTPGYGLVAVLISGRNWKPPAPSTLATGSGGGGAATLLVCHHRNWDPSAPLVRLGAVGIDFDVLATDEPHLGSAVLRG

SEQ ID NO: 1408 - protein, 309 aa, Unknown
  Kingdom: Fungi, Phylum: Ascomycota
MKIASSVAAALALAQIASAHYIFQQLSVGSTKYPVEQYIRQNSNYNSPVTDLTSDDLRCNVGASGANTQTVAVKAGDSITFTLDTAVYHQGPISVYMSKAPSTASAYDGSGGWFKIKDYGPTFSGGSATWPLSISYTFNLPTCIADGEYLLRIQSLGIHNPWPAGIPQFYISCAQISVSGGGSTVPSNQVLIPGAFKDTDPGYTVNIYTNFNSYTVPGPAVFTCSGSGGNGGGSNPPTTTLQTTTRPTSTSTSTRPPSSTSAPPQSSQPPSGSCASLWAQCGGQGWTGAKCCATGTCKAQNDYYAQCVQ

SEQ ID NO: 1409 - protein, 318 aa, Unknown
  Kingdom: Fungi, Phylum: Ascomycota
MAMTPELAAGKTYIVTGSNGGLGFEAVKHLVSMGAATVVMGVRALNKGETAKAEIEAATGRQNVIQVWYLDKTSFHSVKAFAERTIEDLDHVDALIDNAGVAQSSPAMPEGHRENMTVNVYSSLLLAVLLMPSMSDFAKRSGTTPHIVLLTSGASFGMGDSWDKVKNDNPLPKMDDPNVFNSLQTYPISKAVQIMATKELARLVPMSRSGVVLNLVDPGICKTNLSRNAPEDFRKGLAELHDTIGRTAEEGSRTLLHGAVAGEESHGLVLGSCELTEEQVPAWINGKEAAQYQKVLWEGIAKELERVSPGCVKAILIQ

SEQ ID NO: 1410 - protein, 588 aa, Unknown
  Kingdom: Fungi, Phylum: Ascomycota
MPCFKGIAVSIHANSAPLPEHGMQKQSRLSRISTYIPVPQPEISADSGKPEPAKFAISITLLTPGVPIPYSTPKPTESNPYPKPQFVGTLQPGSDGERGKYNGMVTPYIPMTNSENETIAAYIYFDGRAKEEVATLLRPGEETWVNSRWVQVPDSEGGGLAEREFLFREVGLERWLNGLDLQGHDAPEKLEKRRQKFEKRQRRQKAAQEGNSGMDVEGGSSSRSRRDTMRYGADDKSPLEAVMDDTESSSSDDDEPPEATGQIKVAMFRVLASGEIKKGEYSPQFDAHDGDDDYADGKQGADVEHTTSFAKPKTLDPKTISTQTVTGIDGPDKPYATFTFFYRGEKQLQKAGIIQSAKNSQTTPASVKRRSGQLDFSNLGPLKAGGTVGFSTFRDQTTDASHRRKARKKSNGHIADDSDDDDDDDDVAITKMEDNDDKIDTGKLAPEDARFQGELADGVNRIHLKRAHSADPDTSSTTPEAAVQPIASDPSVTTTAPGATPAAKTNMSTVDVPPEALVGSPLKKARPSIDQGTSGEKFSATQSLSAALGSVVGGGATSTTGASPSASASNPPVATISSTVKAEEEEEL

SEQ ID NO: 1411 - protein, 917 aa, Unknown
  Kingdom: Fungi, Phylum: Ascomycota
MPSRSDILAPFASAFGRSHSPSPSRRSKTATPVAGSHQQLPTETDQFTSEASSENSSMHPDTVDSPAVSSAPTTPPQMPAIPDHRRLLSKMNDSAVDFNSSGRGTATNSGRSSPRSSLDIQRSSMDIIAASRTSLDSGRTGTSADLAVHPNEINTIAQLDRFPVGTEVNFRARIETQRQLSKALDFLLLRDQTHSVQGVLSRENMDMVKWVQKLHPESLVEVSGLIKEPPQPVRSATQSKIEIDIQSIFLVNSATDAPFSNYRPPETLRNRMTSRILDLRHPSNQALFRIRSLVTRKFRETLEQRGFVEINTPKLQPAATESGAAVFKVNYFGRRAFLAQSPQLAKQMAVSADFGRVFEVGPVFRAENSNTHRHLTEYTGLDIEMAIEHDYHEVIHVIDAFLKSVFESVYAMPEVDVLQKRWPSKEFKWLDETLILNFADGIQMLRDDGRDVEMEDLSTPDEIRLGQLVREKYGTDYYVLDKFPASARPFYTHKDPEDPFFTRSFDIFIRGQEICSGGQRIHDLKELRSNMAAANMAEDGMEDYLSAFKLGAPPHAGAGLGLERIVAWMFELGDVRYASLFHRDPKSLPERPPGLPHPEADTTKPHQPGQMPPLEKLIANYGDATNTSWLDDRFQIWQHPTGAIVGYVKQEKFAMITGDPLCDRSQFKDVSRAFVNFVTKELRLTPVWMLVSYDVQRFLASEMGWRTLSCTEEQRVDSDKHKSQTAGPKARRVEREGVKVHEVKPDEDFIKRAQEAVDTWKASRKGKQMHLTEVRPWIDLEHRRFFAAEKDGKVQAMVVLHKLAPRYGWQVKWALDFPGSVNGAIEVLIDFALSSVTGKVTFGVGVSEKLTAGEHLHGIRARFLATTYNSIVETLGLRKKADFRNKFGALGESVYICYPKHGVGLRDLQQIIKFFQD

SEQ ID NO: 1412 - protein, 470 aa, Unknown
  Kingdom: Fungi, Phylum: Ascomycota
MDEKTRSRYEAKSAELRADLKTWEGNWASAHNGSKPGREDIKSHPEIAKKYKDYNKIRDILAGKIPPPTRSAQKPAKRKPDEAPVQTPMKKTRHAETPVKDRDQQEGLMGTPAISRKLFSPTPVTALGPTPQRDGRVLGLFDLLIEKELGTPKKTAEKGSGAGKIASTPSKRQGTADPDSGRLGRTPMSSSKRQLLNTFMTPLKNRGNGVDGDGGTPSSVSKLQFDTPAFLKRHSFPVATDENVDMPAPLKLPRKPMVRGLSEIVASLRKIEEEHAEADDDLEAMREMEAMEAGGTIEPPTMPAPAPRKLVEEEVLAPDRPAQALPLGGFDDEGAYDSPTEDQVGRDGQPLRIFKKKGQKRTTRRSNMKPVRSKRAASVDLGGKADGDDEQEAATDDEEAEVLHSDAESDYDDKAERKREAAAAPKKEGKVKKTARKVNELAHANFQRLKIKNGGAKGGAGYNSRFRRRR

SEQ ID NO: 1413 - protein, 195 aa, Unknown
  Kingdom: Fungi, Phylum: Ascomycota
MPPSFTSTNATSPSFSSTLPTSDSVNEARSAVVASLSNMLDRKLQTRASTLHSNAAALSQQERALEKATVGLRKEREKLEKEAARAERALREIGSVQNWAEVLEREFLVLEETVRLANGGASDDDEGAGWSRGGSCSCSECGDEDGKGKTEEDGDVAMAEGGGLSEASRSLMDGEESTGSGQAKGSESASLSTLG

SEQ ID NO: 1414 - protein, 1425 aa, Unknown
  Kingdom: Fungi, Phylum: Ascomycota
MATNIRKPALSQNTELALDNIVVTERSRVGERDAGIDPGLTIADGSTHAVEPVEVEICRLSVEISRKSISSDILAKIQNWTGRAPRRTRHVLLHSVTANLQPGSLTAVIGASGSGKSTLLDALSGRLTSGRSISSGSVLYNGSSKRTHIRRAYVTQQDVLLPTLTVRETLQYTADLRLPPPATASHRRVLVERVIEELGLQKCANTRIGDSRKRGCSGGERRRVSIGVQLLANPSLLFLDEPTTGLDAASALALTTTLRALCQRDRVVIMTVHQPRPEIWSLFDNLIVLAQGSTLYAGPIDGALPWFEGLGFTRPLFVNPADFLIDISAADYRTGTLESRSMERLETLRQAWHEKDCDYSTASLDDPAVAMHNEDDENWGQSVGLYRQIRVLTHRTMRVTCRDPLGLTACMIEAVLMGLAVGYIFYDMARDQAGIKSRQGCLYVAASLQGYLVLIFETFRMTFDITTYDWEASDGYVQPAGFILSRRLAKIPTEDLPVPLILSSLIYFMTGLDRDAGKIFTFFAISILNHYLAVLCATLCVVASRDFPTATLIASLVYTLQSLASGLIIHVDNMPVYIGWTRWITYSFFTFSAYVANEFEGSFYDCPFTAGRGSAECVQYEGTFVIEMLGFPSDWTKRAIACMVGFSLVFLISSVIGLQFLTPSTFNSISQPRQRAASRPCVQETPYVDWMNVSPATVELCQYTLALSTKTLKGFRQGFEQKHILQPINVKFEPGMLHIVLGPSGCGKTSLLDSIGQRLRPTISAKYLHSGSIKFDGTKIIAKDLRKRCAYATQEGELLLPGLTVRETLQYAAALRLGTSDVEQRAERVEGLLCTLGLKACADSPVGSDSFRGISGGEKRRLALAIQILSGPQVLLVDEPTSGLDSFTANAIVQLLHQIAKSGRTVIVAIHQPRSDLFEYFGKILLLSDGGCPIYSGPARDMVTYFTAAGFECPFGTNPADFALDLVNASPGRLFDEREAQERLYRLKQHWRCNGWQGISRDPESRPLVPRENAPRYPSFQPRPSMACIPQLLRRAARNTCRQPQLVLSRFMQSSGVAIIFTIFFAPLGNNYSSIQDRFGLFQQLGGFYIIGMLTNAAVYPFERDVAYSEIRDGLYRVDHFLASYTVFELPFEVINSLFLGFLLVFAVGLPRTVASYFVATLAGFTGLSCGESLGIMFNTLFSHTGFAMNMMGILMALANTMAGILSLNMPALFTSFNYLSPIRYQVRAVAYYSLVNQTFDCNLDQGCPIFTGDEALQLYHFDGLKASTYLARHKMQAIPTFTLDKWRSCASYQSLDDLRKLAPGSSQDPVNSSLALNYGETSGLRSLRERIAYLHSTDRVKVTAEDVIITSGSIAANYLALSTLLGPKDHVICQYPTYGQLITLPRHLGAEVSLWEAEVENNWEPDVKELVHLIKPNTKAIIIK

SEQ ID NO: 1415 - protein, 90 aa, Unknown
  Kingdom: Fungi, Phylum: Ascomycota
MAETTLARPSSAISRPVSESLLNEKWDRCLSNLLVKSTLGLGFGVVFSVLLFKRRAWPAFVGVGFGAGRAYEECNFSLKQAARDLKKQAA

SEQ ID NO: 1416 - protein, 720 aa, Unknown
  Kingdom: Fungi, Phylum: Ascomycota
MLASNSLQPPTSGRSRFSKALPSVPGFSPDTTLPSLSPLSFDAPKKHLPLPPRPDTAGRNQEAPFSPLSAIASPTSSASTPTSIKSKMTIPRRPVGAGANQKGPGLPSTPAPERSPAPVLTPARTLNPPAITTPKPAAAYVPPPSPSESLSSILSAYSRSSIGSPVISSEGTASVRDSQQTSSPSQSEIQSFGPTALFTTSSTHTMSTASPPVPPPKQSVATNITAQQQNSTLQSEASLSSASEQNSTPPPIPAKDLSRQLVSSTAAQYQSSSSAVKASSPPRPQIWRRRSINKSKDLPPIAIYSSHGSTASTAPKISIQLDPDTASILTQSTTETIKPLPPLSATKPPPSATGLPGRNVRPAQSKPSVAEVKTEMGSDEARLPQTSAPRSSNTTSASATPPAAGRPPTPEYQKEDAKTPMLATFVSPASPASSPEPGHRGPLPVSKEPSPSFANETSKQLPKIDTGSITRKAITPTTVPDLHAARSVPDLRSQSPSPANAPLPSLPAAAPTFAAGRERRPSDAASIRGREFTETGKFPPRGSSVKPDGRQKMSSSQSLPQPGFPENDPRLVRSNSGNMMYRGRDGTLYPEMKDPGAPDPKAMYFPTHPQGRIPEGTILPAPPLRNSHYVCYQKHRNMGRRVNRQYPLACQTCDKADVEDRHVCTFCQLRICSPCFEKFNAKGRDLKLFMQSVKSPELPNVLTLSSGERPGSALGLQINF

SEQ ID NO: 1417 - protein, 525 aa, Unknown
  Kingdom: Fungi, Phylum: Ascomycota
MNRTTANIDPARRAARAQATTKNDRSGNRVARQGLDERKALKMQRALASVSYGRRNLTKERMAEYESFDQFDLLPEVRSAVTDELLGGLTDIKPTPIQRLAIPAILGQSKPGGPRKNFTEPRSFLLAAETGSGKTLAYLLPAINAVKVEEADDPDIKAYRERYAAEKARVEASNGKSRPMDEPHPTMARPKVVVLVPTAELTQQIGKVSKKLSHMVKYKTEMLSSDLKPQQIQRNLYSSRGLDVVISTPHLLASIADSDPNILSRVSHLIVDEADSLLDRSFAPVTTSIIERAMPSLKALVCCSATIPRKLNNYLAVTYPKMQRITTPNLHAIPRRVQLGVIDVSKEPYKNKKDLACADALYSIGKEGMIHEGMNKNEVDLRRVLVFVNEREKTEQLAEYLRTWGIDAQALHRDTTEKRHDEILETFTTKEPISVPAVPIKGRGKLGNVKVLVVTDLASRGIDTLAVRHVILYDVPHTTIDFIHRLGRAGRMGRRGRGIVLVGNDDRKDVVADVKKSMFEGQALI

SEQ ID NO: 1418 - protein, 462 aa, Unknown
  Kingdom: Fungi, Phylum: Ascomycota
MDFNSSSPFPEGVISFLDTDLYKLTMQCAVFKFFKDVPVTYAFTNRTPEKRLSRAAFAWLKEQIRKLGNISLSTDEYRFLKQHCDYLTPEYLEFLKDFQLRPREQVELTFTPVGADTGSDNDTGDVDIKIKGAWVDTILYEIPLLALTSEAYFRFMDTDWNYDGQEEKAYEKGMQLLEAGCTTSEFGTRRRRDYHTQALVFRGLVKASKAAAEKGLPGKLSGTSNVHLAMRFNIPPVGTVAHEWFMGIAAIVGDYKTATETALRHWVACFGPKLAIALTDTFGTREFLSAFSQPVQPIEGGFSAETFQREDGSMKTYAEMFAGVRQDSGDPADYVKLLRQYYDDRGVKDKKTIVFSDSLNIERCLEYKKLSEDYGFQPTFGVGTFLTNDFTHAKTGTKSVPLNIVIKLSSAAGRPAIKISDNAGKNTGDKETVEKVKRELGYVEREWSEGDETARWGREEEK

SEQ ID NO: 1419 - protein, 461 aa, Unknown
  Kingdom: Fungi, Phylum: Ascomycota
MLPEQDLLEGALPAEDLDSESSHHSPRRSNDEETGSMRSVQTMSIASRIVSRITTRSSIPMTPPPDGGFAAWMVVIAGHLVIMCTWGVINSFGAFQAYYVSALGRPPSDISWIGSFQVFLLFFIGTFTGRATDAGLLRPCLVTGIVLIALGAFSAAQCTQYWQLFLAQGVCLGLGNGFLFCPTIAVTSQYFQKNRALALGLSACGSATGGLIFPSMVRQLLPSIGFAWTMRSIGFIQIGCLIVAFMFLRPRMPPRKSGSLVDLASFKELDYTCYAIGSYLCFWGIYVPFFFLSTYAREVRGMAYASSLDLLLLMNGIGIVGRVLPSVVADKLGAVTMFLPMATSTALLMYCWPAVDTIDGLWGWAAIYGITAGGIQSLFPSALSSLTLDPRKQGTRIGMTFTIVSFAVLTGPPIAGALISKFGYLAAQMFAGSSIALGAVSVWVSRETRRRRNGQKLFSKV

SEQ ID NO: 1420 - protein, 451 aa, Unknown
  Kingdom: Fungi, Phylum: Ascomycota
MADPLLTNLCAICHVSPPKYKCPRCNLRTCSLACSKKHKAWSECSGERDATAYIPPSKLRTPAGVDHDYNFLHGIEMAVERSERVLIGDRGLVQAEELRPLTTQEVRWKTGRDGRKRKVITTRVLREAKGRSFERFLAQRLKKLNVRILCAPMGMARQKENNTTLNRRSGRINWQVEWLALDRDGPTEHPETKAKRLLSKVMDDTPLYRAYHELLDDERACEKVVAPRTAPRARAHQSQSSSDACWTADMDGLQDALTGMWLSPAEVDAEEDQRRRKRYRFFLGSTSRRSDLPTKMAALDAGDCLREILRNGQVLEFPTIYVLTGGADATLPPGFVLGPKETALSAAAQHSQGTKRKGGPADGQRAGSRVSKKQKQQGAGGPEVLEEGEVVSDGEVGDAQDAGSGDKNSGIGLEAGEVIGEESFGEEDEAMDQDDDDDDDDDTSSSGSDSE

SEQ ID NO: 1421 - protein, 1822 aa, Unknown
  Kingdom: Fungi, Phylum: Ascomycota
MADPSPEQRKLQLVEKLEFRILGVANQEKKLHDLLQTFLAPLILEVASEHATVIQVLGRLKTFIQPPSIVLPVAKLLDQYKSVDSQLAKQLDLSFILHSLERIDDDDRRDLLPKAIAGCAKTRNTSSGPGFLQVIFRLLLDARIPPRGSKDDEAFRTSLGLENDSDAAFLAEMISIFLRLRLPTAAQDWRQSNPGLTGEELALFSVDNPRNHKIYQRLSELKTKLVALLASGAFTDDEKFLPALYGSSSFDNRVSSAAEEIIKRSSVSLEDEVLVAKLFAAHAKLPAAYRTKILSMLSKSSTSTTMSDQILAVVRLDFMEEGSTAASSQNLAPSSALERTKLHKSLFQYISWVARIGPSKEGFSIGPQLIDVMKSYIESQGWPQPQAASNDDIALRSRAYETIGMLARSAEMPVSKRLVLAQWLFQSLSEDPINDVVVNIDGALSSLTANVTPEVGAQEPALRSMLLKYMSLSDEPPAIRSTRHAVVKWANQCLPLSDIYGRWIDILAIGGQPTERNDVIEQGQKGLDPWTYFVHMEDQPSLPDWKEMVRTYFGPAIGLNADRNNSSTVDPLPDQRGPFENFRGSRLAAFAVALRYCKQMMFIAATIDFKIEPNWMQTLDALVKTDIKTREQIKAYLRSTDEDVLIFYLKACLAGAFQEDSPIAEDCIRCFVEVASLSPGAIIKHLIGDSTSLLGLIKSNNKEKRSLAARALGIVAAHPANSPDSIQNWFQTLSALSSNAQKAVGPDLNAAEGTLLAYAHLCTRAVYYSEDATTEDDFSYPQDLLVATGLFPTLQDAVCEAFTQFWSARRAVPSPEGSPRVEDVIDKLEVSAKKGNEKAIQALGRLAMAVEVESPSTSDEKSLGDRWGTVGVILTKLFALHEIKQIEVHFTVGEAITAAIARWDSDSVKLTLDVEPRSETHFFGARDTLVNEVLSKLFKDCKATKPSLLKASGIWLFSIVQYCSHLSQVQSRLREAQAAFMRLLSARDELVQETASRGLSLVYERGDEELKSALVKDLVSAFTGSGTQLKVEQDTELFEPGALPTGEGNSVTSYKDIVNLANEVGDQRLVYKFMSLAANAATWSTRSAFGRFGLSNILGDSEVDPKLYPKLFRYRFDPNTNVQRSMDDIWKALVKDPSAVIDTHFDAIIEDLLKSILGREWRMREASCAAISDLLHGRPYAQYERHYRDIWTAALKVLDDVKGSVREAALKLCMTLSNGLVRQLEESNNVAAARAMMKEALPFLLSDKGVESSVEDVQIFATITVLKIAKQGGKSLKPFIPDMVQQLLGLLSTIEPQQINYQYQRAGEDSRDKIDRLRSQMVNRSPISEAIENALRFVDAEIMKDLAPRLENTIKTAIGMPTKIGCSRVLTTLFTRHAQDIEQVSARFLQLMEKQVMDKNDEVSQAYARASAYMIRAVPEPAKERFFTKLLDLYFNAEEESRRQKVSDVIVAVSKVSSDHFAAYQTQLLPFAYLGSHDTDEYTSKMFKEVWEQHAGSSRSVTRYVPEITSLVERCLDTAQWALRHAGAFTVGAMAADVAGASTATASISEANLKLIWPVFDKALAMKTFTGKEKVLAAFPAFVEKGQALWKVDDKIAAQMKKVAIREAKRNNEDYRVHAFASLWKFAKARDDLDMLADICGIVEPYLDELKDEASDKMDVDSKEDLTAKTAKNGFEAIARGYSREKMAERAGDVISEILRVLKPYLASAKFAQVKREVWYGSVKDMVVDATEKTGSSSDAGSTTPIAVGLLRTLDLDQPEAGIESHRIQRAEAVLGIIRGANAGVFDFGTDKREVEDAIKTALEKERSQDVQKVWKQCSEHL

SEQ ID NO: 1422 - protein, 338 aa, Unknown
  Kingdom: Fungi, Phylum: Ascomycota
MSQQLSQDSISESSVAKGPSAPKVDQGGSVRHDEPSPTAQYPYEEIAPRWVRIRETMQDAFSEFLGTMVLILFGDGVVAQVVLSGGAKGEYQSISWGWGIGVMLGVYVAGKSGGHLNPAVTLTNCVFRGHPWRKFPIYLLAQVLGAMAGAAIVYGNYKSAIDMFEGGPGIRTVTGDKATAGVFCTYPAPFMTRTGMFFSEVVASTILMMCIYGMADDNNIGAGKMMPLGLFFLIFGIGACFGWETGYAINLARDFGPRLVSYMLGYGHEVWSAGGYYFWIPMVAPFFGCLLGAFLYDLFIYTGTDSPINEPWMGLQRLTRPRKEVWSNTHRTARGSKA

SEQ ID NO: 1423 - protein, 557 aa, Unknown
  Kingdom: Fungi, Phylum: Ascomycota
MRRPSASSDDGGIASFSIRRGTLASLIRNRSHQTLSGSFLPLTASNPSDDEESLLSRHRDGEDIAHLLQDERRLTQLLNGPGDRSMNLIGKSNPRYRWERYWKHESELKNMEKPIRKYYERTNELIQQYMYIDCLLDSSIPHDLLNEYSTELEASAFRPVNVPVTIQEESTTQPSSLSSTPGPSYGAITPTSNGPIQSTLPQKRTPKDIFRSSESMPLLLQQQEAEDEADDHPPSIHSDGSGPRPYLPWLEDAEIDSDDPVVTLAIWVNLVANTILLAGKIVVIASVPSMSVLASLVDAVLDFLSTAIVWLTTRLISAGQNDQFRYPVGRKRLEPVGVLVFSIIMITSFVQVGLECVSRLMGPEHEILQLGLPAIIIMVTTIIIKGLCWIWCRLVKNSSVRALAEDAKTDVIFNAGSILFPIVGFYGRVWWLDALGGLLLSMVVIFNWSQTSAHHVRNLTGFSAQPDERNLLLYLTMRFATSIRQIQNLRAYHAGDKLFVEADIVLPAHMPLKDSHDLSEVLTYFLESVPIVDRAFVHVDYTSYNAPTHILKNTPAN

SEQ ID NO: 1424 - protein, 650 aa, Unknown
  Kingdom: Fungi, Phylum: Ascomycota
MASVSATPIEDGSPPAPSAAPPPAPTLASASTTNAIPRLPSEPRSIASNTEHRASLPPSQSPAMSQPPSTADRGPTPGSGTQPPKANGEIKAVLSTDEYFELSSLITTTKPEVVRQVVRDYWQRCLTGSDFHIGFILNTTLHHAKPHLLDQAVQDFGAKLASSTKHKWVQHLDTNDVDELADALFQRASDRFLDRALARRFETISGRALVNALARAERLGYDTRDIVEEKDSTKGEHVIPSMHPSTPSAYVQRGSSGKQQHPQQPYASEYGDSFQTAAQPQYHAPPPPPPPPQFPVTHPTAAQLDEVKSFGIVFCDTCGRPCSGPIAVDNHLRKRACSNHVTKLERLGSDTCLHCGVSFSSNGGLLYHMKSDVCGVYPNNVHIKMMELLSDRAKIPFVRARQAVHSTPSSTPTTANYVLPTQSRASPARLGPAEVYASLTPQQQASFDAEMKAAEDMYGGQMREAMALPPVQAEVELAKIRNRLNSRQSNLRKKYGIKLRDRRTRAQIEEDNARIAANSPLPSSSQGVKRPLSTHADSPRKRVPLSEMGGLSGAAASAEMTDPTLNLTPAQPHKPPAQAAETTQKAQTAQSAQAAQASTWAPVQASTTQDDVVMIDSDRSAMGTDSTRPSPSAELTTTADASRPASVSAA

SEQ ID NO: 1425 - protein, 485 aa, Unknown
  Kingdom: Fungi, Phylum: Ascomycota
MVKSTTMLKTLAGSVQGVIDSRFGRQIEHFRGIQYGCIPKRFASPESVELPSSIDATRFGPQCPQPRVDVGHLLRLPPHIDMPTVDEDEFKCLNLNITRPAEGTPGVNHLLPVLIWIHGGSQCVTFPSAATPVGVALGSTPDPTWLVADSISSGKPVIVVTINYRLNIFAFGYGGGERNLALQDQRLAIEWVSNHIREFGGDREQITLAGESAGAVYVHAHILSQTRASHVQRAVLASGSLHLSPPLPLAAGTALLERITTDLDTKGDTLHSASADSLVKALENLSVTSMWLQQDSDLEGWEDRTEQVDALLVSDVEYENIESAIWRTGVQRMSPEEITSIFDDSGEPGSKLKHLYHIYPERPASCYHGALDLINDARFALPAFDISERWRKRSPGKIFQCLIDEANPWQASSRAHHAVDLLFLFGGVDLGFNPAADRVGSRLRDTWLTFINGGDPWPSSEVWGFGPLGRCGEVDDAEYRARRRW

SEQ ID NO: 1426 - protein, 1114 aa, Unknown
  Kingdom: Fungi, Phylum: Ascomycota
MAVTRKRLVVVGLGMVGIAFIEKVLKYDARERQYDITVLGEEPHLAYNRVGLTTFFSHRKVEELYLNPAAWYSEAPEGALGYHVNSKVVAIDSQAKTVTCENGDVVSYDILVLATGSDAILPRKTPHHDATGVFVYRTIDDLMRLIAFAEEKKGTTGLVVGGGLLGLEAAKAMMDLECYGKVGLIERNSWVMNRQLDGEAGTMVVNQIRDLGLEVNLRKQIGEIKVDANNHVTGVIFQDGEHMDCSTICFAIGVSARDDLARASGIDCEARGNGIIIQDDLSTNISDIYAIGECASWKNQTFGLIAPGIEMADVLAFNLTQAHLHAPRVYNKPDISTKLKLLGVDVASFGDYFADRDGPKYLPPKYVAKKKANGVNGVNGTNGVNGSSEDPAPSTVKSLTYKDPFQNIYKKYIFTQDGKYLLGGMMIGDTKDYSKLVQMIKKNQELEVPPGELILGAKKEGDEGDDLDDDAQICSCQNVTKGDVVNCVKDGTCTDITAIKTCTKAGTGCGGCMPLVTTIFNKTMMAMGNEVKNHVCPHFNYSRAELYHIVMVKRLKAFPDVMREAGNDPASDGCELCKPALGSIFASLWNRHVMDKPTHGLQDTNDRYLGNIQRDGTYSVVPRVSGGEITPDKLVVIGEVAQKYGLYTKITGGQRIDLFGAKKQDLLDIWGRLVEGGMESGHAYAKSLRTVKSCVGSTWCRYGIGDSVGMAVRLEERYKSIRAPHKLKGGVSGCVRECAEAQSKDFGLIATEKGFNIFVGGNGGAKPRHAELFARDVPPTEVVPILDRYLMFYIRTADRLQRTARWMEALPGGLKYLQEVILEDKLGICESLEAQMQELVDSFFDEWEEAIKTPAIAKKFRQFHNTTEEVQNVEMEPERGQTRPVYWPTESAEEDFKGLRSKWSSMTWEPVIEARHFDGADDMPNGISANIKRGDTQLAVWRYKGKFYATQQMCPHKRAFVLSDGLLGQDPNKACDKEKPGSGDGPQPSAAPWVSCPHHKRNFDLDSGACKTDTALSIATFPVESRAEDGMVYLQLPPVEELDAELGTKKWKVKKGDDNGEGADKFKELDKKLNFVGRRGKKPGVKPTINGAAGSKMRRPVELMAGGCGAAPDW

SEQ ID NO: 1427 - protein, 536 aa, Unknown
  Kingdom: Fungi, Phylum: Ascomycota
MDQFTKGPSEGLTKSEIDYSSSKVPQSETNTDADRLAQLGYEAELKRTFGLPSLIALCLCLMGTWEATSAVVAQALAGGGAPCLFYNFILTFIGSIALAVSMAEISSIYPTAGGQYHWVAALHPERGRKTAAWLTGWISVGGQLVFAASAAFAAALMIQGLIILNNSSYEPTRWQTMLLYWAILLYGALINIFGEFILPTANLIAGGIHLVGFLIIFIVLAVMADKNSAHFVFVETYNQTGWDSAGVAWLVGLISSLYPFLGYDAACHLAEELPHASRNVPLGMVGSVIGNGLIGLAYCIMLLYSTGPLEDILATKTGLPFIQIYLDATRSNVGTTLLVILPVISGITASVGGITSCSRTLWAYARDDATPFAKYLSHVSRRRQVPVRAIVVLIALMMCLGLIYLGNTTAYNAIVAMAVMGMYISYAAPIACMLFNGRPNLLEDTDYGWFKMSKWRGVTANVVSLAWWLLVTIFVTFPTIRPVTAANMNYALPVTAGWCFLGLIYYIFWGRKKFIMPVVQAKTAAGFAGSAKTSPS

SEQ ID NO: 1428 - protein, 434 aa, Unknown
  Kingdom: Fungi, Phylum: Ascomycota
MTCHGPGPSKGAFRAFLPDLSQPRFVALQKQDAHEYAEEFKQKGQPPWLHALYLKWLDLYKEPFKGITTDGVVRRNLFDVEDEQVPVADIADAAERLLAALTKEDRARTLYHIDSPEWRTWSNPEFLLSDKGIRLDEVEPAIRDLVLDILRKTLSPEGYEKAIAAMRINGFLGELVDARSVCNEFSYNFCLFGLPSASKPWGFSFYGHHLCLNIFLYKSQIVLSPWFTGAEPNEIDQGPYSGTKILQREDHLGLLLMQSLTPSQQQTAQIYKLLRDPSMPWGRWNHDDQRHLCGAYRDNRVVPYEGITVSSMTDAQRQVVEDIVSEYMLYLPTRSREIRLAQVKRHFDETYFCWIGGFSEQDAFYYRIQSPVIILEFDHHSGVFLNNKEPARFHIHTLLRTPNAGDYGKALLPLLPGEDQAFQWDGDGEMSSAG

SEQ ID NO: 1429 - protein, 203 aa, Unknown
  Kingdom: Fungi, Phylum: Ascomycota
MTDQESHAHPQAQSREWHNGLMTCTPIGDCCLGTWCPCILYGRTVHRERDPTLANYETINDDCKPLGHLQFWTGCGFMYDLWPPPNPPIQNTAKRKEASNDKSKNNSYVQSQRTKLREKYGIPGTARNDFWASFCCLPCAQIQLDREVELREAHRINEEGYRRQDDMTVPNDGAAKTRNAAPAAPLMEERAHQPASPPVAAGL

SEQ ID NO: 1430 - protein, 467 aa, Unknown
  Kingdom: Fungi, Phylum: Ascomycota
MASVARLAGRGAKRLCLRPAPFAARSISTTAQRRYATPEMGTRLLPVDSDFGSPQDPYGLTREAMNASMKKVDNSVADRKVRHYTVNFGPQHPAAHGVLRLILELNGEEIVRADPHVGLLHRGTEKLIEYKTYLQALPYFDRLDYVSMMTNEQCFSLAVEKLLNIEIPERAKFIRTMFGELTRILNHLMAVLTHAMDVGALTPFLWGFEEREKLMEFYERVSGARMHAAYVRPGGVHQDIPAGLLDDIYQWATQFGDRLDETEEMLTDNRIWIERLRGVGVVSAAEALNLSFTGVMLRGSGVPWDIRKSQPYDAYDQVEFDIPVGTNGDCYDRYLCRMEEFRQSLRIVHQCLNKMPAGPIRVEDYKISPPPRAAMKENMEALIHHFLLYTKGYAVPPGETYSAIEAPKGEMGVYVVSDGSERPYRCHIRAPGFANLSGFDHVAKGHLLADAVACIGTMDLVFGEVDR

SEQ ID NO: 1431 - protein, 403 aa, Unknown
  Kingdom: Fungi, Phylum: Ascomycota
MSATRKLPQFLISVLTLDICTLSLSLDWENLTLHAMSYSKQAEARRYAQPDEDAPPPAYDDPGDAALGESSATRAAVVASSMSRDAPPVTPSTQAQNLSPDDKANDSQTSRSPPPTTAGPSNSTSDHVPTVDSPFDFPTQAPLPPAYTRTDSSSSSSIVSRPIAIPQTSPSPTSPFLPAYAPLLLTYGITPSSFLAFLSTISAFLTAKVSDRAISHAGEMAKAITDPPKTSFKNVVSHAKAVGKDVGRNAKKGNVVGAALGVVGGTVTISLAAVGGLIASATSLPGTTLAAAVKKPKTPRQRAAAYIAVANGKWLAARGLYAVLLDSMELAEVLKKPVTAITAEASDKDASVEGQLQGLEAHVEKLDLHEPNASLELGKQTLWLVLSKAVVEKTGEIGTISES

SEQ ID NO: 1432 - protein, 971 aa, Unknown
  Kingdom: Fungi, Phylum: Ascomycota
MATNGAPDAFAPSDVLAAVMTMRSGEHESKKKAHEYLEQFQKSKGSWGTIIGILQAEAEPEATLFAAITLRGKITYDLATQVPPSELASLRNQILLLLKHFAAGPKPIRVQLCVCLAILAIQMKDWDDVLPSVVQALSGSPQSHACILDFLRVLPEEVTEGRKITLSEEDLAARTQALLGDNTTQVVQLLINYAQSSPNAAKDPQLMECITSWLREVPVGDVVSSPLLNVIFEGVTSDECAQEASECLCTMLRETHDVDESQDVIEALFPKTLSLTPQIAAADEEEDTDKLKALTKVFATAAESWVVAIARQPSQFRPLVEAVLECAARDKERDVIEHTFNFWYELKQYLVLERYIQSRLEVNDIYAKLVDIFLKHLRFPQPESGNETDLFDGDREQEEKFREFRHQMGDTLKDACEVLGVTECLTKVLNAIQLWMQKHASQATETQVPNWQELEAPLFAMRALGRMVDKEENIVLPQLMPLLVQIPAHEKLRFATIMVLGRYTEWTAEHPEYLEPQFNYIVSSFQSDSKEIIRAAALSIKYFCTDCKHLLSGQVLQLQKFYDEVLDKLPDVSKEEITEGVANVVAVQPTQDTYRLLKLYCDPLIQRLMTKANHATDEDSKLALADHLQLITKFVQVVMPPVAVGQENPAVKYWQETFPILSTVLDNFLDFSPICERVCRCWRSMVISYRTAMSPMLPDMANKLAIGFNNSREGCFLWVTSSILREFSEDREHVDQATTDNIYTFFEAQATTFLRVMTELEPKELPDVIDDFFRLLIDALLYFSTKLMPSHLMGSIFEASIYALTLEQRDPLSSTLHFLRDLLSYGGDNPATGEGLPEAAAAELRGIVKNLLQSHGGSLVKQVMAGMMITFPRDCFADGSGVLLALFELLPQQTTEWVASTIQMLPEGTVSPIEAERLMTKIREKLQSNDAGGVRSVRTLLQDFTNTYRRRNVAPRDGLGQLEAARFQFGG

SEQ ID NO: 1433 - protein, 601 aa, Unknown
  Kingdom: Fungi, Phylum: Ascomycota
MAGPAEVSILANAGLLQTSLIWIAYAVAIGLCLIAAIITTFTWQTPRERSAIVSIVAIISLTSLLATVLLLPVDIALVSATSSASNGIKKDWATPERVEGILFTLKVVYYSLYSFDALLCLLVIPFVYFWYEEYDEIEFEEEGRTWTSRFLAAAKYTTFFLALVIVLFLLGFFVPAAGDNSKDHWDLDYYKKLISQNHGEKALTFALGLLVTLGTLLYVIYTGAGLALLPISLIKSAPSISAPQLSENTASQLDANRERQRQLEMRNTGRPDGMPRKDRRELDALIREEQTLVRRERLAAEAQGEGRSKLYQAWLKLCALFRPIKMIGGLLLLLLSLLIWVSMLITGIDKAKNSICKARCGYILGQIHVFQPINFIFVKAAKVFPIDYVIMALLVLFLFSSSITGVATVGIRFLWVRIFQIRRGRTAPQALLIATVMLALIILAINYSVAMLMAPQYATYGTQTFCSNEPRHPDEAPNCSDHKDLILPCSEALKFAHAKDICTPSVMSTVLNRITITWPFFGIVDFWAQFAFLGLFLIVFLTALVRTPKLNMAEIDEDAEADEEESLLASTGRRFGATWQDVRGKTSSSGRGERNGGSSEA

SEQ ID NO: 1434 - protein, 3960 aa, Unknown
  Kingdom: Fungi, Phylum: Ascomycota
MGKITKPMQAKHRETLSPWLDAFVQSAAQTPIPLLPEKLASFPSRWPFGRGDLYHWTPLLNRFDTILEHFSKTYRLNEGPQSRDFGCELLLGHSKIEDFGETKEWTQPELTQIGYPVDGDRELIEVVLKFTRMLVDNCGNRSIYASSAHLNDLLNTTSLSILIAALEVGSELAQRYQASVKRISHQQSRHISSQLLANHYNIELDRVQQLALPFVKTPLIRLSDGANNTSPAVTGKGKEKAPAASSKNAAVTHANDLIAICTADDPDWKGWGDVKIIYYPDFTAATSDVMDHGRPSAPSTPTPLRRSTTMTPQQSSRSRNFSADDSSPITPRTPGHQDDTTGSGHKSFEVPQSVVVATSIYDLLQRLPKDMPAAARYEAFHRLRVAKALTGSREERQRLLATRLLAITNLAYIHPEANFIEKVLRHDVDETRRYQLVYQLAELIHPPSESADKIPLWLQTIGLGLIEAVAGFQAKNQDVLSALNANVNHGILLYVIRKAVAGMKEDTPDQEGHTVTETDAWRTKLFSLTLFLAMMTRVGSEMVSAGLMEILVEMLKLRSKVAQRHHSMVLAFLDSLIWTYQNAFTAFFNADGLDAIAELIVDTVKGSKALREAGKGTSVDQQSGAVDYRIPYYQQQTLKWLLKFVHHIMSNSFSFNGNTDRLLRNLADKSDLLSSLRLTIEDKESFGSIVWTHSVTILSDFINNDPTSFAAISESGMIKTFLEAITGNKINDVAAQSSSPEGEAGETAPSPDSDMGGSIIADEDVHPPPEDILRQSKREGLAKGILPSSDAISVVPAVLNSISLNATGMKLVVESRALEGFLQIFESPAHVKCMQEDHDQDLAGNVGGSFDELARHHPRLRKAISNAVVDMVARIRILGIDNAEKLGWGARLHSVTAVPSEQTSQVKQDSNQLEPSNRPQTSDSDVAMQDATPQQAAQSQSRGTAVEDLKKDDFTPYIYALANFLVHYLSNTGLRESFIEQGGIELLLDLVESPSLPDNFGSVYASKAMVTVVKEAIDASPIRGLPSLINRTQAALDLLKPLATQTESSVPYFARYILEQPEQASEQRGPGSLEEATQLVKAFLNSQQLLRILAECFQPTRNGITFYPINAYDLYLRLIDTIGPLVRGILAEEMAEMKAVPIHWNFGRDGLGEVRGGSRAALEADGTSLPDVITATEDLSARGGTSDDTKPVNPTPEEQASPQYRNYKVLRTLQHLMVPQVFPLFQSAGKALFPKREVLQGYAYHRARQLDVAKAIGHAILSHLEPSVSAEGPATTQFHYWTIMLHTIQELLVDRSPTRDRGPATTLILPVLLSFKEQNGLEVLNSMLSSFAAVIKPAGTVEDDATSKIAVFGLKKVLDLYYVLVNGKMIHDACNCFNLQKTRDRNGSASLVQQFVLEFRGAILPAVTEIWQSSVVDNLPDAVVRRLLEIMKAVAQADYESPPMPREREPFALLKYEDARFSWRAYRGAMQELHPPVPDTELLTEAIFRSYGDVDLARQYYESHKDGKAGARNPIPAADADSSALSDEATVPTESTEVDGENSAQADEMSVDAVDVADILTNVLSAPREQSENTIPSNSLPQAQTTVTREKLEEYRTALRENLIDRCLDVTRAHPDVVIEVSDLIQSSVLRGHKQDAQEEDVGMTLASALSSLASDEDEKTRNAKCIAAYAHLLAMLLRDEKFLERNIDILRDNVSEYIGYLKVTPDSNEALPPWIPYILLILEILLCRDARPVEVEWTPPKSLDDEVAEPVLKLRAPFVSDAERLSLLEHVLDLLPRVGQEEVLATSVLRMLVVLTRSRQLAKVVGNKRNLQRLFLMAKQLSGFGSDRMRQMKASSHTLTILRHIIEDEETLKQVMRNEILTDFPHIRHNTSRQQLDLTTFMRAMAPTALREPEIFLEVMTELFEFSKWVAPGSDASRSHYLVLKPNAITASDNKEPVHEGIKQSTEAADNDMTDAPKASDSKRPVVDNPDGVVHFLLCELLNYRDVDDLVVSTDGKLDPKPESKNENEQAASADGSTPSSPDDREKKSSRPVFKPDENPLFIYRCFLLSCLTELLQSYNKAKVEFINFKRSAPPVLALGTPVKPRSSVLNYLIYDLLCQGSLSGTTDTIDSKKRAAVSQHAQKVLVALVSKPKERSRGQVQDRFAYDDEPDLLFVRKFVLDIILKAYEKAPFSDVSLEVRYSRMQSLAELMNHMIGDRDKDAVTSTRGAHGGPTHSHSQMRRLMYEKGFLDKLTTSIAEINLNFPGVKRAIKYILRVLRILTDTAKDLSQLNILPSDSAVDDVDEDLASSSSLSSLDDNDREETPDLYRNSALGMLEPRGEDDDSEDEEEDEDEEVYGEDYDEEMDYGEEDLSDREDNISDEDELTHMGEIEGLHGEPGVVEVIMDDDEDDDSGSSDEDDDDDMDSEEIEDADDVEIIDEGDDDDNSEWESDDEADHDDEGDDEEIDYEAEAQDADEAEAFDPMVAPQLNRLARVMMGDAGPELMDDLDEHYIDDDDHDEEDEDEDEDEAEDEYIYDDYPDLDLGEQLPNLPLGWDGENPEVDDRHRHFFVSINDGRSRPLRVGPRSFMPVPGSGLTVHRDAGVGDFRSFFTRAHRPGGPPPPEDGMNPLLRRNPALADNQFRRRPQHAHDWATLDDNVRRGFDGTMAILGELAQSLPSFGGERGRDVAFQLRIRGPNGLRDQDFPPLERSRGERRDGPVTEPQQAVSFPAESTLDRYQEEVRMVFGQSHGNEVMKLATRITAKLTPASMELERKAKAEEAEKRKQEEEERQKREEEHARQLAREAEEKAERERKEAEEREAAQRAAREAAANDPDRAQSADDGPMEGVETTRADTPTPQTHEQAPAAASNEPRVMTMIDGHEVDVTELGIDPEYLAALPEEFRAEVIAQTVSTRRAQAREEDATGENNEEFREFLDALPDELRAEIEQQERDEQRRRRTSRPAPSGATQDHTVEMDTASILATFPPALRDQVLLDHGSELMDQLPPEMAAQARALSQHFRERLAEASPPQPRGSSHGLRQEGENKEETKPQRRVVVQMLDKAGVATLLRLMFITQPTTIRNYLFSVFADVCENRQNRVEVISTVLQILQEGSIDMHAVERSFGQLSLKARKQKEKEREAEQRTPQSIKRTLTTLSVASSAPANSDTSPLLIIQQCLDLLVDLSSRNPHVPYLFLTEHEAVGATLKRAMNRKGKNKDTRSNKFAINSLLTLLDRDLVMESSVVMTHLADLLNRVTFPLLSFERRRREAVEVKGTGSEKPVGEATTTSEQSSAQQTSGQTEAHATAGSSDKPEASISNTKKKPREMQLPIIPPQNLTLVVRIFVARECSSKTFQNTISTIKNLSAIEGAKSIFGKELVRQARALSKNIVSDLDELLPQIEKAVTGTEIQGVALAKFSPGASEQNKLLRVLTALDHLFETKKKGDDKDEQQREKDELLMALYHNSTFSTMWEKLSACLRAIHQRENMINVATILLPLIESLMVVCKNTTASDEPGQKDAANKDEAAQDTLAFVHPSVSVTTPISETRPIIESHTANLFFSFTEEHRRILNELVRNNPKLMSGTFSLLVKNPKVLEFDNKRNYFNRSVHLRSGPHHSRPSYPTLQLSVRREHVFLDSFKHLYYKSGDEMKFGKLNIRFNGEEGVDAGGVSREWFQVMARQMFDPNYALFVPVSSDRTTFHPNNLSGINEEHLLFFKFIGRIIGKALYEGRLLDCYFSRAVYKRILGKSVSVKDMESFDPDYYKSLCWMLDNDITGIITETFSVDDDVFGVVNTVDLKPGGRDIPVTQENKEEYVRLVVEHKLLSSVKDQMESFLKGFHEIIPAELISIFNEQELELLISGLPDIDIDDWKSNTEYQNYTPSSQQIQWFWRAVRSFDKEELAKLLQFVTGTSKVPLNGFKELEGMNGVNRFNIHRAYGDKNRLPTSHTCFNQLDLPEYDSYDSLRAQIIQAITAGSDYFGFA

SEQ ID NO: 1435 - protein, 731 aa, Unknown
  Kingdom: Fungi, Phylum: Ascomycota
MSTDIKWQNTFEVLPTDAVSPGQLVGDKISLPQSALEELLVAASGTGGKSNLYSEQPGDQTGLPSPLTFRLVNAENRKEVYAGILEFSAPDGTVALSPLIADALGLHPNDRPNQGNTSEERHPQRITVQICPVPKGSYVRLRPLEAGYDADDWKALLERQLRHGYTTLTRGLTLSVHGPRNETFSFLVDKLSPDEPAICVVDTDLEVDIEALDEEQARETLRKLMSRTGTPTIQGSSVGGKLDVWKSVEGKVIPGAYVDFTLPSWNRSQLLTITVKTQDDADSDHVDFFVSPKSSRQRALPRQTEHVFGSFASTADGTRTIHLRPSNAELDGAESIMISVHGYASRDQSLEEGSYAIPFSIRAQSADDGVPDGSSATATEPSPDDEQCKNCMQWVPRQSLVLHQNFCLRNNVRCPRCSAVFKKGSTDFENHWHCDFDEATGGSQQSKKKHDDIYHTSRRCQSCEFSTNSIPDLARHRTSVCPGKLILCRFCHLEVPQEGDPFNPSPEVLLSGLTAHELADGARTTNCHLCNKIVRLRDMAAHMKHHELDKTNRDLPPTCRNINCGRTLHGVGPKGQVRYIPPAGEDTRTGLGLCATCFGPLYVSMHDPEGKALRRRIERRYLSQMMTGCGKGHCGNEWCRTGRANSGRDPKPSNAQGVLPLVKPLLAEAIGGTSPLYFCVDEGSHRQRHAADLVAAEGVWDQHWTIAAAEAEGGDPSKMRDWLQAWAPTRY

SEQ ID NO: 1436 - protein, 1292 aa, Unknown
  Kingdom: Fungi, Phylum: Ascomycota
MATLSEAVLLEDELNIQRVILSSLDGATFEGAESERIEAREEIVKLQQRLRSLRAGAHSDRSSSQRNGDEARLSTPSTPKRQQDPQEMDTVRSGNDIWTGSGSLASRDRKRYHDNTSLGVKSEHRNKSRRTTPTPGSSGFRSPFSTQGSEVIDLTGIDDGDDTTDYLLRQKLEEDRRAQERRDLEYALAISSGDDMPSLGRSTSSRATAPNALQHLMNTQRANAYAPGRHSADEMPSATQFSPEGIPSLHSRPSSGPVTPNDLTPRLPGAYDPSWDETRTTGAVAPAEDRSYLTRPSPYHGSHGHQSPVQRVAHGPIGPTRVLPNGHTSGIPGSYNQVMQPWMAPGMSNMNPMANSQWSPHASPGMAAAASPMRSPATSGIHPRLTRADMPSWSGFRRQMMSGTLSGTLSNIISQTSGYDFANRTDAFGNPLPPHIASYLDDTDPYADPEMTARELEELLQNIEPEVQVPKGLQGITPDALTTPLYKHQEVALTWMKKMEDGTNKGGILADDMGLGKTISTLALIHERKSPNRPKTNLIIAPVALMHQWKDEISRKTKPSHRLSVFVHHGRKSTSDQLMGFDVVLTTYGTLAAELKRYEKWVEKHAGRDLDFNDSDLAIKCPLLHPTKAKFHRVILDEAQCIKNKDTQTAKACHQLRAQYRWCLTGTPMMNGVVELYSLLKFLQIRPYNAWNSFRQSFGVLFGKQGDSKSTAMRRLRVLLKAILLRRKKNSLIDGKPIVELPEKTEEVTYAELSTDERDFYTQLESRSQVIFNKYLRDGSVGKNYANVLVLLLRLRQACCHPHLNLDVDDIAPAVDDDMLDRVKRLDISTVNRIKQIEAFECPVCYDAMTSPAFFFPCGHDCCRPCLTQLVDNATQNNIQAGNESSKAQCIACRSEFDPKECFSIEAFQEIHMPEEHAKRKAEAEADEQSDSEVSEDDSASDAEPEINESEEVDANGNLRGFVVSNSDEELDDSFLALSSKVRKSTGKNEDTLNAEGVKAKSEGDVKVKPDFEGKLKGEETSPSLYAIPKRESEAVDEAVSIPNGAAGSVHENANATKKDKGKEKEKKKKNTSKGKRKTKIKTSDIKPSMLKALRKESFKNRTAYRKYMAYLHDTWLPSAKVDDGIRLLKQFEGDGQKTIVFSQWTLLLDLLEVAMAGEFDEKPLRYDGSMSAIERANAAQDFRDKRSCKVMLVSLRAGNAGLNLTAASRVIIMDPFWNPYIEMQAVDRAYRIGQKNEVKVYRILTKQTVEDRIVELQERKKEMVEAALDENAGKQLGRLSVAELRYLFTGR

SEQ ID NO: 1437 - protein, 859 aa, Unknown
  Kingdom: Fungi, Phylum: Ascomycota
MSPHSFVAVPAAPAPATAGSSSGGFEMTPTQQSPAQHTRPSPQSPPLASGAQQPQYSQQQQQQQQQQQQQQQQQQQQQQQQQQQQQQQRSVKRPRPVKSCTECRKRKLRCDRLCPCSQCQKSSRVCRYAADYDSANLSDGSDPEIEPGRLIKKACGESSARAATAIGDPAQAPNRRSADHPSSLGIGFVEELAIRMDRLEKHVMSGRVSDVRLSGNPLLPNPAPTMRGLSMKQAGQRTRLFGQSSTRVLVNLVSVHTTCPNPCFNRILTPSWKFEDAKEFLHARQHTPDIDDTLMYFRKLHHTLHQDHHDSLAPMAVFVDSMMPIRKRMMDILPQKHVCDRLVAAYMDVSEATYRILHFPTFREQYKLFWDGKLQSDYFLPQLLAVLAIVSRCTTKSQGFGHERIEGVHTPTAFSLVRTWLDGLKGKQVTNIAALQVELLLMVCRQALMFRPQELWIPLGSIVRMAMGMGLHRDPSEFGPRISPFVGEMRRRLWFAVFEFDVQISLDNDMPCAIRDGDYTCRPPRNLNDEDLHPDMKEVPPAKSIEEHTKMQTQVLSAISVQIRARISHLVSRIDTLRDYQEVLELGGKLEDILEDTNQITPRYGITDHSCTSRIWRERVISDAHVRRALLALYRPFVLSAYSCPPQIIKSFLRSCMIVLGYSEELDPMLPHHAEVLGILHQVIRSDILSAAFSVCYFIQNSPPTQQNGVFYESQRGQRQLSESPARSPSFSAASRLMWSPDRLTQAVERTLGYLIRSLVRNRGTKDIVALAVVLEMVRTPEPKSENIARALRTVLDACLQAANSSREKLAMAKPAHTQPNTPGYGAEPFMGGYSGMFSYEQSGMIYRGAGWNLWGGWE

SEQ ID NO: 1438 - protein, 201 aa, Unknown
  Kingdom: Fungi, Phylum: Ascomycota
MHVATSAIAAMGVSPLVRLRMTHPDLIKRALDAGAHGIVVPQVNTAEEARSVITYSKFPPLGRRGQGSSFPGFSFGVDVATYVKTANDSIIICLQIESKEGVENVDEICALPGVDMIFIGPNDLALSLLGYVPARGDEPEYHDAITRIVAAARKHGKWVARLSNSGALCKEHLEVFDTVALSYDVRAIQNWYTAELKVARS

SEQ ID NO: 1439 - protein, 810 aa, Unknown
  Kingdom: Fungi, Phylum: Ascomycota
MAGFRPRSRSPSTPLFRSRRSGSTAGQDAPEPSNADIFFPQVYEDAWGRTTDPTSVLATHRSDIERARIFLLRFTNMNPDQWINAELRAIAMNPQLGTVPHIAAAIQQRVLGGRHASFEATPLLQAVRFMLIKAKIPDAIYTDRTRSVVDFYFDPTVARNLSAPPPDPVSYPYPAGRLKVVIIGGGPTALASAISLAEKGQGKVEVHLWERRWVWKEGPHGPFVDYPQTAKRRDQVVTLQNSVTELMTEKTLHALFDGRPEPVWPGSANIQIRKVEDRLLKRCQDPEFRGTIHLHCEGVWREDVSKVGDFHVLLGADGAASWVRKSYFHGYENERGRSYALGLAFNRPTGLPWSQPLNVFLTLGQTRYLLNASDYDGRGYLNMQLTEDEWHRMVDIRGRPVTFGNPGCLRVNGVPPEGFEEGQIFAPSEDRESPLWQTIEDGLKLFGFKESEVINVVRIPIVVQAVKEGVQYFPAAEAPQLCRPRALAAVAGDAAMTVHFWPGRGLNSGIKSGMALGDELVHALNNGKFEGLDINAMKEYNDFIMKLQDREHDKRSIPILNQSGTPETLGWLLEKAHSIPDAVAVDWLVGAMTQIAERLQRRADWPFEVVENVEPQIRIVLRQLRSLTLREMAVSFPWPTREMGGAEVLPIRSMKQEEKERWLRSLWRMLKDDKEPAPAKAQSRFDGEARSGTPKARFEAAKGASARPINEISNKGQPTSPGFLRPMSDGGNGDGMLRRSSATRSTRARGGSIDERFANISLGLPDQGFSRGRSPSPGEDVGLTRLLSVKKPNQKVLSDALSLALFRVDE

SEQ ID NO: 1440 - protein, 236 aa, Unknown
  Kingdom: Fungi, Phylum: Ascomycota
  misc_feature (229)..(233): Xaa can be any naturally occurring amino acid
MSNPNQLFLLADHVKLSLLERQRAQSLNVDAGSGSQDGHIARSLEQFRDGLAALSEEKARLEQEGDTSAASAIADSLAPLQKQLDDLTAQFHGFTSPSTNTTLTSPNDASLAADFAHASTSPSSARKASKTVRFSDTPDSPSAEHHTDALFGPGRYRDDPEDSAGYTDHAATLDNQQLHAYHSQILEEQDEQLDRLGESIGRQRELSMQIGDELDSHVAMLDEVEGVTXXXXXERG

SEQ ID NO: 1441 - protein, 458 aa, Unknown
  Kingdom: Fungi, Phylum: Ascomycota
MDRDRGTTTVKSSAMVPANPGVLPLVVHQATALHANPDPDPLRLALVAHHHHGTAPPLHVETLDLRDPHVRAAPHHSAQTATFLADAMYPVGDPGLPSAPDHVEAVILGGEGQDQGTILTSPRTPNRRRSRSPFRRDRSPPPRSPLTNNPPPSYRPRSRSPRRGPETYSNYRRPSPRDSLPTSARPSPPSRTRSPNIKDAPPPARSPPRGPSALRQPPTGPAAQRSFSSSSAQGPPAAGPQPSANVTSPTIPPAGPRGYVPPSSRGSFSSRGGSGPGGRGGWAAPPLSRHTSAGVSSPSTPTGPSNIPTGPRGSISNGASTSQGAQSSTSRPFNPPTGPSSSTTPTMTPSSLPRQPPSLASSVLSSLPPLIPGGKLDPITHPLITLGVSRDLEVHTRKLRDEEERLREEVRQRQDRVRKSLYMWQRLERDSRAWEVRSDLSERSMNNLAGEGIGGAAF

SEQ ID NO: 1442 - protein, 629 aa, Unknown
  Kingdom: Fungi, Phylum: Ascomycota
MASTKAAPVKKNPRAWDSLTPALPEWILDAVSTMGFAQMTPVQTATLPHFMGNKDVVVEAVTGSGKTLAFLIPLVQRLLRLEEPTKRHHVGAIIISPTRELAAQIHAVLLSLLEFHAPSAEILPYLKGDEKRPLTTEPVIVPQLLVGGTTTTAQDLSFFMRHSPNLLISSPGRLVELLGSPHVHCPQSSFEMLVLDEADRLLDLGFKPDLQKILSSLPKQRRTGLFSASVSEAVSELIRVGLRNPVKIEVKVKMKGGGVLEDRRTPASLQMSYLVKPASQKLPALAKLLENLSVRPQKSIVFLSACASVDYFQHVLPLLLPPGFSLVPLHGKHPAKVREKNFNKFLTSVSPTILLTTDLAARGLDIPQVDLVVQIDAPSDPKAFIHRNGRAGRAGRKGLAVVMLHPGREEDYVRFLEVRKTPMKPLERPEVPTSEEDADAAAEKIRELVKTDRALYDKAQKGFVSWARSYAAHQATSIFRVQDLDWASLGKGWGLLRMPKMPELKKWDGDKTLGQTIDWDNFAYKDKAREDARKEALTADKSEFAEKKAAELKRKKRNNEAWSAKHEQEDVRLEKREKRRKKRDAERTSKMTEEEKNEEMELQDMIRKIRERNQANGKKDDDEFEGFDD

SEQ ID NO: 1443 - protein, 410 aa, Unknown
  Kingdom: Fungi, Phylum: Ascomycota
  misc_feature (296)..(297): Xaa can be any naturally occurring amino acid
MEIPLSHVKSPASPGVPITPLPFQRPSSLDIDDYFIGPRDIQKHSKWPLFLRLHGSVTVRLILPLSFMAAWSTTIILIHKLVSPIGVESVLLTITGFVVGLGLSFRSSTAYERYAEGRRFWASTIMASHCLGRVFWIHAKDAPSQSVRESTLRKISAMNMVVAFAIALKHQLRFEPFTSYPDLQHLVGHLNTFAKEATELSPQAPAKKNFFKEIGEYLGVSFAESNPRKTIKKAKAPLGNLPLEILNHLASTIDYMIANEQLTIPMQQTIAQITWVYVLLLPFQLVKPLDWIAIPXXTVFAAYIILGLLLIGQEIENPFGHDVNDLPLEIYCEQIAHDMDVIAAYDKSQADFMLSSNNMPLYPVSTAPIGTWMQRSEEKLREAIRTKPNSTFLWKQTRSPGNAKSADHMA

SEQ ID NO: 1444 - protein, 355 aa, Unknown
  Kingdom: Fungi, Phylum: Ascomycota
MERSAPEYTQSGLPSPYPSNFGDNNSEGSTADQPSAAAAAQYPVKQEYNPTSANSTATPTSEYGVYPPSARSGSFPEHIRGSYPGPGASGGSMAQQQNNPSIAAASPTYPYPQHSPYGPNPDMAHGYSHPSGGMYPQTRPDWAGYGGHGASPLTPGHMYNSPASAPQQRPNQVYSFVPIPGAQQHKRPRRRYEEIERMYKCGWNGCEKAYGTLNHLNAHVTMQSHGQKRTPEEFKEIRKEWKQRKKEEEAQRKQDEERQRQAAAQAAAQNGGDPQGPDGTPTSYGPSRGAVQLPPIGYQPAQYPAPPGSAGVPQQPLADYGTSHMYSNYPPHSPYGQPSSQGMYSQSNGQQPPSH

SEQ ID NO: 1445 - protein, 2010 aa, Unknown
  Kingdom: Fungi, Phylum: Ascomycota
MPTPTNHILNLPSTNLSTAKPRLPHDTHDLELASTDSKRPLNQTSRRLTWLLRLPALTSSLQTSSRSLPHVILPAGGLKCFASSGSFKSSSCDTMATPNHPTYPSQTPAGRPSLDRDGSGLQPPINGASRNLSASAAAYAHRGAGGGSFNPSVGPGSFSSELRSHTMLSSAGRLNTGSVYPSSVMSKVDEDDSDQGTAQALASLKDRLNREMKIKEGSENMLEALNTKKAKQTKDQRQRVEAELNASNIRIKDLRQKISETQRTRAVPPPTTPTRNRTQEAVTSNGIRSPPSASRSVVGSDVDESTESPTFALAELLQALEVEGMAPEYYVSRGNQLVELFKRHPTLKYDLVWSVFGLRVQMMLLSESREVVAAGYRMTRYAISDINSLRKIRSLNTDFLVIRSLNNYRKADVEREQALKFVRAFLDVKDGIKEVSRAVVRTIVAVAEHGEARAANAPISDQDIDRLRPICIETLAEILLRDPRLLLASGGLGPLTEALCDGMYKSPESLTSAFLFLLDSPQRRKYIKPGHAIEGLFTAFTDHLYSNDAVLKQNAKAIATAVKSWSGLMSLCMYDYWPIRSLFASMVLPNPTVRETVLDLLFSLLRIKPPAWAATYLAGRRLTTYGRVANLKSATKDKGAALYLEEDSGEQNFVEHYTALLLAIFIKAGLVNGLLKMAQTEEDPTLRRKTTLLIGEILKLSSRLLPPLWSAELQLLPELFSAATHFEDKNHFISTGIVYQISSVSRTLYRSAPSGSLTGALPTSNSTHDLALDEHPKTNAAMVFDDATFRQLLIDTNVLNSSNYSKWNWEVIMRVFDGPLQVGKRLEEAIKASKFMKRIMSFYRPFKHKFAEIKNTRNTQKYVKAGCALMHSLLQSPEGTKFLADSKLLRQIAECLAQCDPTSGITAANPMFSPDGLSETLCGGYIAMLGVLTSDPKGLLMIERWRMFNMMYHIVDLKQRPDLIKLLLSNFDYSNQGHPRVLLSKALTAGTKDIRIHATNAIRKYAIRPVPSLHSQGGVSDSKWAIQMLVTQLYDPEVEVCATAVKILEKASNRKTYLEYIVECRPALDHLGEIGAPLLLRFLSTSIGYHYLDGLDYISNEMDDWFLGRNDTYVSVIEASLAKSFLADPDDQSNRISIFDDGEADADFQDSHVPPHFYRELTRTQEGCKLLNDKGHFEEFVATIREHGMQTEDPEVLTKVKGCLWAVGNVGSMELGAPFLEASDVVEQIVKIAESHEVMSLRGTAFFVLGLISRSTHGLEILSEHGWDANTTPMGNSLGFCIPTDLSKLFNMKPWKQDNIASITLPNSQRTIQEAPTPRPPRPPLEAADLPPLLSDEQVNERILELIVDLGNMVLYKKALTELQKLRARKPSAFRSKEFFMEESSGSSEEDETNPVDNDDDDDEDDEGEQEEEESRDGSSGDDRTERQRSISEPMLTISEFRYTASRFSVVVVDDGRVSGWAPLSTVLFFRIPQAPELGSSYMQADYQRCIFEMTPPRVLVIAGSDSSGGAGLEADQKVIAAHGCYALTATTALTAQNTLGVRNVHVVPAEFVGEQIDACVEDVGVDVVKTGMLASAETINVIAKRITKHNLSTLVLDPVMISTSGSELLPSSAVSQLSTHLLPLTTLLTPNIPEANLILRQNSLDAVNVQTPADLETMARRIRTLGPKWVLVKGGHVPFKDDLTVAGEDDSEKKVVVDVLAGEDGEGAVWIKSAWQNSTSTHGTGCSLASAIASGLAKGLDVPSAVRSACRYVEVGIQTAPKLGGGNGPLNHFHSTYSLPFSPQLSRFDALRGHFVEYLLNRPDVKPVWEKFVYHPFVMAMGNGTLPIESFKGYIVQDYLYLIHFARATALGAYKANNMGDIGRASQIVAHIMTETKLHINYCESFGITPAEIEATEEKQACTAYTRYVLDIGQSQDWLALQMSMAPCLLGYGAVAKMLHSHERTDKTDANTYWPWITNYVADDYVEAVRLGSELLEKHIVLQSPSRIEELVKIFIHGTKVSILFVTEP

SEQ ID NO: 1446 - protein, 1031 aa, Unknown
  Kingdom: Fungi, Phylum: Ascomycota
MSSHEITISPSHDRAKEACLQMPVDKKESPKADNAQPGNEHETAGPSRARHKMNSSGANDAAHNAAKRARSQTLNAKKTKRVQSAGHREKNVSESEDELSSLSDSDSSRSDSDSDDPKEAATRNKRSRASRKTRRRRRVRDSTRHRDKSRQVSDSDTDSSTAGDSDRRQKSIRHKGRRQVEGNAAQDSHICDQLERLELRLFQLQTAVAYGAAVPNMTMSNSGVASVIPPLGARFSQLTGNNGSVPALSPLQPPPATLPASSREQSGRSGRSQRCGKSSHREASSGDEVDAELETRAKTPKETKKKGKADFKRVDWVWDSTRYTFKLQNTAATTVTRYDDFIFHVRRTFDSEGKYRQTFVDIKSKLLRECLQDVIGNVRGASLVDGTPKLDPNLLFLYLEDFRTHLKHLRKAEAAGDDKKERQKNRARLECKMEHLRTLIRYLDKDYAKVKESLYPMLESGVITFDLLWALWKPNTIVYGTAYGNTEDPRAFKVGMAYRQTSLMRGEFYLVEGKYLDFDGKRFGYGSVTQDIPEFQGACKITSLPCFPLKYHKDEALIREKLIARGRKFVALDGVHFKSYSGIAYQKRKKNSVMRFSIHQSRVMVDPAIFRRINPNYVVSTVRPKDHDILSDDGLSSDDSDAAGCPCGSAEEDDSGSRTEYISRVFKDQSGGIIVARLPKSDVEESEEQGLEPVPSKAEDKDSVNTSAEPSGAGDGTPQPSPKGTYTDVTAFSEDTLLIASPVVLGFSFAEKQWLELSVSGIGEIKWNDKAWDSLVLETATKDLIKALVQSRKYHAAQTIDDVIQGKGKGLVTVLHGPPGTGKTLTAEGISELLRCPLYMVSAGELGTDSRFLETELQRILDICHAWGAILLLDEADVFLEKRNMQDIHRNALVSIFLRQLEYFQGILFLTTNRVQTFDEAFQSRIHIALRYDALDYKAKRAIFRMFIDRIKALGKIKLEAFTEDDFNALARRDLNGREIKNVVGSAQDLAVNKSEPLSMRHIRQVLDVHTKFGHDLQGGPGYEDAMRSFM

SEQ ID NO: 1447 - protein, 709 aa, Unknown
  Kingdom: Fungi, Phylum: Ascomycota
MDILKVLSRGTKKTSKPGAGSATLLPSAGAQAHPQLYHDPIRGQKRKRNDDQTEANTTAKELPEVDFFAPKQENAPKKDTDKDAASTAKDDVPNPAAQVQLSEDECRQLLRSHRLKVTILSKREDDSRVTKKKKKSKKDKDEDKSGKKDAKKQLTPQPLSSFAELRSVYGISRRVAENLVTEGYRIPTEIQLGCLPLLLRPELALKQDSGLENGVDLLAVAPTGSGKTITFLLPIFNNIMRRRAEAKLHGIHELEAIIVAPTRELVHQITNEGRKLLDGTGLRIVGMKKRMNIESVKQEIIADSSDEEEADDGSDEDDDGDAGESKKTQAQKPVTRTDILVTTPLLLLKFLQNGPDGAQRVLPTVRDLALDEADVLLDPLFREQTLGLWAACTDPSMRLTFWSATMGSNIESLVAEQLEARATELGVQQKPLIRVVVGLKDTAVPNVKHKLTYTASEQGKLLAIRQLLHPRSKIDDATPLRPPFLVFTQTIERASALVEELKYDIPLEAGGSTRIAALHSGLADSARASIMRKFRAGEIWVLITTDVLARGVDFAGVNGVVNYDVPGSAAAYIHRAGRTGRAGRTGGVAITLYTKEDIPFVKTVANVIAASEKQAGKTGDEAEIKKWLLDALPDVAKKDRKILREKGVEVRRTGRKGAEISTKSGWERQKEHNRKGAAEGSKRRKMEGKKDGMARQKGGNGEEWGGFED

SEQ ID NO: 1448 - protein, 230 aa, Unknown
  Kingdom: Fungi, Phylum: Ascomycota
MSRSLASRVATQAALLPRASICSAQSLRPFSHSVSRCDDSKSGPGKAGGNSLLSDIYGTPQAGKSNPMAGLSNNPIFKTLGTQSRIDTSSLMGNTSQQQPNSVAKEDPEPYHLHIYAHKHNTHVTCTKPNREPIISLSCGNLGYRKSRRGLYDSAYSLTKYVLDRLVHTGWPPKIDRLELVLRGFGQGRDAAVKVLMSPEGRVLRDKIVRVADSTRIKFAGTRSKRPRRL

SEQ ID NO: 1449 - protein, 474 aa, Unknown
  Kingdom: Fungi, Phylum: Ascomycota
MTRSRRRGGKDTGYHGQASMVSSIVNLLNTIIGAGTLAMPSVLSHMGIMLGVILIIWSGMTAAFGLYLQTKCARYLERGTSSFFALSQITYPSAAVIFDMAIAIKCFGVGVSYMIIIGDLMPGVVLGFNSHADRLPYLVDRAFWITAFMLLVIPLSFLRRLDSLKYTSLVALVSIGYLIILVIYHFATDAHANPRDIRVIKWEGAVATLSTVPVVVFAYTCHQNMFSIMNEIKDNRPSSMMGVIGTSIGSAASIYILVSITGYLTFGNSVVGNIVSMYPTGAASTIGKAAIVVLWRPSGGQASGRANSPAPPPRSDHASAPMSDTRFALLTTLILTFAYITALTVDSLDRMLAFVGSTGSTSISFILPGLFYYKISDPDSIHHQRLLKEDDDMGDSADEDIEDSANLAQSTGSIRSAASNSSGREGWRWRRKWRWDLEHLEHGLIRRMALALAIYGMVVMAVCLIMNIFFAATG

SEQ ID NO: 1450 - protein, 537 aa, Unknown
  Kingdom: Fungi, Phylum: Ascomycota
MASLTSTLWIIPTVFLFYKVLTFGRREKGLPPGPPTIPVLGNAHLIPAEGLHIKFKEWADQYGSIYSLKIGRTTMVVLSDREAVFELLTRRGAYYNNRPKDKQVDVAMGHENTALMAEGPLWRAERKIVSTYLSPKNLDSVLAPIQVAEISQLMLDLLVKPECFRDCVKRTTASISTITLFGQRAPDLNDYWGYAVYLGIDEVNKSLAPGSYLPVDHIPILKFVPDRWNKPLQVAKQSYITMSSIWAEGRGRVEERRRQAGTRVSMMDKLLDGDLKSDIPLTYSQLNNFFGAVHMGASDTTSGHTLASIMFLAKYPEYQDKARAELDQVCGTERMPQWSDFRDLPYINCIVKEGLRLRAALPGGIGHCAKQDYWYKGMFIPKDSMIMVPPSAINFDERYVQDPKTYDPDRHLHIAHKLAPELAASSHFEDRDHYTYGVGRRICPGFHLAERVQWRIMAQLLWAFRIEQVEELNTGYEMWDEGFLNYVKDFKVRFVPVSKTHAEMGEYKMGRISDRNYMITESEALERKSSVAEKNKD

SEQ ID NO: 1451 - protein, 505 aa, Unknown
  Kingdom: Fungi, Phylum: Ascomycota
MSQATVDSQTREELEITTSSLNLFDILHNSLILRNTVPHLPVSSILNLAATDRSFRALINQTPGVFRHLDLTRVKTAQFDIDEIDRGGQIWRNVQLDEYLTEDDFYSGPLRGVFSTLKRHNILQDVQTLILDGLSVTSELCYDIINDPSFNVRILSIRDAKNLNQGKLRGALQYACRTTRPDNTPRLKALYVFGSKDAAPVDDSTSGATTTGQRPHNGHPHGSSISAGWNQKSQLALTSALRREGDAWWSKKGRIISRPISNEWVNCMVACEGLIAFDAVLCHGPRHRNSPVFGKTPFPLRVDSNEPAVATYAVSGCESCGKAPEGLHHPQTSQPMSLPLLAPPPVLSSSIRAATSPHHHRGSNETHHEELSFVARCMDCLRERYCAGCHKWWCEDCYQLPGQYAASGAEVSNIVVVEPEEGENDDAAVSVSESLQTIAITATPKFKNRIAKSCWECGNNCDSCIDRTQRVCRKCCAGYCIIHNEGSSATHCDWCVSRGRGLGRL

SEQ ID NO: 1452 - protein, 421 aa, Unknown
  Kingdom: Fungi, Phylum: Ascomycota
MDSLPGPARRVAAERQDVWSMINEAAAESPIQPLVNLGQGFFGYNPPNFIIDAARDALLRVDCNQYAPTKGKASLKKAVAEHYTVRLGRHIDADTEVAITTGANEGILSALMAFVEKGDEVIVFEPFFDQYISNIEMAGGIVRYVPLHPPAQGSTTTTSSGDWFIDMGALESTMNARTKMIIINTPHNPVGKVFAKEELDAITQLAVRYNVLILSDEVYDSLYYTPMTRTASLSPEIFNRTLTVCSAGKTFYATGWRVGFLIGPPHLIKYVSAAHTRICYTSPSPLQEACAVGFREAERQGFWEQSRQTMAAKIARFCEVCDELGLPYSKPQGGYFVMVCFAKVKLPEDYVYPSAIQGRPRDFKLAYFLIMELGLAAIPPSEFYTPKNQGSVENWLRFAICKEDAVLEDAKERLRAIRKWF

SEQ ID NO: 1453 - protein, 390 aa, Unknown
  Kingdom: Fungi, Phylum: Ascomycota
MANTPPIVLDGGTGFLKVGYAAQNFPEHQFPSIVGRPILRSEEKTDNDIVIKDIMCGDEAAAARTMLQISYPMENGIVKKWDDMQHLWDYTFSEKLKVDTQGRKILLTEPPMNPLKNREQMCEVMFDRYGFGGVYVAIQAVLALYAQGLSSGVVVDSGDGVTHIVPVYESVVLNHLTKRLDVAGRDVTRNLIKLLLRRGYALNRTADFETVRQIKEKLCYVSYDLELDKHLSEDTTVLVEDYTLPDGRVIRVGSERFEAPECLFQPHLVDSESPGLGEFLFNTIQSADVDIRASLFKAIVLSGGSSMYPGLPSRLEKELKQLWLTRALQGNPERLSKFKVRIEDPPRRRHMVFLGGAVLANIMADKESMWVTKAEWDEQGPRVLEKLGPR

SEQ ID NO: 1454 - protein, 364 aa, Unknown
  Kingdom: Fungi, Phylum: Ascomycota
MNATKKSPTSGSKSVKPQHRAPKRAGSAASVHHHDHITSNSGMDGRHKRVWKACERCRMKKTKCDGEFPCKRCKDDGLVCTAGIRKKVEFKQLPRGYAEVLENTQFALIATVHKLYNMVRSGEQWTLGEPELNDRGLPVIHDIASKLGAIRPNSDIDLPVHSVFPEDEAGMAELARQLEEQQMPSQEAPSLVSRKDSDSTTSSSMSPEMDHSDDGELDMNYRRMAFGNINTGVSSPASLTHSADFDNTPTSDVDINSFNLFSAAQPTAGSFTPPMWPEMIPQQANEPQNFNSEQTARLQQLQQQQEQMRQLMAYNRAQQMMQQSAAAAPGNNFAMKPQALSHPDSDPMISMGDPMIYHGFDYEL

SEQ ID NO: 1455 - protein, 197 aa, Unknown
  Kingdom: Fungi, Phylum: Ascomycota
MASLRIQSAARMLRAASTPAMRAAAPRRWQSSVTSATAAVPAPETTNQPDYDIQADKATSTYTPVPKRVQEGTEDVLPAAIISGAPMELQARTVRIYKEAKPATQSGNWRGQHWRMDWDVLAKGHRWENPLMGWQSSGDFMQGTNIHFHSKEDAIAFAEKQGYEYFVQEPNSRKVQPKAYANNFLYSANKLKHIRTK

SEQ ID NO: 1456 - protein, 1067 aa, Unknown
  Kingdom: Fungi, Phylum: Ascomycota
MTDIFSTPAPSTQISQSLDTVDNVYYQLAGASSDADPWLLRHCRFDDFGSLQLFKVHIRNAGGVPTRDKIPAHFLVGDRDVYDAARAEAGIDYDGDLREELARLVPPETGLRILRLFMKHVFPLLPVISRSRLGLGKLEDVATAHVLDGIPSPLLAAIYGSALPFASEDSYLYLATSHDKVPVVKIWSLVHRSIVQGTHTPRLSLVQAAILYIHRPVHDEHSYAVTDAASMWSIIGLTVGMAHSLGLNLECRSFGLPDEEKRIRRRVWWALYIEDKWASLLFGRPPYIRSSEWDVSRLEDVDFYTTSRREPSSVDLQLAFRHMTSLAVIAESVQDKLYSLRASQRLAIDLSASLAVAKPLLDTLGSWRASLPSDKDHHTQNEPTVRVQTQLPATIHNAYWTLLVYVWRALLRATVRSSDPPVVIHMQDSSDSGYFPEDINWRFDYLPEMNDRVEEDMIDNSHIVRELHEAALTCASNALDFLSGLDYSAFDGFWHSWSRKSFASISSFLLLLLLQAPDFPKAARAKALLNKWQQILLHRHKSFPPLSQAKVRLDSLSWSGLGVAFNLAPHVQQALQHSLDPGPDRVSNTLNLFYPIQEICIFIMVFMDDSGQPSQEQIGKAKDGLRIKEPLSDEELGYPEGGPRAWLVVVGGWCAMVPSMGLLNTLAVLQAWTSTHDLHNLSEAQIGWIFSSYAFFLYFGGAQVGKCPVQQPTFDGNSSDDTGRSNLRRPRYQGPADSWDSRHLLVSSIPQLLHRARDWALSQHATEFYQYLLSFGVLGGLSASFLFNPSLAAIGHWFHERRAFTTGLACTAGGLGGIAFPLIILYLSPRLGFPWAIRIIALICLGLLLVACVTLQKRLPNNKQGGACIDLKALGELNFAITTLSVFLIEFAVFIPYTYIVSYALHNGFEPQRAQMLNVLLNVGAVPGRALPGYAADRFGAFNTMCVTAGACTASILALWLTAGESQARTTAFTVLFGFWSGAAISLTPVCVSRVCRIEDYGKRNGTAFFVASFGALVGVPIGGAIVDGNGGGYRGLIVFGGALYAAAFVSFVIARGIAGGWRYCKF

SEQ ID NO: 1457 - protein, 977 aa, Unknown
  Kingdom: Fungi, Phylum: Ascomycota
MVLYKRKPVQFLAPEHVEDEDAEVWYIPQTGEIFASYENYLSRMDFYKQRRFNDQISGHSGMTFFEALKNELAGGEEVEAAFPEALKGPVLRKAQFQTVSRLDHLVDMIYETFKHDYFPGEAVTVFYPDDEKRLAGLVRDKVTIGARLQADGSMSKPITRYLIFVVGRDEESSFEETQVSRERGVFTKSMIRSFMRKTVSREAWNGAPWLVKPDYAAQYYIDTRIPPHLRYDTKLMERKQLQAQKRASLPGETAQGAPVRLPELKPALKLNKTKAIGGAKGKWPQDVPVHIANSNAEMVTVAREPTPPPPPKYPIEDLQLEPRENAVRPRLEFYCHNPPGKVVNGTANGTSRTSQVDMDSVGPLLETWDTLNVYCEIFKLDSFTFDDFVEAMSVASEHVVVQLFEEIHCSVLKILVDSETDGGKVRINLPQLEDEDDSDKDEDDDEEGEPTPEPEPKPTGRATRSSLAKAEAERLAAAAEEESLRAELETKHRAEELLNDYDWIEHLRKRDFPNGGWERIVVGLLHQLSKNERYEQKCEELLLQLVPPGEEPSQESVQLNYAQLDLSYRVKALQIMCMLTMETKTVRGYMDECSETMTKYRKEKVEWQRQKKQAIEDLRVLNEQRKELQPAETAPNSPKQGSVKEEDGDSRLEADESQIDKDQEDGDQTDQNVSSKRKRRKPLTEKQRKQEEEREKRAKLKEKEKREKEAATPAQSKQLIKVLKEIQKQEAIIKNCEEEVAIIENDLREADCPRTRVMGKDRFWNRYYWFERNGMPYGGLPNSSTASAGYANGCIWVQGPDELEREGYIDVPEDQQNEYKAKFGLTVPERKAKEEGGTSVFTARQWGYISDPAKVEELIDWLDPRGFNELKLKKELVLFKDRIIQHMENRRNYLSSGDADGADEEAAVSKRSSSRIREKTPEPPSYLCLRWENTTILEELGHLHSEAPPKPRQRKQTRKRESAVVEVAPPAKKTRRK

SEQ ID NO: 1458 - protein, 1015 aa, Unknown
  Kingdom: Fungi, Phylum: Ascomycota
MPDIMRRASLEEPDDSTSRRLAEDAVTMDLDLTMPPAQEDDCDDDMFEDDLDQDPRIYTPPPRIAARFYRPSHARRRDSAASSRRESISSAHSHSRCSSIQGGRTSTGGDQQSKHVAQHLRRASFLEDRRARLADRAAHAEKVRLRAALAKAAPRGSSASEERALAAQQAREKNLAKIVADCAEEVKKAKQISEQIKEKREQDHARMKAQMEERMAEAERRREEIRIKTASRRSRGQSLMTRRPNESPPPHKEDGKDTGTSAMSSDTAARTIQGWWLGRMRQKTISEFNNLGLSLDSIRDASFDSVVEQLANPQVLITTARLLRLCGLQEGRPGSVEEMAAVRTFLSAFLIFGHPNQVLSNKDDPGQDGLLSTHRLPPADLDNPQLQELVSKAKDLLICFENILARLTPSNRYTMPPALKTSLPESYGAWSNAFIAWKSRDADAMVEVMVMQFVELDAILHTVKDKTDEAATELYRQSIRGNQLQLMVRVKRIAGPERGKKMIFDAVAEARRARMAKKQTGDTKPRVAESSTEEDTASARKIVATVAQTQAPPTTPLSTSTIEPSVTYGGLQGLLPDNRVVVHELAINKEYQVPAEEYKAEQAVLTRPMFEQMRAILDHTDAETNFKLFLVAAARVKNKLQRLLKEGNSMHKLIGEILDPEIAQQQFTMGSFSYETFFSAMGNLLPKLCAPFRDDEVKDLVQNKLNDGNLIDRIEALNDFIDLMLCDYMNYLLRVAAPQLIDAAAQYEGVRFKKQVEDGMALTAAEEAWRVARTKVMIEAQKRDPENINHPKSRPTGTKFYAQMLVDVFTQPLPIKPQNVPEMLQLDLKRIEEVSTMVQHIITVGAVLLQCKNLLKRDVRSSWKMEASRIMSVLEASHDSLDTTINGTMAALEAGRSMPAVTKTHLRALVTKVLTASQDMTLRSIEPREPVLRLLLTRLRGNILARLAPGSANEKVKAANIAGEKLASLGLSEFVEKVRGISDLLDKVGTVDRAAHDIWWDLVATKVEEQDPIST

SEQ ID NO: 1459 - protein, 861 aa, Unknown
  Kingdom: Fungi, Phylum: Ascomycota
MAPPAKRRRRNVVEASDDEDDHQQQNTLSNFLLSSPNSPSKTRIPASSPSPSKIGTPSKRPVNSPSRPTRPTRRTHPTKNGSSSSPKKIAGTQRSNSSKTADLKTLFSKQAQKATTLSQPVSERRDPIEDLISDDISDDEISELRASSSSLVSQHAKKRQREGAQVASSDPPSASQRFLKPLKLAGSEGLDDDLRPWSERFGPRNLEELVVHKKKVADVRRWLEDVMSGRMRQRLLILKGAAGSGKTTTVRLLAADLGCELLEWKNPSGHTGAGFVSASAQFDDFLGRGGKFGALETEGPTAASQVPTPSSSSNFGRERGKRIMLIEEFPNTFSRSSSALSAFRKSILNYLAAHVPSLSMFSSHASKDPIQPIVMVISETLLTTTSASADSFTAHRLLGPEILRHPGVGVIEFNAIAPSLLAKALELVVQKEARKSGRRKTPGPLVLKRIGEIGDIRSAVSTLEFLCLKGDQDADWGAKVSFTKPKKAVKTGIGLTRGEEESLELVSQREASLGIFHAVGKVVYNKRDDDAAPSPAEQLPNYLSMYSRPKPSQVSVDALIDETGTDTHTFISALHENYILSCESTGPMDLNTSMDYVNDCIEYLSISDLMCPSRDIFFGGRGGFTGRDSASHILRQDEITFEVAVRGMLFSLPNPVRRKTTTMSKTSDAFKMFYPTSLKLWRAKEEIEGLVDHWSTRLLKGTDALPVKNLTDGAGAFRKPQQPSEFSWMQRQQQQRQQSMQSAQSSENEESAPPLLSLGSAARRELLLERLPYMAHVARGRKTTGLRLKDLERVVSFQGVHAGMEEDSDAEDAEQNTGEAWATDKPSEEASPRKKASGIKAGSVSGLLAQKLVLSDDDIED

SEQ ID NO: 1460 - protein, 263 aa, Unknown
  Kingdom: Fungi, Phylum: Ascomycota
MPSPKTFLITGAGRGIGRGLSRLLLGAGHRVFLLDSDNAELEHTKSILAKSHDAGKDFGTAHCDVRRLDHVRAATAQASELFSGKLDCLVNNAAYTGGVGGLSLQEMTLEEWNKSMETNLTGAMLMTQACLPMLRAARGCVIHMSSTRSSMSEPHNEAYSATKAGLLGLAQSMAVSLAPDAIRVSAIVPGWIHVGNECQAADEEGLQWETGLSEEDHRWQLTGRVGKVEDVFKAVVYLADNEGVTGAELVVDGGVTRKMVYPE

SEQ ID NO: 1461 - protein, 1256 aa, Unknown
  Kingdom: Fungi, Phylum: Ascomycota
MADKEATVFILDLGASMAKANSGRRESDLDWCMRFVWDKITDIVSANRKTLCVGVLGLRTDETSNTLQDDDGYENISVLQDLGQMTMPGLRSLQASIAPSKTWSGDAISAIVVAVDMIDTFTKKLKYIRRVYLITDGQADMDADDVSDIAKKMNDSNIQLTVLGVDFDDAEYGFKEEDKSPTKARSLHAANEATLRELTKHCKDGMFATMAEAIDDLQTPRAKVVKPYKTYDGLLTLGDPESPTAMSIGVERYFKTHLARPQGASTVVVKSETQSTQTLDEDAMEGVDFSAVKQARTYKVNDPDAPGGKRDVEYESLAKGYEYGRTAVHISESEHNITKIETLKSFSIVGFIPYDKYEPFLNMGEACVTYARKNDAKSEIALSSLIWALHELGSYAVARIVPKDGKEPLLVLLAPGVEAKFECLYDIPLPFAEDVRGYQFPPLDKVITVSGQVLTKHRLLPSEELSKAMDDYVDAMDLSGGASEDNQEAEEYAPIDETYNPSIHRINHAIKQRAVHPEEPVAETPAELLKFSAPPEYLIEKVRGQIDVLIDAAEVKKVPPKAKGRRHREAVKPISGLDVDALLGEERKGRVSPVNPVPDFKRALAVAEEVGEIEEAAKQMGAIVRSLVTDSFGDSKYAQAMECIGTMRDELTNLEEPDVYNSFVRDLKKGLLSGALGGDRRDFWFKVRWSRQGLIDQEQSEVSKVTHEEAEELAPSHNYLSGAVPPALFTIEINTPHCNSIAARPSGMATYRGPDDELALRMRQLGLALGRQVTLIPLDEDNEAAVPASNDAEENQDDSELARTLTVGACISFMRGLRPENMLEPEAQSPGGPAPVDVGRPARRENASEGVNTDYFCPWRAVLSYPDHFIGRRNRPRARPFFNDILTGRVWDFFYLHDPRNPDLKPHLLVPTAQFVAFLAEINGKLDTELTIPPHQNRQKFCFRFGLWGLTPQPRHLARSENKHSLDDVEWPQLPELDWRGFNESSLPHQVAFLKEFDRLLAPNPITQAERAQVRERRRAVDRQAMMIQVQTQLGLVQEETTRDRPIFICIDVEALEDPPHPISEVGLAILDAEKIRIIAPGTNGSNWWPFIECIHLRTEEYSGFRNHKYVHGCPESFNFGTSKFPKKEQMPGLIRRLFERFGQGGRKIMFVAHDSKQDLKFLHQIGIDCMALPGVIGAIDTVVLHQKWRDSNDARSLRTLLTDLGMEYRNLHNAGNDAMYTMRAMLGLASEDERKTMALQQGKLYVPLFRLAGSR

SEQ ID NO: 1462 - protein, 500 aa, Unknown
  Kingdom: Fungi, Phylum: Ascomycota
MDLDSKSREPPLEHLTTADQAAQDADDLVHLGHKEELTRKFSPWSMFFLAFSVLGTWNTFAQGLSSGLNNGGPIDILWGLVVVTICNLCVALSMGELCSSMPTALEFILSMRLLYDPDWAPASKGWVQFLLYVGITVFLTLVNQVSCRRDIILPMFNNFVGVCYIGLFFVFSLALLISVGTKDHLHYKSAGFVFGQWINETGWSDGVTWFMGLIQAAYGLTAFDAAVHMVEEIPAPRKNVPKVIWLSVVMGAVTGFIFMVVSLFCAQDLQTLTDGPIGIPFVDLMNQVVGLKGTTVLLSFFVFNGMGQGTSLMTTGSRLTWGFARDGGLPWSNYFAHVDKTWKVPVRALWLQGAIIAIVGVLYTFSSFVLGAILGVSTIALTISYGIPIATLLWVGRDKLPPGGQFSLGRFGPLLNWVSIIYCIITSIFFFFPSTPNPVASDMNYSIAVFGIMIIIAVGFWFVKGHQSYLGFTTGNNEIAAVIDAQPETKSPGNTKSESV

SEQ ID NO: 1463 - protein, 1135 aa, Unknown
  Kingdom: Fungi, Phylum: Ascomycota
MSASKEAPLTVSGNGHSNGKNSSSTNGEKPTARTQTGAPASKSRTSIIANYTKLRKESRRPLPTDLGDGRYRSVTKRPGLGQDIRSLSRASQKFPDSVHLKTLLDIIKAKAKGEIHQDDKTMIMERTIQLVAGLPNHSRTQETLTNSFIDKLWDSLDHPPLLYMGDEFKWRRPDGSFNNPMMPSLGAAGTKYARTCKPHTTPLGALPDPETIYEAVMARDGFKRNPNNVSSILWYWATIIIHGKSQVANIKLTMATNLTIRVDLFWTNMRDGNQNDASSYLDLAPLYGGTQEAQNSVRTFTDGLLKPDCFADKRMLGNPPGVCILLIMFNRFHNHVARNLAVVNEGGRFTKPQGTRDDEDAAEAWKKYDEELFQTARLVTSGLYINITLVDYVRNIINLNRVDSSWTLDPRQEMGTSAGTKAGSESGVGNAVSAEFNLCYRWHSCISEMDDRWIQDFYVQLLGDGYGEMNLQTLMAAMKKFEASMPQDPAQRTFGGFERGPDGCFRDDDLVDALATAIEQPGGAFGARNVPRIMKPVEMLGIIRGRKWNLAGLNEFRKHFGLKAYERFEDINSDPEVADQLRNLYQHPDYVELYPGIVAEEAKTPMSPGVGIAPTYTISRVVLSDAVALVRGDRYYTTDYHPGNLTNWGYKEVEYDFKVNHGCVFHKLFIRAFPDHFKGDSVYAHYPMVTPPENRKILTNLKRVDRFSFDRPAFKGHRVTINSTGAVKQVINNKQTYTLIWREGLEHLMGRQAHRLLTGGDSSLHAQQRRRMLDVLYQGEWKAIVRTFYADTADKLLAEKSYRLAGKTQLDAVRDFGNLLPARFAARLFSLPLKTKDHPRGAVTEQELYQKLSLVFRSMSLDLDPTQSFQLRQEAKEAATDLTAIIETNVKLHKMFGLKGLFTKEPKNDPLTSIGTNMAAGMAKTGVTPYDAAWLYILPAAACIVPNQAQLFAQSLDWYLSPFGEKYRPEIHRVAAMQPSEHADALLLGYVLEGVRMAGSLTISREAISPDLVKEDDGREVQVRAGTQVFLPSALMSSDAEQFPNPETVDPRRPAESYVHYGAGPQTFLGKDICDVALVELFRAIFRKKGLRGVPGPQGQLKKIVGSGAIVEYMTEDWGAVSPFPTTMKVMWDAE

SEQ ID NO: 1464 - protein, 1096 aa, Unknown
  Kingdom: Fungi, Phylum: Ascomycota
MSAWMNDAAPNHNGNNGFPHMNDPNAAGAMMDPSAFMANQAQFNPNQFANQQQMAAMQNGPMRHASPTGAYQGQNQQQQNQPNPNHVYQPNSVIPSKRPRPREDSITGSPRQNPGMQPPSRSETPQQQNFPGFQAGVSMAPQQTAGQFPHLQPNGSANASPSPIMGNQMRPGNVPQRVATASPHPFSPGAQQFGGGSQASPIPSEHGTPQPNAYMQNMPQGYNPGFAPSPSNPRPSPNPNAMTADMMMAQQMGQQVGPHMGQQMGRQMGQMPQHMGQMTPQMYQQMQQQMQQQQQQHHHQQQQQQQHAQHGQQPQQGQVPPQHRPQNMSDQQKMAAYQMRLQQQLQGNMQMQAQMQAQNMGRGMMPKQQMQGVANGQVPQGAMRQQPRPMANINPEQFMKNLTTLMNAKGLPLDPNPIVGDRPVNLVMLFQVVQSKGGFKNVTAANGWVHIAHALGLPAQIPTVAPTLKQVYERNLSKFEEVWMAQQKQRMMQQNVGMANQGTPQKQMQPGQQMSQGQMPPGQQPPQPQQQTPVKAGQPPVNGFSTPQAQQQPPPPTVPGHNRNSLSHASVPNDFSMQSPAHQRPGSMSMTPGDPRHPAPMTATATDPTMPRLPPKSDEYSPCARELSTYGGVDLHAASSLGAELERWEPSVPSVNDLGNIDIHALTRSLQSGIHGEVRLALDTLATVSASPGQMHFMQLRYCEDLVDALVDCAEEQLDLLAEHTVEVCDEIQLTPYEEVVRACRVERWAVRDVPVFGSTEYQLDRAVDRLICITTILRNVSFPGEQNDNHNFLADESVIKMLCVVIRYLGTRTMLLRTHSNTLDFMKDVVVLLSNVAGSIEIPGREQALCLLQFLLSFAPTPGPTTTNKALHFPTYEPSLHSYAPHSVDALAKLLARDEPNRGYYKQLFSTDANNAGAYELLTRTFALAISPLPDKTKEQNRNPALPSLIETRKPFLMQGLLSAEILASLAPGPEAGVARSWLTSENQLAQNIYRLVQDLGMLYEKPPPPPPPAARGANRAPPPRKDPELVYIVVVAVALLRRLVEKARDPQNRSSSVPSDLLPQSQLLMNALTMQAPEWTKEGMLPQLTAIYNM

SEQ ID NO: 1465 - protein, 722 aa, Unknown
  Kingdom: Fungi, Phylum: Ascomycota
MGPRGRGAGARGRGSGRGGRGGRGRGRGRGRGRGAFGPAARRFDGARLAEEDSESESGDEMDEGTGSEALSDGGDESESEQPAAAKPYMTLLQSFQQESEPKAKRRKTHHDEPQTKAPAKDHDDSASPQSDEEKDIDHVDEPEETAQDADIEEQVDSDDEEDETDPFESHFAHPDDKAVAMHVAAVRKADWITKKALVPSGRATAMLPSSASKAELPAPITTLEGLHLKQKLKESAKDKLPFNEFQQNLSPLLFNYSDLLYCDRTVKNSTQVRQLTCLHAVNHVLKTRDRIIKDNYRLAKEGDDTDLELRDQGFTRPKVLFLLPTRHACLRMVNTIRDLTQPDQEENRKRFDESYHDKEQNFSADRPVDFRHLFEGNDDDMFRIGVKFTRKTIKYFAQFYNSDILFASPLGLRMAIGSVEEKDKKKNMDYDFLSSIEMVVMDQADALLMQNWEHVEFIFEHLNRQPKDAHDCDFSRVRNWYLEDWAKYFRQTIIMSGFNTPELSELMRLHCHNWAGKVRLQQEYTGSLQQLGVRAKQTFSRFQPGTVDREPDARFDYFNSAIVPSLVKRAKDATGTLIFVPSYLDFVRVRNFFATSSSVESLTFGAISEYTDIREASRARSHFLNGRHKILLYTERAHHFRRYQIRGVRRVIFYGLPDNPIFYREIAGGYLAKSEEDMELEPGQGTVRAMFSKYDVMKLERIVGSKRVGKMLQERGDTFDFV

SEQ ID NO: 1466 - protein, 246 aa, Unknown
  Kingdom: Fungi, Phylum: Ascomycota
MATSKPRKKCLLWDWTNTRDRPSAIDQLFKTTPTAFISCHNWNTWVPPELKDRLTFRPMLRTLSHVSNEEFSWVLDSPFPIVHYLNEPERQAATPEQAAKAWREKIVPELVEDRGKKIISPACASDEQGKDWLAAFFKLCGERKPDFLGLHYYGTTVEDAKAYLRDMHGQYQLPVVVSEIASISRNESEVATFTKDLGCWMDGEDWIVEYGFFGCMAHVADDFVSEKAQLMDKEGNFTDLMLQLME

SEQ ID NO: 1467 - protein, 273 aa, Unknown
  Kingdom: Fungi, Phylum: Ascomycota
MQSVWILSLGFSLVEAICHHGTTLYHRRAEVEEPKFGYTNLDGPLAWHALAAENMQCAQGQKQSPISVTAENSSPAEGKSLQFDIADFPEGGELLNLGTTLEVEANGTMALKNKTYSLAQFHFHTPSEHRMNGEYFPMEIHFVFQAADESLAVVGAMVEVAAMEVPAAFISSVFANLNRAGETGAAVETTPINFTALKEHIAASTIWQYEGSLTTPSCDEGVSWNVVERPLFVSPTTYRQIKSVIKFNSRYTQNAPGEANLVDNACTVLAAAQ

SEQ ID NO: 1468 - protein, 528 aa, Unknown
  Kingdom: Fungi, Phylum: Ascomycota
MDRVLERTPEGTSPRTFALNHLRPKSSFVGCSRIGEYELQGKLGEGTFGEVHRARSRKNGAIVAMKKIIMHHEKDGFPITALREIKLLKLLSHENVIRLEDMAVEHPSRSTDKRKKPIMYMVFPYMEHDLSGLLDNPSVHFDEPQIKCYMLQLLKGLGYLHENHILHRDMKAANLLINNRGVLQIADFGLARHYEGHTPTPGRPMGEGRRDYTGLVVTRWYRPPELLLQLRQYTTAIDVWGVGCVFGEMLKGKPILAGESDSHQLELIWDLMGSPNDEKMPGWKQLPGGQHLTPRARPGNLESKFKGFGQGAVSLMAELLRLDWKTRINALDAMEHPYFKAVPLPAKPHEIPTFEESHELDRRKFHDRKANLPAAPRGGTVGVGPDVNGATAGFNTGEGFSGRNGANGRPRGYDERRPGWRGDRGPRPPQGERPPPYREDGDRGQRGRPAPRAGADGDTYIPSYQAEAPSRRREDRPREDRRDDWRSRGGRDDRRSDRERRTHSRSRSPTRDKPRDRDRDRDRDPYRR

SEQ ID NO: 1469 - protein, 290 aa, Unknown
  Kingdom: Fungi, Phylum: Ascomycota
MSPIQMSAHTPSLQQLAASAGHEAILKAVREDGAVIIKNLFTKDQVRRLNEEVQPAVDKIGVGSHHKEDWVKEFHGDKTKRLNNVVSLSNTFRHEILECDLIHQLCEAIYLEDAGGYWMNSAQVIDIGPGSKAQPLHRDQWQFPIFTRCGPDAPEASVNFVVALTPFRDENGATRVIPGSHRWDDFEQNGTQQDTIPAEMDVGDACFITGKVVHGGGANTTSDSTRRAITLVFQCSYLTPEEAYAFNVEKEVARTLSPRGQRMIGFRSQFLKNSPGVWKRDYGQYDEVYC

SEQ ID NO: 1470 - protein, 1111 aa, Unknown
  Kingdom: Fungi, Phylum: Ascomycota
MASEKKGGDPLANHVSGQSNEPMSAPAHALSAEKVVEDLHANSESGLTADEAKRRLEKFGKNEFGDSEGVSPVKIFVGQLANALTLVLILAMAASFGIKSWIEGGVVAAIIALNISIGFIQEYKAAKTMDSLRSLSSPTAQAVRNGNNQTVPTVEIVPGDLVELKTGDTIPADIRLIEVVNFETNEALLTGESLPVRKEINSTFPEDTGPGDRLNVAYSSSTVTKGRAKGIVFATGLYTEIGQIAVALRGKKSRRREPKKRREDGSASLPRWVQAWILTGSDAVGRFLGVNVGTPLQRKLAKLALLLLGTALICVIIVMASNDWSGTQEVVIYAVATGLSMIPASLIVVLTITMAAGTKQMVKRHVIVRNLKSLEALGGVTNICSDKTGTLTQGNMIVKKAWIPGRGTYSVDVGNEPFNPTVGDVGLNKSQPKDIDFSSSDAGGDAVAPKELVGQDETLKQYLNVASLANLATVQQIEGEWRGRGDPTEIAIQVYASRFDYNRLRLSTGNDAQWHQIAEFPFDSDVKKMSVIFVDRHANKQWLFTKGAVERVLTSCPQYMNGDELAELTEPIKNDILANMEAMASLGLRVLALASRTDIREVEENEADLERSEFEENLIFRGLIGLYDPPRPESAPSVRKCHEAGISVHMLTGDHPATAKAIALEVGILPSRMSDIATDVAKSMCMAASDFDKLTDDEIDNLPVLPLVIARCAPQTKVRMIEALHRRKCFVAMTGDGVNDSPSLKRADVGIAMGMAGSDVAKEASDIVLTDDNFASILNAVEEGRRMFDNIQKFILHVLAENIGLACTLLIGLMFKDQQNISVFPLSPVEIMWIIMITCGFPDMGLGFEVAAPDIMARPPVSLKTGVFTLELMLDMLVYGLWMAALCLASFVLVIYAWGEGESEFGFDCNNRYSEGCETVFRARAATFACLTWFALFLAWEMVNMRRSFFRMQPKSKLYFTQWCHDVWRNPFLFWSIVAGIFSMFPIIYIPGLNREVFKHDAITWEWGIVLVEAVLFFLGVEAWKWAKRIYFRRADRKKVSDKSDLEERTFGHYFKSNMSRSGDEESGLGNGSDDGYEKKKATQTPEAATNDTLATVNGAVSAGKKEKAEV

SEQ ID NO: 1471 - protein, 445 aa, Unknown
  Kingdom: Fungi, Phylum: Ascomycota
MDSSKPATTAGEAVASIEPRRNPKRKTSEANTSALNLPTDLLTAVYEPLADGEREDWEGWVELESDPASFSYILNELGVKGVEVQELFSIDQDSLNLLPKPVHGLIFLFQYQPEHVIDDESTQGDDVWFANQTSHNACATVALLNIAMNTEGVQLGEKLRDFKAETMSLSAPLRGDRITVNSFIRSKHNSFASRIDLLDADLGLESDFLAAERMSKRRASPKKGKGKSGLRRGEEYAFHFIAYVAAKGSVWELDGLRPQPTRLGPITTEDWTTVATPQIEARIMQYAESQLAFNLLALCQTPQAAQRRRIVESVASLRYIRSHMSSVQEFERLISGEEQPLDVTNPSQLAEYDLQPRDVDESAALPSVVEKLRAQSLEVNDAYELYHNLTQRARQAMASYDAERSNEGQGPECLQTMKAPWSPAIHRLLTALAEKDALLGLLRNS

SEQ ID NO: 1472 - protein, 528 aa, Unknown
  Kingdom: Fungi, Phylum: Ascomycota
MADNVRKGSRVDNVIARDAAQLAALGHDQQLERNFSFFAMLGLAFSVLNSWPALAASLSIGLPSGGPATIIWGLITAGLGSLTLAASNAEFLSSYPTSAGQYHWAAIITPKRWVPIVSWITGWINVSGWVALSASAGVLGGQLLLGIITMYDPGFAPKQWHFFLVFLLYSFLGFFLNLFTGTGLPVVTKSALVWSLCGFVATTITVLVCGAPEFRPASFVFGTLINTTGWPDGVAWLLGLLQGGISLTGFDAVAHMIEEIPNPCVRGPRIMVLCVFVGVATGLIFQICLLFIIRDVDAVVSSKTGPLIEIYLQATDSKAGTVCLVLFPIVCIVFACVGIMATSTRMVYAFARDRGLPFSHVFAKVHPRLGIPVNALLLTNAVVVIFGLIYLGSSSALNAILSASVVALSVSYAVAPAINCLQGRKKLLASRPFKLPEWLGWTCNLFGIVYTVVTTIFLLFPPVKDVTADTMNYAVVAFAVLIIISGIQWFVDGRHNFTGPTFDEAAFISVEGIIDEETSQMATPANKQ

SEQ ID NO: 1473 - protein, 672 aa, Unknown
  Kingdom: Fungi, Phylum: Ascomycota
MAIPSESRVDVLIIGAGPAGLMMATALAKCGVHARIVDKRGTKIFNGQADGLQCRTLEIFDSLGFGHRAWDESNHMLEICLWNPDDKGVIRRSDRIPDTIPGISRFQEVVLHQGRIERFFLDTLEDCSDVRVERGVMPSSLEVDESLVEDADAYPVKVHLRHLTEEEATPKQTATSANGTSVQDGLFRSNLAKDDTEELLRKARLNEKANTEEIVHAKYLLGADGAHSWTRKQIGVHLQGDSTDYIWGVLDIVPITDFPDIRMRCAIHSASCGSTMVIPRENKLVRLYIQLTTTEKLSEEGGRADRSKINPQVILEAAQRIFAPYKIDYRKLDWWTAYQIGQRVGTCFSKSERVFLAGDAVHTHSPKAGQGMNVSMQDTFNLAWKVASVVKGHADRSILKTYEAERKKIAQDLIAFDRKFSRLFSGRPAKDVMDAEGISMEEFKDAFQKGNLFASGIAVDYEDSLIVAKPKGERAVDSSDETGSKRRVVSDQSLAPGIPVGQRMPSVKVLNQSDARPWHFQERLPSTGRWRVVVLPGDITQPAQAAQLAEVGQAFDRESSFLHRFTPVGKPKDEVFEVLAVHHAPRHSVTIFDFPEVFRNFSDTDGWDYNKIFADDQSYHEGHGKFYETFGVSPQGCIVILRPDQHVSYVGPLGDPEAVTDFFSGFMKAQVA

SEQ ID NO: 1474 - protein, 331 aa, Unknown
  Kingdom: Fungi, Phylum: Ascomycota
MPSDLSSYLASRYLVADPKPSKKRKRKQATADQGLLINDDADSEWGTNTAQNDDNNEDGPLMVSGTTSEFRKAKKNNWKSLGSGKNASATTADDSASADAILASAAAETRAAGGSADDDTPVIEDDPSVVKMSDGTHAGLQSAASVAAQLARREREERADFERHRKSAKEEETVYRDATGRRIDISMKRAEARKAAAEAEEKERLRKEELKGDVQMEEARKRREALEDAKLMGVARGVDDLEMNKELKEKERWNDPMMQFLSEKKNAGGKTRAKKGKPTYAGAAPPNRYGIKPGYRWDGVDRGNGFEAERFRALNRREMNKDLNYSWQMDE

SEQ ID NO: 1475 - protein, 593 aa, Unknown
  Kingdom: Fungi, Phylum: Ascomycota
MRRDRLRRDIVLAAVVIITLWFYVSSPTSRPTTEMGRLERFMNKGAALSATYGHKSSFDWSKVPSRLNSVPQDPVPQPKPGGLPRVQYHFPAQELRSVAKPRIARLGVVREVFRKNWASYRKYAWKQDALLPISGGAKDQFSGWAATLVDSLDTLWIMGLRTEFDEAVEAVSELDFGQASAPKVNIFETNIRYLGGLLSAYDLSKREVLLTKAIELGNLIYAGFNTASGMPVDFIDFAAAKAGEQLSIEDIVVAASPGTLSLEMTRLSQLTGDPKYYNAMNRVMQLFYRDQNKTELPGIWPMYVSMKKQDLVTGSKFTLGGYEDSLLEYLPKMYQLLGGGDEKYEIMTKAFLRTADEHFLYRPMLPDRNDILMPGNVNIEGGKPVLDPETEHLSCYIGGTFGLSGKLFSRRSDVTLGEKLAHGCAFAYKSFPTGLMPERLNMVPCPDRQLCAWAEEEWQEESAKRPEYKKHLPKGFTTAKDPRYILRPEAIESIFYMYRITGRREYQETAWEMFTSIIKGTETEIANAAVQDVTIAEYPLPKEDYMESFWLAETLKYFFLIFSPADVISLDDWVFNTEAHPFRIPKGKQIHII

SEQ ID NO: 1476 - protein, 412 aa, Unknown
  Kingdom: Fungi, Phylum: Ascomycota
MLYRHSLLVLKHIPKHPQFREPENKKAFRLLSKRVDSVLKDLEALKPEIESVYAEWERTKPATQQAPEASPPGSYDHHAARDPSLGGYTQVLDASEHQDLAVDLAQQELRRRDTARRATKQAGLSDQETSARRRAGLWDSVGPGNPGLRDELDLQRQLEATRRNLDRPSQSSTFIDRGQNTVPTTSNYHYPSIARQRHEDDADWYSRNAESPVKQGPPIPSKSSLGPADGYGAPAPPPKYSMPLVPPPIPSKLLSGANGDERASPAAEAPVLPRKERLTFRPGAYLENGEPIRSVFLPAQLRHQFLKLAEENTRAGLEMCGILCGMPINNALFVRCLLIPDQKCTSDTCETQNESAMFDYCDKEDLLMIGWIHTHPTQTCFMSSRDLHTHAGYQIMMPESIAIVCAPKFTPS

SEQ ID NO: 1477 - protein, 723 aa, Unknown
  Kingdom: Fungi, Phylum: Ascomycota
MPLDSPKPDDDASSRASSKGAERAVSEASAKSDDGTPMKRGRRSRPKVKTGCANCNCTQCVKSNKICTGYPPPPRSARPEYEVRIAPKPAVTSQTPAPTASLSSAAAVTPSPVIPIIISEPPQAAFLRRRSRREVMLPPRRAGHRDVLSATTPSPAPETSSSAYPLPSGAPSFGTDSFYFQVFQEQTANELSGFFDSAFYTERVLEACRSEPAIRHAAVALGALYQNLVQSRTSATSPSSSAQEQEEQARHWHVAVRQYSEACNAMMAMQDSSQNSLRTQLMASVLLASFDSFIGDHRQAIVQIQNGLDMLERIRTAERLPAYGVATDTAEEELTVIFMRLAIQAKSYDLGFHFPEPYVVRFTLPAQHQARLHQLTQQQRHPEPDPSLYVSRLSPGGGHESTPASPVRSPSPFQPFSSVHEARIAHDRLNERHVRLQEALSIRPRDMPRVPIPEPWVRALNSFKGQLAAWSEAFQPLLLSRHESHVGRRERAGIIVLWISHLTSAVISAIQFSSSEMIFDDYSSVFQSINDMALELLQEEEAAGAGACHAESPFCHHQRQLPAGYINAGIFSPCHMKPTFSMDMGIVAPLFMVATKCRVPLLRRQAIELLRGCSRREGMWDSELTARIAYWVMTVEEPSPHVHGSYTDPSSYHSRPPEGPAGYQDRGLLLSSQPYVAVPSERRVMIKTVDFDLRARWANVAVGTRNLPDSMPDPRYRSTQITW

SEQ ID NO: 1478 - protein, 549 aa, Unknown
  Kingdom: Fungi, Phylum: Ascomycota
MFGKNKNKSVSPEASEAQHDTEFESNTYGASADLVDPDSGVKRGLKNRHLSMMALAGIIGPGLLIGAGGALANGGPASLLIGFGVIGIIAFCIMQSLGELTTIYPGGGSFISLAERIVDKSFSVAVGWNYFIIWATVLANEYNVMSSILTYWAPAVPLWGFFLILWSVFLAFQMLGVEAFGEAEFWLALAKLLGLTAYFIFSIIYAAGGLVGQDGALGFRYWHDPGPFNNNGFRGVATVFVFCSTFYAGVEAIAIAAGETRNPGVAVPQAIRQVFWRIIFIYMGSALFFGITCPANSDELVSGGAKALQSPMTIAIQNAGWEGGVHLINAFIFITCLSAINSSIYIGSRTILYMAQSGKAPKILGWVSNSRRVPIPAIVLTNAVGAISMMNVSTGAARAYGYIVNLSGVSTFLVWGSISFIHIRFRRSWHQRGRSSEELPYKSMGYPFIAWFGLSACIFLALVQGWTTLSPFNAGNFVDAYILLPLFGIIYVISKLIWWKTDRFKRSFDIDLDSGRRVDLDQKGFHVDEDGNMVRREKLPFWKRVWESF

SEQ ID NO: 1479 - protein, 683 aa, Unknown
  Kingdom: Fungi, Phylum: Ascomycota
MLPKPSKIGKKSRVSRTAISCDRCKARKTKCNKPDANGPCDYCRSIDEVCSIDIAKRRQKPFYFVSEEEYRLLRELCSRCYPDVELTLETLRQLVSNEPVVSTVQGDAFIKNGIAASSHGSENIETITKSPVTLPPEEEGFALPEIVSLHNDLGCLLPDAHGEYRYIGAESGVSFNGAVKSWILRMGARTKSAAQDRDKIPPLVKVSPPSTKSPFTSSSSPGRQADSLPPQDLLTSCAARFFEQVHCIYWLYSSEDFYTRLETTYSSGDTRSHSASWLCSLQGLIALCACGEESCDAGTSGPESLESAKALVSRVCEEAGLDSIRALIILTLALQSNGLSTLAYVHLGLAVRIAFSLGLHLDKYSSQGSVDLSLQLGKPSMAIPIAADTWQPPLPSECVVTPGSHTPHGYLEQAIKLAHLAQGIRQRLYSGPIHYGQRLTQRCFSDATESLNEWLKGMPPHLHLSTSMSPLHRRSISILYLRYWSTVMLVTKPFLLCNLLRGDEIEAQKQPIFAEFARTCLSAAEASFDILESMVSHNVMSSLLVTDFFFSLQTLQVTLAACGLYQGEVYRDRAKRCLRILLATSVSGYAKYLLPETLFQLQQCGIVEGAEEDSLPIQPIETYPSMQRDTQRLNRDSRDHLSTSWLGDSSMADVIIDEEFWENVMDFSEIFPPENYPQTEPIM

SEQ ID NO: 1480 - protein, 165 aa, Unknown
  Kingdom: Fungi, Phylum: Ascomycota
MSDNAVSELAPKFAPFVGMAGIAAAMIFGCIGAAYGTAKSGIGIAGVGTFRPDLIMKCLIPVVMSGIIGVYSLVISVLIAEDLNPPSNTSYTLFAGFLHLGCGIAVGMTGLAAGYCIGIVGDSGVRAYMEQSRIFVGMVLILIFGEVLGLYGLIVALLLNTKTKG

SEQ ID NO: 1481 - protein, 310 aa, Unknown
  Kingdom: Fungi, Phylum: Ascomycota
  misc_feature (186)..(189): Xaa can be any naturally occurring amino acid
MFGTKSTQSLKNLFAGYHEPAALSKQHSQKLLDGLKTSFRSQLDREHGHITNGASAASKAAAGSETIRRPSPAQQHLKTILTNPLFSYDKDTPNILSQPSLAVKRDPMDVFEQAASKGMLTIQAATGCLIARNQLVQQASPNATSDAKETASRVLRWLHSSDHMKDMQFMSNYRFTRAFMPCLVEXXXXASTCNLISALATTDRLPGKFPVEQAHLHLLHPKHPDNAPALHLFQDKPGLKSLLTSFAAAKETKSTKTVPVWRSIGSWVSSLGQDTVDSLTRSGRDDEAKEITRFLELDVPELLGHTPQPT

SEQ ID NO: 1482 - protein, 553 aa, Unknown
  Kingdom: Fungi, Phylum: Ascomycota
MNNYGPLHPSRIDKGIAASVAATRQKSCNACVRGKRRCDKKAPKCTRCSSKSLECVYARVPPGATADSVLLDDDYFSSNLTSRSAKRPGDASAAPSVDSQPSVSDVPDFGAMGGFVDMPSLAGSSAGNTSPESSLDYAMDSSDVSGAGMGPAGGANTAAAEFLHDMSGFSIADLLAASNPPFGGDLWDISNFPMDGDASLPANNITANIHSGIDTATLAGKINPRPLEVVPARAIRDLSMLKEQCVVAFDPLEVHDARSRPGHILKVFTDLPITFSQTRALPFLHSRLYSSHLPKPVMTAFCAASAYANRTAETKGWTVKLIGEAAKEVYNEGEKAATPLEKLARVHALLIMNTMRMLDGDIWLRSAAEKEFPVMIDWVRDLIAVRDKLEEGTPRSQWADKAYPPSSWESWLVLENIRRTILASISFLCLVSILKGDTRKKPPPSPPPLSCISSSCLKEWHSDRKPTIAECDLWDQPIHFTASRHLWASQTSFEFFRAWRDKPRFLIEQMQFREFWQYASPDDLDEFTRIMLTTQTGTEAMDHFMLGDTSVTV

SEQ ID NO: 1483 - protein, 475 aa, Unknown
  Kingdom: Fungi, Phylum: Ascomycota
MAIETIPGEKFQSSEKTDMVASSDSVKGGGVSSVEVDLENRGVFRSGDDVLEFRRVSWQRAVIVFCKINFAMSILAIPQAISTVGAVGGSIILVGFTMLNCYTALILGDYRNRHPECHMLADMMGVIWGKIGRELVGIQTIILQILITAGGVATVAVGLNALSDHSQCTAVFGLVSAILITACSSIRSFAKLGWVTWFGMITFTLGVLVFTIAVTQQDRPAAAPPTGPFELGWKAIAYPGFVVGMVSSTNLFICTSGSSMFLPVIAEMRRPQDYRKACLWAGVIVGALYLVLSLVIYRYCGEWLSVPAFGSAGPLFKKISYGISLPGLIIGLGIYQHVAAKYAFVRLLRDSDHLQKNTFVHWGTWLGVNFALGTAAFIVAEAVPILNYLLGLAAALCAAPFSLIFPCLLWMSDFKGYRSGTMGQKLQYAFHVLIVLIGSFMVVGSAYAVAVAIKMAFQTGMIARVFDCADNSGAH

SEQ ID NO: 1484 - protein, 372 aa, Unknown
  Kingdom: Fungi, Phylum: Ascomycota
MNWPLASVFESLHPVDLINQTAASMKVLAGLAAFWPLVAGAALNITYYQNVPLAPTPLPPSHADSDGETIIRLFQNLGRSTVWKSIANITIEGDTFEPEGMVRLGDDRLVVSCGEYTEPTKKYGSIINGTDRTPGQGFGHLIVFNGKGQRLADATITKRGDIEYHNGGIDFDGKAIWGTIAQYRPNTTAYAYKADPKTLKPTTVVHYNDHLGGIVHDTKEETISCLNWGSRNASTWALRDVKPGCNSPSSSTKPKRVVRNPSYFVDYQDCKWLGHSKFYNGKSVMLCSGVATIGSYNLGGVALVDVATMEPLAEVPIALESALGVRLTQNPVDVSVRDGKLRFYWMPDQRNSTLYVYEAQPDSPFQYGGDPR

SEQ ID NO: 1485 - protein, 847 aa, Unknown
  Kingdom: Fungi, Phylum: Ascomycota
MNGFAAAGQYGQPPSVWQEHHTPDGRTYYYNSATKVTQWTKPEEMMGPAERALANQPWKEYTAEGGRKYWYNTETKQSSWEMPDVYKAALGAAAPQEAAAPNAFPAPNQGYDHPRDHRDYRDQRDQRDYNDRRDYRDRGRDRDDDRGYRDSYPESRQITYPSDPRAQTFVPASNDPEYATPEEAEAAFMKLLKRSGVQPDWTWEQTIRATARDPQFRAIKDPKDRRAAFQKYCQDMVVQDKERHKERLAKLRADFETMLKRHPEITHYTRWKTARPMIEGETIFRSTDNETERRQLFEEYIIGLKKAHAEQQTTMRKGAMDGLIDILQKLDLEPYTRWSEAQDIISSTPPFQNDAKYQTLSQFDILVAFQNHMKALERAFNDSKQEEKNRKLRKERKARDAFKSLLSSLRKEGKINAGTKWDQIMPLIQNDERYLDMAGNGGSTAQELFWDVIEEEERGLRVPRNDVLDVLEDKRYDLTPTSDLEEFLSLMKEDRRTANIDRNILELIFERLREKRLSKRDDEKQPDRHQRRAIDDLRASLKRLDPPITLNDTYDKVRPRLIKSEEFQAVSTEDFRRMAFDKYLRRLREKEEEAERGSHSRRRDPRSVEPDSHHHRRDRDRSRGERSHRGNDRRGSRRSRSPEPDPYEADRRRAMAERERNHRKTTMAENLLSTDRVGRAPSSPPRRERDHRDRERDREPRDRDRDRPRSRDRDRDRERERDRERDRDYDRPPRDPRARRDDDSHYDRERRDREEERERLYRRRIDSGSYDGLPYGDDRPSGSRRRRPEEEDDYSRRDSRDSKRLKRERTPERTPQREAAKPALKSPVPPPKDIKSGSEEGEIEEDE

SEQ ID NO: 1486 - protein, 413 aa, Unknown
  Kingdom: Fungi, Phylum: Ascomycota
MAVPCEPLDKERHIKYWKRCHKSLLPTAYTSSDSTRLLFACFTICALDLLGAPLDASERSAIRTWVLSLQHPEGGFCGSPLHAYDKRDSRKGSANLAATFFALILLAAAADGEQEASAAFSGVNRVRLLQWLRSLQRADGSFGQNLWDGRPVGGSDMRHSYLASCIRWMLRGPIDQADHGDVNLERMVAHVLRGQTYDGGMAESSLNESHGGYAYCGIAALAMLDRGSDMSALQNDAVRKDLMLKFLSHRQFPYLAQEEEDEDAEEAENMVEMDLDALSLNEPCQHVGYNGRWNKKADTCYCWWTGGALKLLGQVSMMTMDPSRAYLLEITQHRIGGFSKNAGGPPDIYHSYLGLASLAIMGQDGLKSFDEGLCCSQELTKKIIAARRGPNESDSKSGWAEDGFWEAINCSSA

SEQ ID NO: 1487 - protein, 476 aa, Unknown
  Kingdom: Fungi, Phylum: Ascomycota
MSSSASTPKAAQAAAFPDGTTDYVPLRSNQGFDAKKVHIADQPITWGNWHQHVNWLNTFFIIIVPLIGFVSCYWVKLHPYTAIFAVVYYFWTGLGITAGYHRLWSHTSYKATLPLKIFLAAGGSGAVEGSIRWWSHGHRAHHRYTDTEKDPYSVRKGLLYSHMGWMVMKQNPKRKGRTDITDLNEDPVVVWQHRNFIKCVIFMAVIFPTLVCGLGWGDWWGGYVYAGILRVCFVQQATFCVNSLAHWLGDQPFDDRNSPRDHVITAFVTLGEGYHNFHHEFPSDYRNAIEWWQYDPTKWAITFWKWIGLAYDLKQFRSNEIEKGRVQQLQKKLDQKRATLDWGTPLEQLPVVDWDDFVEQSKNGKALVAIAGVIHDVGDFIKDHPGGKALISSAIGKDATAIFNGGVYNHSNAAHNLLSTMRVGVLRGGCEVEIWKRAQFENKDMTYVEDSTGQRIIRAGNQVTKIVQPVASADAA

SEQ ID NO: 1488 - protein, 277 aa, Unknown
  Kingdom: Fungi, Phylum: Ascomycota
MAHIDTSLPPEPTGAAARLAALHSTDSALKLYGGWFCPFVQRTWITLEELGVQDYQYVEINPYRKEPEFLALNPRGLVPTLAVPGSKSGEEQRPLYESLVVCEYLDEEYGDAAKTGRLLPSGAYERARARLWINHIATRIVPAWYKLMQHTPDKKFSLDDARAELQKHLKAFAAEMADGGPWFYGEKFGMVDIALAPWAKRLWLIDHYKEGGTGIPKSGEDEVWGRWRKWMEAIEDRKSVKETCSSDERYILAYKRYAEDKTNSEVGQATREGGALP

SEQ ID NO: 1489 - protein, 580 aa, Unknown
  Kingdom: Fungi, Phylum: Ascomycota
  misc_feature (19)..(25): Xaa can be any naturally occurring amino acid
MPFLTSSSPLATTTTNTSXXXXXXXNSLRDSEHRLSTMSDPEKTRTTSTEHNEGPPQLEKGAVPAEAISATLEVTGGAPNPWGKGHLKLYGACLVIYLCSTMNGKSPLQQAPMPYRTRLIVTGYDGSLMGSINALPEYQEYYNLGKGGTSTTGLVFSIFQIGQMIGALFTWICDWRGRKITMIVACFGILASAIFTALAPTLASFIGARFLLSFFSTIATVAAPLLLVEIAPPLHRGAVAGAYNTLYYMGSIIATFAMYGANLHLSGNLKWRLPLWLQMLCPGLVCILGWIVPESPRWLIAKGRYDEARNFIITHHANGDAHHPIVAIEMNEIEASLRDGQLRSAKSYFDLRTLVKSRSRLYRLMLAMTMAWFGQFSGNNVSSYYLPVMVENVGITSVNTVLLLNAIYAVTGWIAATAGARLHDIFGRRKMLMSSCAAMSVSLAVVAATAAKYEQTASKTASSASIAFIYIFGVVFAIAFTPMQPIYPAEVLANDMRANGMMMFQITAGCASFVNTFAAPIAMKNIKYWFYVFFVFWDIFELAFIYFFYVETKGRTLEELDQVFEEKNPRKASTRKVTVE

SEQ ID NO: 1490 - protein, 343 aa, Unknown
  Kingdom: Fungi, Phylum: Ascomycota
MPDNGFTFLPLGAIIQTFTVNGVNIVQGFDTPEQYKSHNAPFFGETIGRVANRLSNSRLDSFNGKTYPLAANDGTNTLHGGNVGWGKKEWKGPTPVGLREIPGVEGLKGGESVEFTLTSEDGDEGFPGTVEARIVYTTGTVATPDGKEAVILGMDYSAKLVSGADETPINMTNHSYFNPAGVDADTYADTEITLSTANHLPVDDRAIPLGNVAPFPNIQANTPFTLHAAEPFIDHCFTVTSTPSSVPIDTRSLPLDKHVQAYSPHTKIHLEVLSTEPAYQFYTGDGIDVPEVGGLKARGKRSGFCCEPSRWVNAANVEEWKSQMTLKKGEEYGCRIVYKAWAD

SEQ ID NO: 1491 - protein, 421 aa, Unknown
  Kingdom: Fungi, Phylum: Ascomycota
MKAFVAFALGLQAVTAKVSYEGYKVFHIETTDYEATESALSSLEYVSLNCESDHKTLEVAVAPESLEAFEKLGLNAELTVGDLGAEIAVEGELKPYEAKVKRRDTCTGLPDFSYFDSYHVFEEHLDFLDDLQTAFIRNSETFVAGESLQGRPIKGIHLWGKDGPGVKPAIIWHGTVHAREWIVAPTVEYMAYQLIKGYRKKDAAITNIIDQYDFYIMPVVNPDGFVWTTTENRLWRKNRQSRPGATCLGTDVNRNWPHQWDVPGGSSTNPCSETYRGEAPGDTPEMQVLTNHTLSIAESVGIKFYVDWHAYSQLILLPYGYSCSAVVKDLDTQMELASGVAQAIQSVNGLNFVYGPTCQTIYQTSGGSMDYVYDVAGAELSWAFELRPASSGQGGFVIPPDQIIPSGEENWEGMKHLFANF

SEQ ID NO: 1492 - protein, 347 aa, Unknown
  Kingdom: Fungi, Phylum: Ascomycota
  misc_feature (132)..(134): Xaa can be any naturally occurring amino acid
MLEPVLASLKLNQPASVTLASKKRGIVTFEEIRFPGRSLLEARKFARVILILQLAHDSVVSGTVLTKRNVFYQNQDLFTDQTSVDSLVDAVALTLAAAREDINIVATSKGVVSGRALIRLVQSSLLDLERLXXXVEKDAVFKTLSSTQYWENATAGPGILVTGKGYPDLITRNFLQTINRCAPDLPLLTLTDYDVDGLNIARCYRYNMDPTSRKPATVNLGISWLGIRTSHVVDLASSISPSTSGHVPAPTGSRFFRGDSISKDPIASTECRDPINGLTTRDRKVAVTVVATLSDHAATDQAAADLKSEAQRMLMLGVKCEIQWLDESGNLHSWLDRELLRVCRVEM

SEQ ID NO: 1493 - protein, 408 aa, Unknown
  Kingdom: Fungi, Phylum: Ascomycota
MASVVKPYNISVPDSALEILRKKLSLANFPNSVDFSDDWDYGAPLSDVRRLAERWRDGYDWRAHEKQLNEELPQFTTRVPVEGFGELNIHFVHKRGTTEDSIPLLFVHGWPGSFMEVIKILPLLTNPDGDALSFHVVAPSLPNYGFSDEVTKKSFAIRHYSEALHRVMLSLGYDKYVTQGGDWGFAITRMIGYQFPQHCLASHLNFIRVPNPPSITQHPVAALQHALTRYSEADRAGLARTQWFVKEGCGYNQEQSTKPATIGFALADSPVALLAWIYEKLHDWTDNYPWTDDEVLTWVSVYQFSTAGPAANVRIYYENHHGGGDLRFKESGYIPSVPIGLSCFPRDLIIPPKGWGRQLGPVVFERYHSDGGHFAAHERPQQLANDLREMFGPGGGAYRQAQRTRGKA

SEQ ID NO: 1494 - protein, 489 aa, Unknown
  Kingdom: Fungi, Phylum: Ascomycota
MSAKAIHEADGKAVINYHLTRAPVIKPSPLPKPTKHNPPSRLASLHFNDDDDVNAVLDQAEVSFPWLLQAGSKFVAKPDQLIKRRGKAGLLALNKTWPEARAWVAERALKEQKVENTTGVLRHFLVEPFVPHPQDTEYYININSVRDGDWILFTHEGGVDVGDVDEKAEKLLIPVDLAEYPSNEEIAASLLKHVPKGVHNVLVDFITRLYAVYVDCQFTYLEINPLVVIPNEDKTSAEVHFLDLAAKLDQTADFECGNKWAIARSPAALGMTAVASSNGEKVNIDAGPPMDFPAPFGRELTKEEAYIADLDAKTGASLKLTVLNPNGRIWTLVAGGGASVVYADAIASAGFADELANYGEYSGAPTESQTYHYARTVLDLMLRAPTSDKGKVLFIGGGIANFTNVASTFKGVIRALRDFATQLNEHKVQIWVRRAGPNYQEGLKNMKAATQELGLNAKIFGPEMHVSGIVPLALVPGKWEEANIEEFKA

SEQ ID NO: 1495 - protein, 682 aa, Unknown
  Kingdom: Fungi, Phylum: Ascomycota
MKSGLYLSGAVAALAGTAVADDMLVSQRLSKRFVDDDGHYNMTFFHVNDVHAHLDEFASSGTNCTDPSRGCYGGYSRIKSTMDKLREERPDNLWLNAGDEFQGTLFYTYYGPEKIAETVNALKFDAMTLGNHEFDGGDEELGAFLQNLTFPVVSTNIKSDYEPLNKTIKPYVIFEDHEVAVIGATTEDTPGIANVGNQTRFIEAIPEIQKNIYEIRNETNITRIVVLSHLGYEVDQELAEKTEGISLIIGGHSHTKLGDMNDAEGKYPTIAKDLSGQEVFIVTAWRWGEFLGSIDLTFGDDGRALAYYGAPIHLTNTTEQDKDLQAKIDEWAEPFEEFAGEKVGFTENELDQTTCQDGDCLLGQVMADAMLEYRANLTNNDGEKPDFALINAGGVRATIEKGDISRGAVLTSFPFGNAIVELQMKGEDVRKVLEGCVSMENQFNDKEITSWFQVSDGIYIQYNEDNDKGERLVNVTIGGEDLDDDEDYRIVTLDFLAGGGDNIFESTTDFATLDTQDEVLMQYLEAHNPLASDLEERVVKTDKQASDSEEEEDNNDDGSQGSGSNSGGNGNGNGGSNEDAAGMLAVPTWGSLFAMGAVFFALQVFIAIVGLYHEAAGSDDLRARLNLGRRDTFKESTSPSPRSEPSRSAGTDAARGLDLTPSVSLWEMARSSCGRVECDPAA

SEQ ID NO: 1496 - protein, 718 aa, Unknown
  Kingdom: Fungi, Phylum: Ascomycota
MRPAIVLDNIENQDTVHQRCLLITGRCQNVAVDEGHVEVAVSDQRGRLRFPEQRWPMCQGHFKALTILQPGNNVIRVTASHDSSYTTEISVTYIPLLQRPPLHLAILIAKDSPLSIDCPPSKFGGLSSAHSSLNAAIAKFRVTAYMWQALTAEEMRSNGLGRRSFRLEEEWGRDTLSATFANDEAMQATAKVHLIRSELTVAELRDHQRAQQNPRANDRQKDELHGIFSKALLAHGAPFTKAGRPVVAGMILDSHYDMDAKLIVAHAALGAHDPNGLSLGIFGSHLTYSWPRFMEEIPDCLLDTEIPGDRVGNDNGECESMWEACSVGQGAFLHEVGHAFSAPHSSGIMMRGYSGDWPRCFLSKTAYCRRTQTEGISPVTAETQHDCHWDIRDLLRFRTLPNFRQPDDKDLHTDPPSVELREDEDFLGLTISSTADIGRVSFNQKVEPKPSVSSPLIEVNYTLDELEARFDKEKPLEMEVTAMNGTERVINVWKFFKSKSFIRIPGTNMRLSKASVACYNPEDDDCAWLVPLKRRGRNGSLVSAYKMDIRVGCALDGAVVFYKDGSSAPCGRAVGTAPTYGMGGHQAKKIVIPAGVDVEKVAVNKSGSWDLNGLRIFLSNGKAMGALNKQRGSEIEVLAPEKGHRVVGFYGTSGRGGMCKEFGIVTADKNLQLPASAYDYLESQQDHPNKLERDSDADDLTSEDEDYGYDHESDVDTI

SEQ ID NO: 1497 - protein, 323 aa, Unknown
  Kingdom: Fungi, Phylum: Ascomycota
MGWQDTLTSLYRDERVILTTIGVVSFAIVTTMITTLTIIRDDNEVPPAQPKTQYITQDTENSLQLKTLDKLLEHPNYSIREIAVKILYDRAINDSETTAFLLRGATRPHYDDRLQSLRALEALVHPTGGFDGLSKLDDAKAYSALVRSLEVGLEDAELPDVRDPSWDEYRLRDAAEKTCLQLLSELALKFSAKGIIKAKFVEKWLAKQAWGEDTAERQSNFRMYMERRGNHIVHIVSKIKHYRRGLRALERAGLIDLEYSRPGDQAIVGLDMSPEPLTLRAREHSAEEQRLRRQHREAMVLNDGTRPLGREDIFEREHNVAID

SEQ ID NO: 1498 - protein, 229 aa, Unknown
  Kingdom: Fungi, Phylum: Ascomycota
MSSVWNALTGGSSKTGSQQQQQQQQQSQRTTTFDPSEGQGVESFLQSSAFADPSQLHPLAGLNADTLEYLSLEDSALSDLPGGQSVLPSRGFTDDLCYGTGVTYLSGLSLGGAWGLQEGLRRSAGQAPKLRLNSVLNAVTRRGPFLGNSAGVVAITYNCINSGIGYIRGKHDAANTVAAGALSGMVFKSTRGLRPMLISGGIVASVAGAWAITRRSFFPVPEQQARESM

SEQ ID NO: 1499 - protein, 1481 aa, Unknown
  Kingdom: Fungi, Phylum: Ascomycota
MAGQKKKKKPAANPARGFATTSIASKPRPETVEEPTKPPTKAEAEAQAATTSKEDARGAQAGPVPAETTLSPEEFEKQLEEAQLQIIVDKHAAKVKRDAQRQRSRLETDRRLLRGQADYISCAKWLPQDLMDHVLDLIQAENRFAASNVSSETSSSSKMPPEEEMIARLWTLQETLESVGFPDTRVKAVSQFILDISSTISVSNKDLIWGLEEALEWLARECPSDELPSYEPRVKPVSKDTSNDSPLPSRPVTPKAADGQRRKGNKEGGNGGTKKTSSSSGKLQVTYDSDIEPDNLIPAYVEANCQLLELERLNQGIRGNSISTSADIELSIAKLEAKIAKIRSDVLFDSYTAEQQWQAKRIPLEKELAEAKRLANQNEETQITSEPKKPEKSEENGEINDEAERIAAEILAEADGSDDGLEGLFDSLPQTEIDPTTGQSQTVINGSDGVKTVIRDFGKWTGVSPRRALEEACRSRDGMVRLNYVLVSESSYANRHAVDIVWSKPQEVPLVVETSTIQVVASPNRFTLTMTGVATPDNKQSEAYAATAALFYIFSGNAREEKVNLRLPAAWRDLWTELAEDKKKKLDSQDREVVRKLRDLVRKKQDQELEDGVIIQGAFRGRATAKSSHNPSEAGSQDRAKQGNGSEDIFRKIWTDKASTRKFQTMLQSRMQLPMWSFKQRVLDAVEQNQVVIVCGETGCGKSTQVPAFLLEHALSQGKDCKVYCTEPRRISAISLARRVSEELGENKGDLGTSRSLVGYSIRLESNTSRETRLVYATTGIVMRMLEGSNELQGITHLVLDEVHERSIDSDFLLIVLKRLMVNRKDLKVVLMSATVDAERFSSYLGGAPVLNVPGRTFPVEVRYLEDAVELTGYTVSDTPPDKMVDLDDDAPEPEPEGPKGDLTKTLSQYSAKTRATMMEIDEYRIEPDLIVQLIAHIASDATLQDYSKAILVFLPGIAEIRTLNDYLLGDPRFQRDWLVYPLHSTIATEDQESAFLVPPPGIRKIVLATNIAETGITIPDVTCVIDTGKHREMRYDERRQLSRLIDTFISRANAKQRRGRAGRVQQGLCFHMFSKHRHDNLMNDQQTPEMLRLSLQDLAIRVKICKIGGIEETLNSALDPPSAKNIRRAIDALIDVRALTAGEDLTPLGHQLARLPLDVFLGKLILVGSVFKCLDMALTVAAILSSKSPFSAPFGQRAQADNAKMAFSRSDSDLLTVYNAYLAWKRVCQSNAGMGKEFQFCRKNFLAQQTLANIEDLKGQLLVSVADSGFLSLTEEERRSLSRMRFSSGGRRRHQQFFEVPSRVNLWSDNDIVTSSVIAWSFYPKMLVRDKTGVKGLRNIGNNQSISVHPTSVNRTRFDIKWLSYYHIMQSKSAYYAHETTSTDPFAIALLCGDVRCDMFSGVIVLDGNRGRFSLPDWKTMLVLKVLRTRLRELLTRSFKQPGKLLTAQQEKWFDVWQRIFTQEFGVEKCIGAALAVPRA

SEQ ID NO: 1500 - protein, 903 aa, Unknown
  Kingdom: Fungi, Phylum: Ascomycota
MRTSKDSYYEKREKVLKVCAESQLDDPSTRFAAVTAAWQYVKDGTVIKDVDALDLLEWACQDHLPECDFQETLGALRARAVKAGLKQKAEAIRCFESCLMHWDLINAQQIAAMMDRTYPQERRFMFWNIVVTHMLSIDPQSPPEKKKLYGMLAQKQIERAAQSAQDNANDAATPAARTVQSEEEILLLYEVVEKHGTSDDLSKLLANPLLGPVPQFLKGRKELLMRTLKRHQRNKEWRAIFDLCRQCLTGGDGKTEEPNYLAADWSILQQFIEAASHLESVEPTAVSTVRNLLLKFAKSTSLRPIYRRNILLARLAAVFALSPTEGADAKDDGSMSLRLTEIVAYLKDQVLNSACFDDVKAFMEKLDDSGLQWLVNKLHEQLQSNPEDDRRASAAELLLLKMSCLQRIIEDAMHRYQELSKSAKTQRSGILSDLAILVALCYVDTAEISSKSQKTDSHAVQTLYRAVVILEEQLQESPKDSVILLLLVQLHLRIGSAYRARVLWDDLGVKRTIVDCIAPILYDRLSTISPSLLARSDKLGYELSECVSSHYEVSLKTRMPRRLIDAIEAESYSSVLQIPIYIENLRTGCTRAMSLVEEARTARLLDGPGGRVLDDPRYSEASDNVHLCDTIDFGSYPSWAAYDRQPVYKQLQLGPSLTNSRSHLSLLSEAFHEVLNYKAPPVYKVGTNNDPTFVLEQISQIGNSLSTLIASSEDATTEAETIYYNLLSLLSGLITLSATLDRASAEETLPDLIQSAQVALESLKSLLSIVSGPDMQSSSIKLSNLHGLTIARDSAQATRLACQWIMAQNEREKGRDRSGQSGLPKETVAQFKCLQALSEDVSNFGKTWVSSLQSVVAGSRFQEEVRNALSEGSLKSLDTSKTTGLLIESWRSTLKGWQNVRWD

SEQ ID NO: 1501 - protein, 287 aa, Unknown
  Kingdom: Fungi, Phylum: Ascomycota
MLEKRVAIVTGASTHAIQSGMGTALSIDLVGQGWQVAMADIQPNADLQKTLGDGASYHHCDVADYDSQATCFEEVWNKYGRLDALCANAGIVDQSSIFIFDQRNSEKIPPKPSLLCTDVDFKGVVYGTQLAIHFMRKNKVSGGNIVATGSVAAVVPHESYPEYDGAKAAVVNFVRAVSRVLKIKENIRINVVLPGIVHTNIIPPAMVAAVSPECLTPVETVVKAYDKALNDESLNGEALEASVNEVLLLPRPELANGRFSKRAVTVWDPLFSMLHNGEPSGLPDAIA

SEQ ID NO: 1502 - protein, 162 aa, Unknown
  Kingdom: Fungi, Phylum: Ascomycota
MTTNVLLETSMGSITLELYTNHAPKTCTNFTTLIRRGYYTSTIFHRIIPNFMIQGGDPTGTGRGGTSIYGEKFADEISRELKHTGAGVLSMANSGPNTNGSQFFITLAPTPWLDGKHTIFGRVKSGMGTVKRMGMVKTGDEDRPVEEVKILSAKVLEEGDEI

SEQ ID NO: 1503 - protein, 250 aa, Unknown
  Kingdom: Fungi, Phylum: Ascomycota
MRFSIASIAAVLPAFASAQDAAGAGDYVAQFQNFLGSLGSKIPHTGIHDPVAALEAKLGSLRLHTLTKENWWETLHEGVTPETVKPVEWWVLVSGRNVTCSGRCGQLETAFNETAAKFALSPGSPKMGYLNCDDQPLLCSSWMIGAGYIWAIDMLPTSEDVKIYKHRFNVTKATSEEMISLRVDDKAADERWTEVESYFHPFNGQVAKLGLGMPFAYILWFFNIFPNWLFMLVVSFASRTMMSRRMQPPH

SEQ ID NO: 1504 - protein, 735 aa, Unknown
  Kingdom: Fungi, Phylum: Ascomycota
MSEFTAADTIRILVATDNHVGYEERDPIRKDDSWRTFDEVMNIARTEDVDMVLLAGDLFHDNKPSRKSLYQVMRTLRQNCLGDKPCPLEFLSDAATVFEGAFPHVNYEDPDINVSIPVFSIHGNHDDPSGEGNFCSLDLLQASGLLNYYGRVAEADNIEAKPILLQKGLTKLALFGLSNVRDERMFRTFRDHKVKWFRPNVQMGDWFNMLAVHQNHHAHTATSYLPENVLPDWLNLVVWGHEHECLIDPTKNPETGFHVMQPGSSVATSLVPGEAVQKHVAIVEVTGKDFKVQKIPLKTVRPFVTRELVLSQDKRFKGLDKKKDNRQEVTRRLMEVVEEMIDQANRDWEDLQTDEEALEDRPLPLIRLKVEYSALDGGQFECENPQRFSNRFLGKVANTNDVVYFHRKKKAQKKATAVDPTEALEALEDGSDMVKVESLVQEFLQAQSLKVLPQGPFGDAVNQFVSKDDKHAMELFVSEHLTGQVKQMLGLESDDEDLNSAMEIYRTRIEQQVTRGERKVHDKRKRVLKPRPDTWDSDFDGSWEDAPDAWTYNEDPNGIAASKGTSRGAARRTVQVDENMGESEEEAPKTTTGRKAAGRATKAAAKRAPAKKAPARGRGRKAISESEEEEEEEEDVIMESDDEPEPEPAPKPAAQSRSRKAAAAAPTAPAKKTTSTRGKTAAPTASKTRQSTLNFSQSQRGGAGRQTQAVEISDDEISDDDAFEPAPVASRTRRR

SEQ ID NO: 1505 - protein, 725 aa, Unknown
  Kingdom: Fungi, Phylum: Ascomycota
MRDTSLAGPFSRRNISAKTTKPVWITARTRKTYYIEAPLVRYDVVISVSSSLESPSRFWHLGIFFLANVIADDSDLSSERNLSHGVDDLATNLHQLGRGVLALKMRKYMSKRQRPCDHCRSRKTACRIDHAPPCRACALSGKECTFLQEAPPRKRPEGQDSIASDMTTARGTQSPEDARLDSDTAYVDLFSNQLHGHEDGVQQMLYHGSDGLGAGLNMDMDVSGYPFMPNMSPFGSQEAHMSVPIPEPEPGPVATGDSPLQTIDQMEDGCPQVIGLSSDMDPFLLHRYNADESGFFHFKQLSIQSVQSQPYPVQFLTSKPALVSKTREDAADGALPDAQLRMELETVVSASTGRRLLSLFHAYIELQYPIFSTEAAPDPETSPVHLLAAAYAVAFPFSIYDDQLCIDLAYDTPPFAALSRLINLSLRPDLHSPTISVAQTLVLMLIRPFANPLVAEAPYKGSLMGSLAAWIAASLGRPRQLRDDDWVVTSLDTSDRYGTNLTDEEWDHLLFTSRITAILDSALSRLFSLRASQEITRDSRYAPPIVESLLQSFPNVADTLPQIHGALDTVSHLSYHYARLLIVRSISRPPVASEAGQQLHTVDSNAFDANTTGILRSITCDFVDFIRRIKTDATPVFWPPWCPTVISTLCFTLLSAVVTSQSQQEAEEWLSLLQTTRRELRLKATTLPVLRLGLLRIDAIFWRGLENVLCLETHVKTAVQASLAR

SEQ ID NO: 1506 - protein, 317 aa, Unknown
  Kingdom: Fungi, Phylum: Ascomycota
MAPYNIGHMHGSWQTPGHSSYNLSSTAQQSPLNIGSYTGQRPSLYSQSPSMGYGAQRDSQSPTTGPGGEALPPPPDHHVHQPFPSPLGGHAGGGAPSYPQSAANGMMPSHSSSQSPAQSHSLPHLDSYSNGRGSSGYPLSSTNPAQSAFPSYSSLQSPNQASPASAGPGMRNLGAMAPPAPYRPPFGSYSPLPGVNGAVMSNVHHPGGSMSMVGSMGVPGYHGHPMIYGQAPPTAQERPFKCDVCIQAFSRNHDLKRHKRIHLSVKPFPCPNCTKSFSRKDALKRHKLVKGCDKKDADKGSPDGAESADIEDELKRE

SEQ ID NO: 1507 - protein, 570 aa, Unknown
  Kingdom: Fungi, Phylum: Ascomycota
MPNRNRKLRLLVAATGPREASWALALVVRLSNNPNIEMKAIVEHVVPRLTQTITAMPNKRLTQEQNPDDIAFYRQQAYKLVKWADILVCVPLEALDIGKMLAGVDDTFLGKVIRGWDTTKRMVLVPGMDMNEWSNPTTKRHLSKIHRKWNWIRVMGPILWHWEGTNEGAPVSKPMPNWNGFDELLGIIQNQADLLGLGRDVQVATSVTPRPDSDTKVQAKLPPEIWTIILNYVGDWELAKALRVYTNLPTPRAWQDLSKDSDDPLKAYASELAWTTLTCNSAAICKKISESPPNFRDLPALVVRLVIRFALIDVLQYMEANRPDLFTAFDGSVLPTNASAYYPRLDILDYWRQSRWFKDRHHHYTHEALDGASKNGHVRVLDWWLRRSGFQLRYTEAALEQASANGHLLVLEWWRDAAAQDEDVVLRPGRSILWATQFGRANVLRWWDASGIPVAHGDGVAQLASRWGQVEVLETWRRLKGDNKLVYDSEVLRDPTVHGYVGVLEWWRKFAHGELEGMEGREHPVEFRTCNIEEALEDSVGDQRGVRQWWARNGLNLGVRNEEWLKTRYL

SEQ ID NO: 1508 - protein, 157 aa, Unknown
  Kingdom: Fungi, Phylum: Ascomycota
MSLCQNRLQEERKQWRRDHPFGFFAKPARTKEGVLDLKNWECGIPGKEKTKWEGGLFKLNIAFPEEYPTKPPKCKFVPPLFHPNVYPSGTVCLSILNEEEAWKPAITVKQILLGIQDLLDDPNPESPAQAEAYNLFKRDRAEYDKRVKRVVRENPAP

SEQ ID NO: 1509 - protein, 565 aa, Unknown
  Kingdom: Fungi, Phylum: Ascomycota
MPALVHDDPPRSGLGDVTVFEDPWPQSRAATPLEDAAADHIELVGFFLRILAHFPRGKGGVITDEALAYSEWRYVCYLRFLDANGLSPHDRPPPWDVALVWYCHLMSPSSFQAHLWNHGHKALGLDYHHFPVQRLLQLKQWGRWSDRQSHRDWDRWAASSNVGYYLSYQLWESPPWEHVSLLSRILRRAPKTQPPRRLTKNSAPAAPSPAPYIGDRSSSSAPAATHIHQPRETLFPCSLKARSSDPVSWPLSDYALFRSGQIHRPCQSQVLHDACPQNSPRSACELAPWRCISHLKTALYRQAAFWNALCVARETQPSFFGNPTASGAVEQYTAFITLLRRPIPRVHNVSRFDPKAEYLPSVHPETRLVPPTLEVDLLWRTHRLFPGNYWAFCDENVGNVIDSEAAGEGTRLAMEMTRAAWSALSPIAWPSNGSPIQDWEDSYTPDVAILGPPADEATPLSCILSGLLPRRKRRHAPRKPPSAHQRYGSGTAGGRYSLSSAPGAASPRPSTSNSRGGGVRGSRSTDRGSSTLAHSNSTRGSLDQGYTPLGKFEDEKNWRISGVVL

SEQ ID NO: 1510 - protein, 194 aa, Unknown
  Kingdom: Fungi, Phylum: Ascomycota
MAVTIEDEYSNPLPKVRRLITTSNAKGQSVFAPDLAEEMEFWRLETPENVPVGFFLGYLTDSSPAPLKDHEDLRRYKEAFAKSERSGLVSHGGTILRYVDVPPQDKSTMHRTVSLDYGILIEGELECLLDSGESRTLRPGDVVVQRGTMHQWINHSSTTWARIAFILIHAKPLEFNGQPLDEDLGGMTGLPSSH

SEQ ID NO: 1511 - protein, 493 aa, Unknown
  Kingdom: Fungi, Phylum: Ascomycota
MPAKITVGPLCEEPSGHAQATKGRGGLSNTALLLELSQQTQVDGKKCVQDIMMSDLVFDKALTPADRIVLETLADHIQNSQSSKDGKAKRRVSSTGCSASSSDSEQMEDLSECNVQKLKALNNPKSPDFELSAFSGFELRDLKLPSYVDQFLLQPYIAWASSVVRVKTDVIMLTHLLIYASTSIPSALMLFRSFTYFHGFLHLVMQLYYIGAYTLLMHQHIHMRGVLNKRFALIDAIFPYILDPLMGHTWNTYYYHHVKHHHVEGNGPDDLSSTMRYQRDEIWDLLRYIGRFYVLVWFDLPLYFLRKGRPLMALKTFASEASTYAFYYAASRINARAALFVYILPLMLLRVGLMVGNWGQHAFVDVEQPDSDYRSSITLIDVASNRYCYNDGYHTSHHLNPMRHWRDHPVSFLQQKETYAKEGALVFHNIDYVMITVRLMMKDYETLAKCLVPIGDQVHLSVQDRIDLLKRLTKRFSDDQIREKYPQCFRVKT

SEQ ID NO: 1512 - protein, 303 aa, Unknown
  Kingdom: Fungi, Phylum: Ascomycota
MKASLNIAAAGLLLAPGVAAWGSLGHITAAFIASHFVENTTQAHFQELLRNDDDDYLAKVATWADSIRYTKWGRFTKNFHFIDAHDNPPESCNVDFERDCKDDGCIVTALANYTAQTLDTELPSWRRMQATKFVLHFVEDLHQPLHNEDVQRGGNGIYVKWDGRNFNLHHVWDSSIAEKWIGGMRGQPFPIAAKWANQLVVEITDGKFAEEKDEWLSEMDFSDPMKTAMAWSREANALVCSHVFPEGPAAIVGKELGGEYFEKAGPVIEKQVARAGFRLAAWLDHIAAEYEARKENGNTAVEL

SEQ ID NO: 1513 - protein, 803 aa, Unknown
  Kingdom: Fungi, Phylum: Ascomycota
MSTLPNGFSHQRAGTREVAPSPSLDPAIQDAATESEMRAALAVLHEREAKICARLDGLVASQTDMSRDLGRLDMLRAGLGAQVIATRSIGNNMLSTAAETAGRLSDKVKELDLEKSRVEDTLRVVEQVAELRACVHGVVGSMGAPQDWEAAAAYLDRASKVPEEIVRGAFAASIVPSVEVPDPPWVTLENAKESLCGLFLREFERAAADGDGTKVTRFFKLFPLIGRAEVGLDVYGRYVCQGVAGTARATLKDGMGGHSRKEGFFYANSLTKLFEHIAQIVEGHGGLVERHYGSGRMVRVIERLQMEADVQGGIILDTWSDERTIDRKLTDVKSYPFSFLVKSFLPQQSRSGTPRVNSPAVGGQNNARDSEDEGVNMKEIDGLLNEISLMLGRWSLYTRFIAGKCRDSAAADDAPLVMPDVLLKSTLYRKVTSKLASPYNVMAAFFFRRSVEKAFQLDEFPSGLSLSLNRTIEANAPYIILAVDDVMYIINAVIQKTIATSQRDVVGSVVPTLSRVMSSDFIGMIQRKMRDESYPKAIVQGGFPPEDKIIQFIVLINSLDMSNEYLQRIISGRVGTPDGMSNADNGPSLLLQSFPFERDATFVTSTLLGFENSFISKSSELLNEGIQVLIEKVIKPRMRPVLTDTFRDADYTLTEDEIAEIAQQNDEDEEEILDQVSRRFEYGWDQLMKPIARLMTPGTFTILLNATARHVAKLLEKRILLSSGRMNAFGAIRVERDFIGIIDTVSRSDYRVREVFGRITQLLMVANMEDDEWEEINALSGAEGIDWVLTEEERKKARSLVRP

SEQ ID NO: 1514 - protein, 112 aa, Unknown
  Kingdom: Fungi, Phylum: Ascomycota
MTTADPKCQQARTSVRYSTYSVAAPSFTPTVQSSDSTDGDLRSIAVGLDRMENKALSSQRVALTEEKTDNMSKLALGAKLERALDRRLSSQDAVMRPRGKTVTVEKDLEKSG

SEQ ID NO: 1515 - protein, 354 aa, Unknown
  Kingdom: Fungi, Phylum: Ascomycota
MASSSSNNGAHEALQPIHPSMAGKLDPVFEKLYNDNVANTPLKPIDLAFLRSKYSVLYSYGTGPAPEVGRVYDDRIETADGVALDVRVYEPASQGPWPVHLDFHGGGWGLGDLDTEAHICRHLCAKANVVVVDVAYRLVPEFPFPTGITDSFAALRYVHEHGAARFNIRPDSISLGGVSAGGCIALALAHLARDHRPAPIPLRLVAVGTPVIDDLAQYASAAESPFPSMQENEFAPTLNWGRLAWFDKLKWSSLPADPAEHKAFREEKVGWFANLLKAPRFDGLARTVIYTAGADPLRDEGERYAQLLVAAGVEVTVRRFPGVPHPFMHMDKDLWQASEFIDKTAREIRLAHWE

SEQ ID NO: 1516 - protein, 550 aa, Unknown
  Kingdom: Fungi, Phylum: Ascomycota
MGLSINNIFAVNEDRPTPKAVYNWRVYVCAAIASFASCMIGYDSAFIGTTIALPSFMSEFKFASYQPDDLALLKANIVSVYQAGAFFGSLFAYITSYFVGRRYSLIAFSLVFMVGAGMMLGANAERGLGLIIGGRVLAGVGVGACSNMVPIYCSELSPPAIRGRLVGIYELGWQIGGLVGFWINYGLAETMAPSHTQWLIPFAVQLIPAGLLLVGAFWIPESPRWLFSKGRRDQAMKNLTWLRQLDANDLYLVEEVNYIDQELERYNKEVGPGFWKPFKALKNRSIQWRFFLGGMMFLWQNGSGINAINYYSPTVFKSIGIQGTNTSFLTTGIFGVVKTSITILFIMFLIETVGRRKLLIIGSVGGSLCMWFIGAYIKIADPAAKIAAAAAAGSTAAPKMSSGGIAAVFFFYLWTAFYSPTWNPIPWVLNSEMFDENSRSLGQASAAANNWFWNFIVSRFTPQMFLKMGYGVYFFFASLMIMSATFVFFFIPETKGLPLDTMNRLFDIKPVRKAHGQLSQELRDQEDVFRRDAELNEEKNSTMAQEKEQV

SEQ ID NO: 1517 - protein, 865 aa, Unknown
  Kingdom: Fungi, Phylum: Ascomycota
MGDPATKPKTGIFSECSVSFVPGTLLTPRTISDLATAIKENGGEVYEPRRDGSLRLDEATHIVSNTIDFPQYAESQAFMIPVVTADWVTVSLARRKQAIVRPYSPDPRLIFSSLVVTCADLPLTDKESIIGATLAMGGSESKDVTKATTHICALSMDHPKVQAAVKAKVKAKIVLPHWFDDCFKLGKRIDEGPYLLPDPEILSKPADASLTIPTNENLEGATSPNPVTLPFPSSSEAARPPCTVFQDKRVMISGDVVTSSRKRLIKVVEEVIVNGGGKLVDEVEDCDIFICHYRDGPQYVEAAQSCKDVGNLAWLYHLIVHNEWTSPFKRLLHYPIPKGGIEGFKDMRITVSNYGGEARIYLESLIKACGAEYTRTMKQDNTHLITARDTSEKCLVAPEWGISVINHLWLEESYAKCEIKPLTIKKYTHFPPRTNLGEIIGQTSMDESRLRELYYPGGEDKMSSFAKRKRKILDAADENTYGHGPGEGILKTPAEVDTENFDVMRDDSGNSTEPKTKSKNSRKSAATPVRSGRVSSGKENTTPTGMSTGDRSAKAKARDMLQHIAPDIALYEKEKKRHSKSGPWGGKRAADTAEKEHEKSAKKGKGRGVEEEEEEEEIEETHRPAKRARPSLPEVEMRVVLTGYTRWVGDKKKEDTERRKLRNLGIQVVPEGSPCDYLAAPQIIRTVKFVCALARGATAISSDFITACLDANELLDPNKYILKDRENEKKYDIKLSQSVARAKAHRGRLLWSVAVYCTDKIRNGPESYRAVAEANGAIFKMYRARSGVTIKPTTMEEDGGRPPEPVYLLSSMSPEEKAMWPRFKDMAQKGNMEPRVVAPDWLLDVAMAQEVRFDEKFLVENFYAD

SEQ ID NO: 1518 - protein, 366 aa, Unknown
  Kingdom: Fungi, Phylum: Ascomycota
MEDLGPMVNGVVWFLAVAAGLVLALRFWCKISRGRGLWVDDYWLIASLGCLVLTACFNSASVAYGFGKHGWRINWAKGDWLLLNMNLAGTFSIIAAAWSKTSFAFTLLRIAETRWMRWVIWFFIISLNIALGGAVLITWIQCWPVEKTWRPSVEGSCWPKVYHVNYNIFAAIYSGVMDITLALMPWWIIWSANMTLKEKLGVMIAMSMGVFAGIISFLKIPSIFGIGKADIIDTVPLVIWGAAESSVTIIAASIPVLRLLLPSYTRHVNELDYKSDSRSKKLTDIESTTDSRALSSPTTAQSHPGSAGQNALATPYRGQDIPSIQEALETYPLQVRSPAGADGTYETQGKDLPPLPLRLSKMQTSA

SEQ ID NO: 1519 - protein, 155 aa, Unknown
  Kingdom: Fungi, Phylum: Ascomycota
MLYPSFFKFTTLLLAMVGGIFAAPSSDNQKRTPKSPITHLGNKGPILSGAVMTKDLVYTSGTVPSINGTIPEGIEAQTTVIINSISALLEEAGTSWDLALKTTVFLADMGDFQAMNAVYSSLLPNPKPARTTIQAGKLPGDFLIEIEAVVARPHC

SEQ ID NO: 1520 - protein, 84 aa, Unknown
  Kingdom: Fungi, Phylum: Ascomycota
MRSTAVMRMFRQTPRMMRPVPKEDQAGHTISQRLRKLKSIPPELIPLGVVVGFAVIAAGYSSARKFWVDKNLRLGRTGPTGRDH

SEQ ID NO: 1521 - protein, 445 aa, Unknown
  Kingdom: Fungi, Phylum: Ascomycota
MSESPKKIRLAIIGAGIAGLTAAIALQDQPHIDVQIYERARQLREVGATIALGPNGLRILDKLGVANALSDDVGFRNRTGRSMIYRHYQTDEDVSSDVPQGPVEYKHQTARFFRPHLQRVLLDHIQQGRLHLGKAFESIVKDNSTDDVTVKFRDGSTAKADIVLGADGIHSAVRRTFVPGSSAKWTGHVFFRTVVPRTHYQHIEGLPDEAVHYWAPDRTLFLSPLPRGLYAVVAAHQCDPDDPDQPYLQAEWDQNVNIASLRPLYKDWSPLTRRILDATPFIKVYPNTAAKELDSWILGRGRVTLAGDAAHAHGGAFAAGGSLAIDDSWAFAQSVLHHFPASGDWRVSLDDSGVSKVLALYERTRKAHTDRVQRTVQQRNRFLVDQIKTKQTDEELRHKMRSRGDLAWVHEHDVEAAFTRAKLELDQPEEASVQPGFQQREQSRL

SEQ ID NO: 1522 - protein, 705 aa, Unknown
  Kingdom: Fungi, Phylum: Ascomycota
MNPAQPQGQAGGQPGQQQQRGPPMYTAATIETLPYITEDEKARYKAGLTGLWAKVSNTQPESAESQQARRKIIEFSRMLVNKITQRRQTQTQTQQGQPQQAQQPQQVQQPQQAQQVQQVQQVQQVQQVQQAQQAQQAQVQAQQAQVQAQQAQVQAQSQASPVQQNAAAAQAAQMQQRQQNAQAQQSAAANAAAQAAAAAPAQNQAQAVQQAKPRLPDHITQHINKMTIRPPPSILKEKTPAEAQKWVEDAKERYGKALLQMDSAKKQMNALEKLVKDRADAGNPLNEQEMNTMNMRKDQYMKQWNEAKTWADNFRKSIAGQPSAAPAAAAQQAAGQQTQQAQQANTQNVAAPVNAALEAAKQQQATRPNPPQTPVHPPQRPGPSIQQPAIQQQAKPEQQMPQQTPVNAPQPPQAAPRAATQPVPATGPATGQGRALTHSAAMSLANSRASNTPGSAPVQGQPQQQPQPQQQPGSGAGTPASAGPPSQSTMAAQQGHPHAHPGTQQASIQSKMPIPKQLPERAMSVPTGVTVGGGVAPGRPTMSQGSGTLGGVMNQPAVAKVQAYNHEAEGDHVLSKKKLDELVRQVCGGTAEGQEGNMLTPDVEEVRSIAFPRRNTTDSLQSVLNMADSFVDSVLHAACRNAKERGSKVLEIRDIQLVLERTYNIRVPGYSSDELRTVRKVQPASGWIAKMSAVQAAKVMPGKGE

SEQ ID NO: 1523 - protein, 370 aa, Unknown
  Kingdom: Fungi, Phylum: Ascomycota
MLRPTLVAIIFILALAVGQSEQRCFITNDWREGAIVPGEPDVLVWQNGPTNQDVLLNIVNGSSTIFVGAIARNVSQGSVFWIPPWDVYGNNSDQLFTIQLWDLTSQNGCSSPAFKFAKIPRDEPEPTSAVFYGPFVTTALSILDTGYVTVTATVATYSSDDPQFLGVVTGSITATDSMILSGTVTSSARATATATATSTSTSTASPDANDDHDGGSGPNKLAIIIGTIGGALVLALVVLSILLWRARRKRAGARARADSTVGLKDISPSSTPDSHTREAETNPTTPAPATELSEDTARHEMMGSTTAPQELPSENMEPVELPADEIPPPSYPHWEQEVSPTTGDSRRSSLSFDKGTFTVSPLSDRRDRKE

SEQ ID NO: 1524 - protein, 613 aa, Unknown
  Kingdom: Fungi, Phylum: Ascomycota
MRQRHLTILGAFIFLLILAYTASRLQKQYSVVPDRSSEEPKSPAQDGDTNVDENGAVPQHDLGPKPVIDTTIHPIQSLMTSARDNFEQIKNRQSKTLEEAVKEYRRRYGIPPPPNFDKWWSYAKKRDTQLGDEFDTIYDLMTPFWGISPQTIRSRAKEALSHENSLVGVAIRDGEVTLVEGGPEWQQNATKGMLQSFVQFLPDMDLAFNVHDEPRVMIPHDDLTRLVRKAKDETMAAAGAAKSLKNTFSGRPKGMNDGKTFEETKLTRFNTFPQQATWTNSRMSCSPNSPARTLDDEEDIDDLSQYSMGEVGFVYNTTAMSDICSTPSLRSAWGFFGRPNAFSVVHDLFPIFSQSKISSYADIIYPSPWYWNEQVVYDEEKDMQWEEKQDKLYWRGSTTGGFSREGGWRRQHRQSFVQKINARDDAKIIVNTGTDDAPNWEVQTTPRGDHRDLIDVHFSHIGQCDEGDCEAQIQFFEVVERVDQQDAWGFRHLLDMDGNAFSGRFYAFLRSKSLVYKLSLFREWHMEWLRPWVHFVPLSLQGQDWLEVVRFFGKNGAGTSDAEKMASESRDWAKKVVRKEDMEVWFFRLLLEYARVIDDDRESIGFDPDLASG

SEQ ID NO: 1525 - protein, 594 aa, Unknown
  Kingdom: Fungi, Phylum: Ascomycota
MASFLHVTWSKSLRIKIMIVIDTLFFLLELISGFLVHSLALTADAFHMLNDIISLAIGLWAVVAAQKETTDEFTFGWVRAEILGAFFNAVFLIALCVSIILEALTRFVEPPEINNPKLILVVGCAGLFSNLVGFFVLGGHGHSHGGGEHDHSHENEHDHVHEHGHGLHSGHAHDEEQGLVGHSSAESSDVTAVESSGPPDIVIRRPTGAGHGSSSDDQHRRIRFDDGSSRDESNTRTSKASASSRGRGRRSSKSSQNHSRLASIEDMSIHPASFRQEIISYATSSSANAEPPSESESDENCASGDYEEGADEQSPLLKDSKDNNGTMNVASSRRGAFPGKTRGRRDSSVHKGHNHTLPKKPGKKGGHGHSHGDMGMNAMILHVIGDALGNVGVIVTALIIWLTEWPGKYYADPAVSLFITAIILKTAIPLTAATARVLLQATPETICIADIREDIEALPGVVSCHHIHVWQLSDTKVVASMHLQVSFPIDTNSGEKYMQLARRARKCLHAFGIHSATIQPEFCLDIQHEHEAEAASLRLDGTADGPKNEVCLLECVDNCAAPSCCPPSDNMSQASSTRRASDSSHSASGGHSAH

SEQ ID NO: 1526 - protein, 616 aa, Unknown
  Kingdom: Fungi, Phylum: Ascomycota
MASWWLPSRIDATVTRQFVIQQLLPEEIQRLDQPVAFGGEDLTERTYWDSIHQNAKRLFLILLDLGVPDQIFGIIDDGWGDAELPLGPEDVERLQLTAVKDDRIDRKFYQRQFIYLTKPIIRGEHQSYSDYELVPLDVVDRPQGKAGAVDRVKLPNGGSRVFTRRRLALGNGPGLLSPREFMELVSGIRPLRNDHIVSYWASYTHHGYGYILLTPTTEYTLKSFLANTPAVFKNLPKIERRQLVMNWLLCLADTMAFLHSKSRSHCCIKPSTILFTDSNHVFYADSTRLSPEAAGNGKDSSFDREWYDYAAPEQWYRPTGPGSPSAKKGLNPYSISPEGLNYSVPRSPDGTPSPSAVYHSPNPQLNPQQADIFSLGCIFLELLSFLVKRSSSKFASFRSTKHKTAGRGGAVLDTSFHKNLGQVEAWMSSLAKDASKKISDSDGGNVFRGITPMLHIVTGMLSANPHDRPTALDVQQKVYRVLIDQCDIEEPHCVHQYSADLEYSLSRLQMADGEQMSRPIPIQHVGAYNASPGTPRAFRHIRTGSDGGFSEKSGASNNTGSSSENGVTDPPYRGYASGARRAVPTTAPQASASGWVGQAQYMGSRGDPASLYASAQ

SEQ ID NO: 1527 - protein, 971 aa, Unknown
  Kingdom: Fungi, Phylum: Ascomycota
  misc_feature (183)..(183): Xaa can be any naturally occurring amino acid
MARPEDFPILAQLRSARTLPDRIAALRALKNEIVGHSQLKEAWIGLGVLEPIVRTIGSSSRQSWANGKDVRVPGYRPLSDEDGAKLQALQLVASLANGGPAFLDPMHAAGIVPAILSDISPDDNPPQIVIAALRALSEIAEASTLVSRSSPLDSNTLADMVFVPEHIQSFTAILALPSSRHLXDRHRHALTMAGALDALASRLASFAVAQGFVVPGAETLAHNDGLIKAFPEAAPINAKLEPILTAIGSIIGESKYRAHRLVHSPSIIAVFPSIRFRPAKAVQDLRQGNEYSGSAPTSPFEDSTAMEYMLPVLPPPSSRLSSPSYYTNSPPERIDPELSRPSAGKFAASTLWDSSRTHKLGRASADEQSNRNDSERLSAASILTGLFKAGLGSPNREASLGLLVVPIIVGLISRNDREITNHDNEKERRHVLQRAPAILAHLIVDSAVLQKAAFDCDGVPILTRILRRAYSPVDPNSAGTMWSPHVDTPMKVEDASPVQRMGQPGEDPLQVHYLELRESSLMAIAALAGQEEHRRALVKEDLVPYVVESLAEFPKRPQPPKDKSREPRTLVAESLTPGYGRNTEKVIIAACHVTRMLSRSVSILRTALVDHAVALPILKFMEHPNIQVQIAATATMCNLVLELLTELGVMNMLCEFAHSDNHALRINAFWALKHFVDAVGPDLKKKCLEELGAGWLLQLIWENGRDTALYSPRGERSLSDTMEDEAEPLNEPHRWLYIVDGTLQEFDASLVTRLRQAEDKLAAVRDAELDPVRQARNDDIAIQEQGLDLIRNLIGRPGSGAGNGDSPSETTEMIDYLLDQLGEDRLFSILASKLRTRMVGRFSQRGASTGQEARLVHPHAKIMETVIYILVHMAASIPRHRKLVIDQTDLLKALCQQATNKDPSVRVALCHLVFNLTCQDDDGETPACQQRAQELKKLGFLARMETMRLSDRDIDVRERAKTAAWQLEQAC

SEQ ID NO: 1528 - protein, 395 aa, Unknown
  Kingdom: Fungi, Phylum: Ascomycota
MAPAPIDPAIKDFVAPKKDNLPLPPATRSRLEKAGIDLSNGYPYRPSKPLYLQDVYKIRAEDREYHDAGARADKSKKNLFAAATKVTDLTANIGTEIEGIQLKDLTNEQRDELALLIAERSVVFLRNQDISPQQQRELGEYYGEVEIHPQVAQVPGVLGVSVIWPDLQATEFPANFRRPGGASRWHTDLVHEHQPAGITHLHNDTVPPVGGDTLWASGYAAYEKLSPEFRKIIDGRTAIYRSAHPYLDRDHPEAGPKYVEREHPLVRVHPATGWKALWVNRAMTDRIVGLDRAESDVILNYLYDVYEQNVDIQVRFKWTAGTSVLWDNRITIHNASWDYGGQYPRHGTRVTSLAEKPFFHADAPTRRQALGLLGPDEKKELNIETATDKLRDFSL

SEQ ID NO: 1529 - protein, 689 aa, Unknown
  Kingdom: Fungi, Phylum: Ascomycota
MATTSSPQVGSFEVDMPAPELTGPRTLPPRQVTAATIEDAYVQFIIYCNPALPNKADVPSLREAFRTPPRSGGKAFDPFAIFELVRQFYTKEIKTWAELTTKLGVEPPDPSKDESSQKVAQYGVRLKKWMNSMHVKAFFEYLMNIPNEYWTQLPQGSDPLGEPSREGVAVEDDMALRALLPHIRPKRGRKRPEDEDQPFTPVQRPRLSPASGVDESRNVSTQPWLANPEVTHLNPLSEEPRSAVPAWGSTDSQQRPFSQWPQSAITPTTRAPFWEDPNEPRSAITPSKLKPSQRRGVKNVSSAWKTGGLESTGKTRGRPPINRTPIDGQSFSSATWPSSQAIGPSTLQNTTISDQESSSIDAKPPHAPPPQYASTEPERRIPISEHGSTHQDGSRPARPSISLQVPQRPPSSVRLASPPAPPPPPPPPQSHPQNGQTSQPPPVIITNGDHNQEPSSTEPQNRTAGWNTWASEAMGAYGDGQTSRQPAASNGAAAGTGIPDYYFEKIEDRTNVDSIISYFVQAAYDADWCNADGTPGERATLEEATSIVNTALQTMYKSATSPQVFLINLAALAGARHLMTRRARYVRRGGDENFRNYSFEWEYRFGHVHGKFTMMHRVPRSMWPLEEPPPVTAPDANGSGQEGQGEKDNAAAPAVDWQKKYENLLEQVERQNKDMWELRARVMGWGRGL

SEQ ID NO: 1530 - protein, 554 aa, Unknown
  Kingdom: Fungi, Phylum: Ascomycota
MLAGGLAQMTSNNFGPGLGMPTGGLASRRGGQNIKPLSFDSINKQGTQNDTGIPTPRTARGHLLAGLRTAPKTSTATSFGPMSPTMANPQQQFARNNGMSVNGNGVESSYNPPKTAFPQYNNQTYNSVPDQQYTVDQVLAPPELPLDEQAQEYMEPQLYEQLVATNMYLAQQQQRLQQQLRSVQAAAQQFQQLNLSNPQLNQQQMMLYQQQQQLRNLQQQLGIQAAMSQGQQVYYHAATGQYLVDSSGMGLASSYGAEQHFALQQQQQQMYLHQMQQNMPRVQVSPPPENQPQAPTYRSNSPPKRYDSPQTEVTPLPPPSANAFRRGHKKSASLAPVDSALAASIGSDGPKSAGPKTANFPLTPATGTYGPGQARAGEHPIRQPRGPPSLDELKAKPTAKHEGSKNFAARTRRSALSNLMRAGNLRRKGTSSSAGSMSPVSETAEESATPITDNDSDSGRSGSGSLDGEMECGDSQTSASGSWGAIGSDRPSSRQKTTRGSIDSAVSENESNSFADVFKNGAARAAKEQEQAGAQRKAPRLVLTSVEKRKTTLN

SEQ ID NO: 1531 - protein, 927 aa, Unknown
  Kingdom: Fungi, Phylum: Ascomycota
MASAAYSAAVPESVITVKINYDGCTRRAKMFLRDMVPGQLEQQIRTFLRVPSDEELKIERYSDSAGSYVVLDATNIAVYKQLYRAAKAKSKLKLRVTNPNAEGKPTPRPVTVEEVPDTSVVTESSHIPHTESSIKAEESASPQVSSPSTQLPESTPSDTVSNPVEVSLPLRCGRTSKAYDSDHLAKAAKQLAEFETIRKDLTERLNMIQNKMPEPPQSVESFSEAAARRVRLLHSMQKARLEISNRGAESSNTTSLEFPPMGSCTRNTQGFAVCCNSCDKTMPDVHYHCSTCDDGDFDLCSSCVDLGITCHSPSHWMIKRTTINGQIVNSTTEVIPPKVKKETTPKAEETPKFGLIKPVTYISPALAPDCYDGPSTNQVPAPFNASFSAMRTCNNCISSFAEKEFLHCNACEDFDLCKACFAKNQHGHHPMHGFTPAVIGTEMPENIKVKLAPGRNQMHHAICDGCDKYIMGVRHKCLDCPDWDYCASCLPNAHFVHPGHRFVPIYTPLVDGVRVLNKSVHQGICCDGPLCANGKGYPSYIRGIRYKCAVCDDVDFCANCEANPHLNHNKTHPLIKIRTPVRHINVTTTGEKGDGSPMRPMGDGASIRRSPAPTQAPAEPAPEKQTFTSEEIETVKKADTPKPFISIDRLADRLQALNVLNAHANQPTAVKPAPKEQDLNATFVRDTVVDGTIMPPNHVFEQSWVLRNEGPTAWPAGCSVKYVGGDYMGHVDSNHPAEIAKLVSASESIVCYDSLAPGQEFAFTVLLRTPSRPGKFVSYWRLSTPEGLKFGHRLWCDVVVRPVKIEEPEPNTAVETAAAVPAALADSVSVSPSVKTDGTMVNSDMIFPKLEKESPAASMHEHARAPSTVAASTVADDKVSSTGAPDESAEDEDWDVSEDGFLTDEEYDILDASDEELLEEHAKKLQK

SEQ ID NO: 1532 - protein, 441 aa, Unknown
  Kingdom: Fungi, Phylum: Ascomycota
MRRVAPSTPRAIRTPIHARAASSVSQRPNSEFVSFPGALKSAFTNKLSFETPETYTALPTYRVVDQHGVVVDKSFEVEITDEEVVKLYTDMLYISILDMIMFDAQRQGRISFYAVSAGEEAVAVGSASVLDKDDVMFCQYREQGVFRQRGWTTKQFMDQLFANKYDQGKGRNMPVHYGSKEMNIHTISSPLATQLPQAAGAGYALKMQQLRDPSAKPRVVAAYFGEGSASEGDFHAALNFAATRACPVVFICRNNGYAISTPTLEQYRGDGIASRGIGYGIDSIRVDGNDIWAVREATKKARELALKDGGRPVLIEAMSYRVSHHSTSDDSFAYRARVEVEDWKRRDNPLIRLRKWMEAKGCWDEAKEKEARDKYRKEILKGITQGEGEKKPAMRTMFEDIYEELTPELKAQMNELREVIERYPEEYDLSEYDGGKDSLKA

SEQ ID NO: 1533 - protein, 374 aa, Unknown
  Kingdom: Fungi, Phylum: Ascomycota
MAPAGGVVSVRHGTSSAVPGGPDDNLAAEESCPVCKTSRYFNKDIEFLINPECYHRMCRTCMERIFRDGPNQCPHAGCHKTLRKRGFKSAFFSDLRVEREVDIRRRVANVFNKVEDDFETLDDYNDYLYKVECLTDDLVNGKEEAKRRAETELVEWEAQHKAEIDRNKKLARESDEARQKRIAMEREAARQRRLEDFQAEAEEKANAARFREEMLNSLQTAEEGQAAQAMNKIILKRRGQQKRDSVMDTMASSTGSLSIRGLRDRAAEAAAEAEEEGPYDPYGGLDMRPQRIDLAPEKLADYGQGNEWIESARHKDEFKVGGYSPDEYISRALYEAFAGLGVFIEEEKIDRGAGTMGAAEAAQTGVTAGSMDVD

SEQ ID NO: 1534 - protein, 83 aa, Unknown
  Kingdom: Fungi, Phylum: Ascomycota
MSHESVWNSRPRTYGKGSRSCRVCKHKAGLIRKYDLNLCRQCFREKSKDIGFNKVSKKMPASGSHSPNVDNQRRDTPTDLRAP

SEQ ID NO: 1535 - protein, 467 aa, Unknown
  Kingdom: Fungi, Phylum: Ascomycota
MYRDRRTLLILVPIVAFFLVVTSLYLSSDYLTRVVLPKLHYPSAESIHELPTPDVVSSDVPVLDNAASSTPTPTPTPTPLVAIEPVPIIAVGNGTILKATLIQQYVDAILDPELTTFERLQCPPINETRYAPLRSPGEPDADEAGLSFFFALNLRNNLPILPRLIGSIVEAIRFLGPDRCVLSIVEGNSPDGTGDVLKALGPFLDGLGIQYRYSTSEINPKEGDRIEKLAQLRNMALHPLIEAFEDSASADTTVVFLNDVAACSEDILELALQRRRLGADMTCAMDWTYAGPDPTFYDVWISRGINGDSFFYIPETGSWEHAWNLFWNDSMTKSRYAANMPFQVFSCWNGAVTFSAAPLLDGVRFRDAQDGHCKHGEPQIFCKDLWSKGYGKIAVVPSVNLEYSDDKGLMIKTLKGYVMDLVREERANDSVIDWSGPPEEVKCIENWGNQFWKPWEVSRRDLQDSPK

SEQ ID NO: 1536 - protein, 514 aa, Unknown
  Kingdom: Fungi, Phylum: Ascomycota
MYDVVIAGAGPVGLFLASELALARVSVLVLEKDSPSNLAWKAMPLGRRGLNTVAMEAFYRRGLLNGISDPAERPSLVAKPGGPQFGGHFAGMPLSTKHFDLSRSKWRLPGPALFPARTYMQRIEDVLAERASSLGVSIRRGEGFSRIEKETSHDIEITTTEGSTLHSRWLVGCDGGRSTVRKEAGIAFEGTDARMTGYSIKCSVDHPERLKPGFHCADNGLWIFAPGSIYLMDPDGGSFDRSQEPSKDHLQNVFERVSGMKDVKLAQVDYVGTFTDACRQAALYRKGRVLLAGDSAHIHSPMGAQGLTAGIGDAMNLGWKLAAVVRGEKSEPAYTSTRSFQDRMLDSYAKERHPEGAWALEWTRAQVLALEPGPFGQAMRNLLTDLFATKDGTNMMLDHLWGLNQKYPTEEYESGHPLIGRSVPDFELPDGSRLGDHMHHGKGILLELEHLPDAAKFRKGYEERIEGLNIRPTETLGIDALLIRPDGVVVWVAEDGVEPDLAALRKALETWFGL

SEQ ID NO: 1537 - protein, 965 aa, Unknown
  Kingdom: Fungi, Phylum: Ascomycota
MKAGQWDGKQRKVVINDIPVPEPVENQFLVKIHSASLCHSDLMSELRPETTVTLGHEGVGFIEKIHPSAEGKGFNIGDAIGFNYFLGVCFECDGCMVHNLRCERSPAQLQGFVADGYFQEYCVVDYHNAVILPKELDMKRAAPLFCAGITAFHAVDSCELKSGDWLAVVGCGGLGQYATQYAKAMGFKVVGVDVNDEVLESVKKLGADAVVNSKTNPNAAEEVKKITGKGAHAAAVFAAAPQAYSSAIEYLRVGGLLMVIGISSEDLKVSTFDLTTGRYRIKADSTSIPQRMAKAVNFTAKHKIQPDVEFRKLEDLPQMVADMQAGKAKFPDMKEKAKDMGYDIADYDDCSTLYSKSLGDAQNFFSLKYHANRSEDCKHFMALRKGMKVMVGQNMMSFEKGMPDVDARDGILDHKTQCAQRDCGSSLVFRSDNDAALVRTSSTLCSKDFFPSQDFSIVTRIRLTNRAMAPTLKLVKRPRPEHLDVAHSKKRKSVFLVETATGFVTAPLTAKPETRTPDLVKSVDAISGCKRTTTAGPIAPSSAISRSRPSIQGLMSRGIQLGFAKERDTEPMPRVLAQGQPAGQRYNPRRETTTIQNLECAFDSAFHLAYSSVFSMGQRSSNDHGRPFPYLHSASRRLHGVTELKNSNPFVPPKLLAKTASSQIDALHPPLHQPGLWRAEKEPSTLDEVFQNQQETHLQPNQDEERASSLLSTLNSTEANMELYEIPVEDSTGALRKWLVFRMTKPEVRRGSRTLPPVEPPSDDWIVFACPVTQIMKLSETSETIVPPGPTKRNTRSQTRARTIARLVDTERFKVTVYNPMEGKQCCLKLLLSKNGIPSFECSQYTDLETQQAIKSEADPSMCCHRSATGHRSRRRSRSQAHGPWAKVQDAMARFGCIMDIKSEAGATWTEVGAAVPELKPLRPSLPVRNSISTGTSTREKMQQKAAQRASLALQNWKTTRTSSG

SEQ ID NO: 1538 - protein, 382 aa, Unknown
  Kingdom: Fungi, Phylum: Ascomycota
MTAPSSADTMDLPAIDLDVFLNNPLSAPETQAECLKAANALITYGALVLHDSRTSEAANDAFLDLLEDYFAQPEADLRRDERPELSYQVGVTLENTEKPKCAVDEPCLEVIQRLAPEQRPLDISAHQPDPKCRFFWSLAEKPPYETEFPGLNAANVTPEAEHLKSRWNETMEARGKSMRESVAGLAQMVAVGLGLPADYLTNAARYGPHLLAPTASDLVKYGAKDTILAGFHTDLNFLTIHGRSRYPGLNIWARNTGNRIPVKIPPGNYLLVQAGKQIEHITGGLIKAGFHEVTVNEKTVETIQRRKAQFPDRPLIRISSTCFWHLSSDFDLKPVPELAERAKQVRAEQFNLGRDEGREVEYPPMKVGHQVQGELKHIALMI

SEQ ID NO: 1539 - protein, 402 aa, Unknown
  Kingdom: Fungi, Phylum: Ascomycota
MIITRTQARTRRVSTTTLKGAADASPMPDIKTLRDAIPAKCFERSMLHSFYYVVRDLVIIGSLFYSAVLLARLDASMAVKVPLWALYGFVQGLFFTGVWILAHECGHDSFSSNLTVNAVTGWFLHCFLFVPFFSWKFTHARHHRFHNHMERDTVFVPPRKEEVTAKPTIFEKITNHTAADTPIVTVGALLFHQLLGWPAYMLVNAGAGVKSLVNSDRTQSPAIKQLHLNPNADVYTKGEAPFVALSNLGIFITFSVLVLVSRSLGVWNTVLLYGLPYLWMNHWIVAITYLHHTHPNALHYEAEQWTFIKGAASTVDRDFGFIGRHIFHGIIEYHVVHHMFPRIPFYHAEEATWAIAPILGEKYIQQKTNFFADLWGSFVNCKYVEEGNGACGEGLVWGKVKA

SEQ ID NO: 1540 - protein, 1301 aa, Unknown
  Kingdom: Fungi, Phylum: Ascomycota
MPPSPSYERPLSPAQDSDSDLDLDLQELDPISTQPARGSAPAPSDAEPKSSRIALRNLRMGGPRRANKRSRVYGELGRDRDDGDEEALLGGAGSRSGWSDGHGEDDEPLLGDSQPSRRRERLSSFSSNLRLPSFMSGGKNQEEEQAEEQEEDDPSASRIVVVGAIQSTRYPSNMISNAKYTALTFLPITLYNEFSFFFNMYFLLVALSQAIPALRIGYLLTYIAPLAFVLCITMGKEAWDDIERRRRDTEANSEEYKVLVFSDPETSFSAARPRRPLRSESYRKKSKRQSHSRHDLSDIREETEDEHLDLPQPSSYVQEVSRKSKDLKVGDVLKLSKGQRVPADVAILQCYTAEGVSQVAAKEPAEDESLLAFGDSEQSEVSKGKQPATEAASNDTDNGSSGETFIRTDQLDGETDWKLRLASPITQGLPAEEFVRLRVTGGKPDKKVNEFFGTVELLPSRQEAMSQQASLPSSDDENGTKTAALSIDNTAWANTIIASQATTLAVILYTGPQTRSALSTAPARSKVGLLEYEINSLTKILCALTLALSVVLVALQGFESTEGKEWYVKIMRFLVLFSTIVPISLRVNLDLGKSAYSWFIHRDPGIPGAVVRTSTIPEDLGRIEYLLSDKTGTLTQNEMEMKKIHVGTVSYANEAMDEVTTYVRQGFHIQLTTDPATHSMLITPSSAYSAPANAGATRTRREIGSRVRDVVLALALCHNVTPTVDVENGEEVRSYQASSPDEIAIVKWTESVGLRLSHRDRRSMILESTETGRPVVRVRILDVFPFTSEGKRMGIIVHFHTDFKSKSPDLTTGEIWFYQKGADTVMGSIVAANDWLDEETANMAREGLRTLVVGRKKLSFQQYQEFGAKYQEASLALAGRDAGTQRVVSHYLENDLELLGVTGVEDKLQRDVKPSLELLRNAGIKIWMLTGDKVETARCVAVSSKLVARGQYIYTVAKLKRKDNAQDHLDFLRSKTDACLLLDGESLSLFLTHFRLDFISIAVKLPTVVACRCSPNQKAEVAKLIREYTQKRVCCIGDGGNDVSMIQAADVGVGIVGKEGRQASLAADFSIEQFFHLVKLLVWHGRNSYKRSAKLAQFVIHRGLIVAVCQTMYSIALKFEPEGLYKDWLLVGYATIYTAAPVLSLVLDKDVDENVATLYPELYKELTLGRSLSYRTFFVWVLVSIYQGGMIQGLSQILVDVDGSKMIAVSYTVLVLNELLMVAIEITTWHPLMILSIVGTFVAYIGSIPFLGGYFELAYVITWGFVWRVLAIGAISLVPPYVGKIIRRTMKPPSYRKVQST

SEQ ID NO: 1541 - protein, 452 aa, Unknown
  Kingdom: Fungi, Phylum: Ascomycota
MSATTYDCIVIGAGYAGLSAARALLDKGKSVLLLEARDRVGGRAWTKHLDDGSYEDYGAMFLGVEQPNMHRLAAEFNISVFDVTTKGKSVLTYRGRSKSYSPTGLPPLSAVSLLFLARAVRSFEELCKTVDLEEPWKTPRAHELDNQTIEQWIRANCWTKGARDTLRMAFELFWGLGTSQVSLLHALWYSKSGVSFTVLGTIDEGAQKELVIGGGQAIANALAKYLGSAVHLEEPVVQIDQQSESCVLVKTTKSTYQAARVIVAVPQANILRLEFSPPLPPQKMKLLQNMPTGQYWKIVAMYDSPFWRNNGLRGEAICPDGYMALINDVSPHDSRYGMLVAFIAASKAMAFLDMDHEQRRKILLRELELNYGKEAAHPNKLTMHTMMAEEWSTGCPVAAPTPGTWTSMGHWIRKPVDRVHWAGTETSSVWSGYMEGAVQSGLRAADEVLKAL

SEQ ID NO: 1542 - protein, 767 aa, Unknown
  Kingdom: Fungi, Phylum: Ascomycota
  misc_feature (468)..(476): Xaa can be any naturally occurring amino acid
MSQPVDDDASPSSPIQALPTAASGAPARLPKLRNITQPNLGASGPSLPLSNSESSLPFRRANPAASLYASTLSPPGSRSMSPAGRGSPSRIFSGGGIFDTVSDRELGEAASDNPSDPLNLILKAFVPHVTICTSEDTDAMMSEKGFKQGLWELLRPFGERVQGRVSIRDSTGISRPVDDFSIRFTQLGTNIEHPSPALSTPNGNQGAAARDRKVLADVESLVERHLTFAEESYANGPHFGISTRQGLEVEASSPYHALYLRRLLSGIPIAPHETFAHPVCCVVAITSRNETPIEELRRLYEETNSGVRKLPPWVDGEYLRYYVLIHDEENDDITRSMGFFDQMKRHLGPHCHLLRLRSSQSIETDDDSIPLPRSDWMTAGEELAEIKKSEDDAEFEDPTRHIFESDATAIRTFIREMVTQSIIPTMERHVSVWNDQVASKRKGLAGTFSSLTKRFPFGSSRSSLGGGXXXXXXXXXILRKLADYAFMLRDWKLAHSTYELLRSGFAAAKAWKYQAAADEMAAVSLLLVPQYASSKSRYEAVEQIIESAVYSYSTRCMSPYGAVRSMLLPVELLRLRGGANIDGAGRLGVRLLDSKLLGTVGDALLKERLAISYLGKEGVGSWNWGNRTRKSGLWSYLAADAWLQQEKYIPSQRCLNQALETYDSLPHGHGMNKFTTANSLLEQLQRTLSEKLDLPQHEDEDGINGEGSSDVVDEESEALTDMRTRRVSLVAGAGGMLETKPLHGAEGNDDTTVGEVQMEFDETEREG

SEQ ID NO: 1543 - protein, 1190 aa, Unknown
  Kingdom: Fungi, Phylum: Ascomycota
MAMDSASEEAAQSRRAEVRGSEAGSLDHQLWEVWSKTANEFPDRDAVVSMWQPARVLGRFGHDVPASVERQEYLRWSYKELHSEASRNANWLRHLGCIPGMKIVAVLWNSAEWPLFFWSATKLGMVFVPIDPGAAADLPCLISRLNAEILVVQDEAIATTMSDVRLASIILKIQCSGPKVAGWLSIGDCSSSNLALGQNLHSQPQSLEYHKSPNRIAMMVLTSGTTGDPKICQHTHRNLMSQTCAYDPNPEDPVERWLVHTPVCHIFAINNALRAWREGGAVVFAAQSFDAESTLEALTQEKCTIMSATPTLIKSLLSHQRFPGRADIHLDLVTIGGTTITQEDIQLCRRELGAKHAIQAYGMTEGAPLISWKRLDSHLRNGYHPGAGRVLPGTAARVCRPGSRETLKTGESGELHVSGSSIISGYYGETNNSSSFYAEGDVQWFMTGDQATIDEDGIIYLMGRYKDTIIRGGENIQPAKIERLLANIDGIQVAVVGVPDSLAGQVPVAIVKLPTGIGKIVLTESVMVLGPKFALAGIYTLEELGLSTFPLTTLGKIRRGFLTKVVNRHRQNLSKLAISDLRKDEHESMVVSLIDAWEQVAVTRPERDQDVLFLADSISMLRFCDRVVRLCGKHIYLQDLVRHNTVEKQARFLQSGDQGISGVASPVGEPTPRISSEGPTLEKHSSAVLRSSIEPSDLCQSQPSLESPGPFEASIEAVIPIRSSLKRFVSGQRPQSYQIAFTFRVPGVSRQQIRRAVSQLVSHHPLLRGTLSRRGDEMLHIIPAYTDGLMEHIICYDELDTCQEALNYAGNIGGAANRTPFMLKVAILHNKEDGVNYISLTFNHSIMDAMSVIPWTRNLDLLLNDSTTGLPELTRYAHFAELHEQYSECPAAKEAVAFHAKRLRGISLLQRALWPVQRAPGWMICDDSGSEVKAERDSSREKVWHGNWEKVKAQFEVPRLSRVVHLPTLTLLEKQFEVAPSTFAKASITLFNILQTGCPHAIFTSWESNRTWPFLPKWIEEKLPPAMSIDGPTLDWVLNMTEVDIHQSIGGFLKRMGRDHLDMVKHQHAPWTDIESALQEEGAIALEASFRQAFVWDVSLLGMVVPQTDLTDFKVLEPVNRHNWADCGLFWNAFTIDPQTVYFIASWDTAQMNDLEVQGYCDMLADIMRKLAMEENWGRQIREVFTTGLR

SEQ ID NO: 1544 - protein, 558 aa, Unknown
  Kingdom: Fungi, Phylum: Ascomycota
MLKSTYKPPPAGAAQTPLPPGWSEHTAPTGHKYYYNEATKESTYRRPELPPQQPPQPQIPSLADPKVANAYLAQFRQPTGQPGNSRRGGHDGRPRPQPIDRPRRKEKIPGCEPWILVYTKYSRRFVYNPEKNTSYWRIPEKLMPGILELDKARIRNKGAEHEAKSEEHVSKKSNESVKEEDKPEANAEPEHDYDSSEYEEVEVTDDEGAEDEQETGEGSSAKRQRTEDHRQDGPVEFTEADIALQLQAMNEEYGLDPDDYEGGDVDGWAEGEGAEDFSEEDAKFLFKDLLDDHGINPYSPWEKLMEDGVIIDDPRYTALSTTKARKECWSEWSRERIAELKEQRARQEKKDPKIAYMALLQEKATPKLYWPEFKRKYKKEAAMKDLNMADKDREKAYREHINRLKLPQSTLKSDLTALLKAQPVHLLNNKSTPNNLPAQILTDLRYISLDPKTRDPLIAAYVQTLPPPPEDPNAAQQDEEARKASEARKRREKALEDRNRNIDEQRRQRERDIAASKARLRDAEREIENAMRVGKRGLQGQLADMRMQDAPVDDKAEE

SEQ ID NO: 1545 - protein, 287 aa, Unknown
  Kingdom: Fungi, Phylum: Ascomycota
MASVASPRAGRLAGKNAIITGAAGGIGLETSILFAKEGANVLMSDISEPALEKALAKVKQLVPSARVETKKADVSKEADVKALVDELDSWGGLDVMFNNAGIMHAKDDDAVNTPEEIWDLTHNINVKGVWFGCKHAVLSLRRHKKTKGSIINTASVVALVGAATPQLAYTASKGAVLALTRELAMVHARDGYRFNSLCPAPLNTPLLQDWLGDDKEKRQRREVHFPTGRFGEAIEQAQAVLFLASDEASFVNGHDMTVDGGMTKAYVTPEGPPAPAPTNNALKDSLS

SEQ ID NO: 1546 - protein, 293 aa, Unknown
  Kingdom: Fungi, Phylum: Ascomycota
MFRRSNIWPHKPTLTETTLPDQTGKVFIITGGNSGVGKELAAILYQHNARIYIATRDRLVFLELILDDLDTIKVAAETFLDRESRLDVIWNNAGVMLPPKGSKTKQGYELQMGVNTLAHFLLIKLLTPILLRTARDPATKKNSVRVVWVSSLSVDFSAKPFLDFDNMNYEGKDESQAVKYDRSKCGNLLHAIEFAKRYPESGICSVSMTPGLLKTNLQRNFTASQNLIVKLMGKPAIMGAYTELFAGLDPSITPNDKWVCPFGAQEEPRVEMMEPKLASAFWDWSEKQVKPYI

SEQ ID NO: 1547 - protein, 266 aa, Unknown
  Kingdom: Fungi, Phylum: Ascomycota
MTSIDLSTRDINVLEKIKDPESNPAAGVIIDSALPRDPNIIDASVYDRVVATERSIIQSIQKIEIELSRSRGEQSPNTAAVEGYERCMSDLDGLVSEYPNYASARNNRAQIARRLYGDAMLLSDTTTMPAPLISSPDRAEKLRVAANALNDMDTSINLLSPRTPLMPVSAQQARTLSMAHTQRAAIYMRTAKLMSQRGLDIDEGRREAHWSKLDFEEAASRDLALGGRYGNEIAKGLAVSVNPTAKLCGEMVREAMKKEYGPAYAE

SEQ ID NO: 1548 - protein, 586 aa, Unknown
  Kingdom: Fungi, Phylum: Ascomycota
MGTTDASAAAPGGSKSPKKTNKSPPRKGQLAPSPLPPPLSIVSSVTLHHNHHHRSYSRLLSSLTASLRRSLFNLFVTSSTLTRCLPDTDAKTDSTTAEASTNADAAAKPLAPPPRPAQQQGNNTPDYFTNQPGGSLSLEPNPFEQSFGGGSGPETPGGTKLPSVASLTSPSSLLPGSNATPFNWGGGSLRTGPLSPAMLSGPTSDYFSDTHHLRGGFPTPNESGLRSGLTPGGSGSMFPAPSPNSQALFNQLASGGATPSTLDFHRTALSAAAKREQTQASTTSQPAAQPTQPEVQQPAITQSQDMTNGVPAVKSEPKSFDPHDNDAANGLFMLAQGAQQRNGAPNGNHFTAAPVPAAQPHPATINPHVSPQMSSVNGGSVGSARGVSEGSNMSDESEPRPNTRGKGKRSNSATNGRKKTDDGPVKAPPSKKSKANNGGSVNGGSYDEPSDGEDDGMNNEDGPKGKMTDEEKRKNFLERNRVAALKCRQRKKQWLANLQTKVEMFSSENDALTAQITQLREEVVSLKTLLLAHKDCPVTQQQGLHGAFMSQVAEPYSNTQMNPYGMAVPMGGQPVMAGQGHQRRFS

SEQ ID NO: 1549 - protein, 351 aa, Unknown
  Kingdom: Fungi, Phylum: Ascomycota
MDGSFSDFANQGSLLDPRTHPSFDQTLAGKPSPGTPSQFLLTPSSLWDRPAFDDASMDIFADFTEASDQASDQQQTQSAQSLREAPDQTSIPTQASVPAMLKIKEESPTPTVPPPATRRLTRATSSGSQATHNSILDKASAASSEVGKVKKSRTTSKRTVKRTKAQPKDKQASKEDEMIDRLGRTEDGNQAEGQPAGEEDVRRNKFLERNRVAASKCRQKKKEWMHSLEETKTELEKQHNNLHETLNGLLAEISVMKEHLMIHANCGDPNIDQWLATEARKFVESKTRADDARRPSSSSGSGETQFSSRSSVVQYSPTSSVAPPTVPSPKVKNETFSYDYMPDDMFADDHT

SEQ ID NO: 1550 - protein, 604 aa, Unknown
  Kingdom: Fungi, Phylum: Ascomycota
MTVPLLFSNPVWSGGSTIPTTIIRNISSQTSQLAYEERLKSNITTLTTTNAETLNGVITGLLYVPEIRNNPECASQQYDFIPRNVTRRSDLPPVNYPLVAFAPWFSIECTKAYLASARRDPIRAFIFYKPNNSSNKPQDVDSPVWNLDDNGLWQRMNPFPIFAVSGQEGQKITTKLSHYSGNISEVPHGDEIQSIYSTNPKDYVRIFTELTMEDRSTGPALWAYFLIVIGALLLIFTSVSLAMHLIQRRRRSSLRKRVESGEVDLEAMGIKRVVVPPEHVKSFPLFTYQAEPDGPPTPMGPGGGPLGSRSARASRRQRRAEQAAASDAASQAGGRSVRTLRSKRSSVACSVDTTATNDQPKCQICLDPFEHRVSIIREMACGHIFHPECIDEYLTKNSSLCPICMQNMLPAGYSPKITNAMVRRERNLRRLRQRINDDDASLESGYTKMDKLKRLFKSSSAEDSPSESPPVALTLVQKPTTPPAPIDTRQESIPEEGTASSPDSEAAITPSNDAQAGTSRPKPSPPPKPPKPRTRKTRPRALNLLPTQPEDGELKATQAVGRKSPSSFARQRMREIAHRNAPIDDPDRQSIWRAAVNKVFPGLT

SEQ ID NO: 1551 - protein, 523 aa, Unknown
  Kingdom: Fungi, Phylum: Ascomycota
  misc_feature (83)..(89): Xaa can be any naturally occurring amino acid
MKPSAPSIRIVATPFVVSATVTYRGALRRTPRWRGFATTTFVRSANAPTRGGSKLYRDADAAVADIQSGSTILSAGFGLCGVXXXXXXXVSNNAGQEEKGGLALLTSSGQVSRLVLSYLGNNKVLEKKYLSGDIAIELCPQGTLAERIRAAGAGIPAFFTPTAAHTYVQDGKIPMRLDSSGAVLESGRQRETREFNGRTFLMETALPGDVAILRAWKVDKAGNCVFRYTTKAFGGIMAKAAKLTIVEAENIVEVGEIDPNDVHLPGIFVDRIVPSTAEKRIEILKTRDAELQKDGASKVSEAEKKRLRIAGRAAKELKDGFYVNLGVGIPTLAASLLSEDKHVWIQSENGILGMGRYPTKEEVDPDIVNAGKETVTLIPGASCFDSTESFGMIRGGHVDVSILGALQVGANGDLANYMIPGKVFKGMGGAMDLVANPDNTKIVVATEHVAKDGSSKILNQCTLPLTGARVVSTIITDLCVFQVDRAQSKLTLTELAPGVTVDEVRSKTDADFEVALDETTSYE

SEQ ID NO: 1552 - protein, 311 aa, Unknown
  Kingdom: Fungi, Phylum: Ascomycota
MDVATEFLLGHSTSELQASALRSGNNQFVSDYLLCSEAVVKKLRLGPLQFLVGSSESDEAKARVFAYIDKFLEEASLLKDEDSRPVYDVLRELQKMAPDHQSLRDQVLHILLASRDTVACLLSNLVFALSKEPAVYQRLRREVLRCAGEECPNIEQLHSMRYLKWCVNESALRLHPVIPTNAREAALDTTLPFGGGQDGNSPLFIRKGMLVMYNVYSMHRNPKVYGDDADRYVPERWESVRPGWDFLPFNGGPRICIGQQFALTETYYVMARMAQRFATIESRDDREWQEREALAITCRHGVSVSLTQATH

SEQ ID NO: 1553 - protein, 189 aa, Unknown
  Kingdom: Fungi, Phylum: Ascomycota
MAGVFFNRLLASATRSTFTVAFRPATSTSTTTLRSSPILRQLTLSPQSTSAFSTTAPLSTTLNQVLRGQRKGKRARHAVSPALSGKNCPQLKGVCLRVGVVRPKKPNSGERKTARVKLSSGAVITAYIPGEGHNIQQHSVVLVRGGRAQDCPGVRYRLVRGALDLGGVASRTTSRSKFGTKKPKSAQVG

SEQ ID NO: 1554 - protein, 630 aa, Unknown
  Kingdom: Fungi, Phylum: Ascomycota
MKSFFTAHVWAVASALLSVSHAATVKYDFTVGWVTANPDGAFDRPVIGINGQWPIPTIDANVGDNIVIDVHNNLGNQSTSLHFHGLFMNGTTHMDGPAQVSQCPILPGESMTYNFTINQPGTYWYHSHTISQYPDGLRGPLIIHDSEFPYKDKYDEEIVLTLSDWYHEQMQILIPPFMSKGNPTGAEPVPQAALMNETQNLTIHVEPEKTYLFRVVNIGAFASQYLWFEGHNMTIVEVDGVYTKPAEADMIFVSVAQRCSFLVTTKKDASANFAIVGSMDTTLFDVLPPELNYNVTGWLVYDDKKPLPDPQTVDSLDDLVFDDMKLVPYDEMERLPEPDRTVQLDVMMDNLGDGANYAFFNNITYKSPKVPSLYTALSAGELATNPTVYGEYTHPFVLERGEIVEIVLNNLDSGRHPFHLHGHHFQALYRAPEEGGVFNASETKESDLPQVPMRRDTMVVWPNGNIVLRFRADNPGVWLFHCHIEWHVTSGLMATFIEAPLDLQKTLKIPQDHLDVCTKDGISTSGNAAANTVDFLDLSGQNKPPAPLPAGFTPRGIVAIVFSGVAGVLGIIVVAWYGLSGSAEASRPTDFGVVSQSEPQVPGEAASRESDGSDPVAAAKPEGGPQVAAQ

SEQ ID NO: 1555 - protein, 90 aa, Unknown
  Kingdom: Fungi, Phylum: Ascomycota
MASAIRQLIPLVIAILILSGAAWIGWQIYLSVAKIRDTASERMGKKNVVFTKDGMRVGVKHIHNEKYIDTTQSWVVKAWNMGETREDEDL

SEQ ID NO: 1556 - protein, 723 aa, Unknown
  Kingdom: Fungi, Phylum: Ascomycota
MPPKKELRGPSNFCEWVVGTTIPTILGPEKKSKKQRSTPRDVIKIQVTTDDESGEDTLKISYPRNRGRRKKAASKDGTKPKKVRFEEVPQKSALKKITKAYTISESSEENANASDSSADASSDSSGPRMVLIPEENIKVHAVQVTEDSKVEESSGDESEVDDDPSPTCKCKSCIRGRQKLARRKRKAASCEKLPSEESEDTSNTETDDLDEPENAKENGKTSEKKDKDTPKRKGKKKGQKPQPVTVESEDSESEFRDDANNESTTSEDGGKSKSKKKHNKTKQAEQEDQQQKSDKSEEQVQHEDCQGDAEKEEKNKKKSRSKGRKAELSDAKQKKDKEDSKSYPEAMPGPNPRRPNLIEPIRAEVIQTERVIESQEDPPPNAYYDHANNVLRVYHGPVYGGYHNKGLYPLRDPKNLPLPLGTAHPTQNPYFHGFGNGPPQPQPLAQESKPGAQWPGGMWPGMQWPYAPPFAAGPPGPVLAPEAPEPPPPPPPVNGSKGAFSDRAGRNNVAPVGVEVSFQRPMALNMRSRELTHALKDGKPNPYYSGSKQHSSPFRSYTKTSPASHRLGAASKVGSRQASASGWNNDGAAGSVKQGSQTGHWGQSNTGGSRTQDAGGWGGSQNQQQTDTWGGAQQEKTQQNDSWSGAGSGGPPDQTGQGGWGKTEEQQNQGWGGEQQTVEETNETTPQSNVMPGTFESAGWGDPTMAADTKGAVEQDDLPISTW

SEQ ID NO: 1557 - protein, 196 aa, Unknown
  Kingdom: Fungi, Phylum: Ascomycota
MPRTALFVVDIQNELAGDPQTEIPHAARIRAAGDKILSAARNLASSAPEGKQPALIVFVQHEERPEQGTLVNGSEPWKLVFNPHDGAKDEILVAKTTRDTFESNPHLAEKLKEQGIDSIIAFGIQSECCVQETCKGALSAGLGVTILRGAHSTYDDKQKPAVDIERGVEEMLQSRGAKVVPWEDAVARWQEAGVVC

SEQ ID NO: 1558 - protein, 603 aa, Unknown
  Kingdom: Fungi, Phylum: Ascomycota
MTAFIQRRSRPSNLLILASATVVGLILAILYTSLYLEQGAYDRLIPKTSSHGTAKVEIPEIKVSKSSHAQSQIVGVTDSTEVTDSSDSSDDAFPDSDLVDPNLTDGNSAAGVTLSEIKYDVDSGDRRMVLIIPVNSPSPNLCKVMLSAVAMGYPMPIIINWGITPQQMFPDRKNVGSHQLKIAGLLKFLDEMTHKSTKAEDRLADDDLIVMVDAFDIWFQTPPDVLLRRYHESNRRMNERLRAQWKGKPEDLPFKQSIVVSATKRCWPADGPSELYCDELPDSDLPEDLYGKLTDKETGNIWKTLHNVRPKYINTGNVMGPVGDLRRYVSRVNEKLERTTALNDNFKFKSDQAFFGNIFGEQEIYRKWFLQQDPSLVSGDSLPLMLTRDMEYHVGLDYSQNLCLPTTNEENDGEFVALGDSEHIRNKSESLKVGSVRLTGVPKDIAMSPNPLAILPNIKPTPGWDELPLYADYFTTSVPAMLHHNTNRGEGKARIKSWWDRPWFFPYLRDLVLARTQPDKEQKPLGEFNAKDGKKVTYWAPKSDMTKKQPRIFKSGKASKGMPFGEWEDMCLDPKYPDVHWSKEVFRDGKGGLNGEGAEDKKE

SEQ ID NO: 1559 - protein, 707 aa, Unknown
  Kingdom: Fungi, Phylum: Ascomycota
MKESNYTGGTMPQNLSQLAEITQKATGGGLIPAKHGHFNVGIIGAGAAGLFTGLVLDWINDTIEKHLGPGHIKITYEILEAAGEERFGGRLYTHYFDKDKVHDYYDVGAMRFPNNDVMDRTFRLFDMLKIKKGNLGDRKSASDPPVLVPYYLADDNNVCPTYFNNIRKVGKPWNGAVDPFELNKGMAKSDQIPEEVTKADPSHLFEEAIKGFIDHVKEKLDAYAKQTLKDEKELWDLLQKSDQMSVRQFLLSGKNPLGIKDDPENPQKIPDGPGYSYNTIQWLETATYGTGWYDQSLTEAVLETLDFKIPDKTKTNKYWYCVDGGAQKIAEAMRDQLKDKSAIKYNTQVVGIDATVQLNERVTKNMRLDLKDTVTRKPLEAKEYFTVINSTTMGATNRMDLSKAGLLWDTKQAIRCLGYGASCKVGIKFKSAWWRKAPYNITKGGIARTDLPLQVCVYPSYNIDNEDEEELKEVLLRDLAYLHADDPKDEENLAKHLEIISAEYHEHHAYDWYHDPHMAGAFAYFGPCQFRDLYPAITKPNAFGQLYFVGEAASAHHAWVVGALESVVRALWFMFDTLHQGSKNDPALQDDDGNKGGYRPYLWALQLLQCGSVKDGDNIIPRSQEPLPFYPLPAEMPEHREVDCVCSGGQGAPEKTGDLLDHPQLGKGGNEGELSYGAAVVALSMVESVLGELLKPGVPPNMAPLTS

SEQ ID NO: 1560 - protein, 352 aa, Unknown
  Kingdom: Fungi, Phylum: Ascomycota
MPHAAAEQLQPTIAGVHLRVNDGPLDPSSVRPLRASHPSEPLAALRERYAADGYLFLKGLLPRDDVLAARAAYFTSLAPTGVLKPGTAPVDGIFDAEGASAADFPGIGAGSVKNARPGGSSSARSVLFTDAALRAHTEPWYAGGGSSEGRDGSDGSKDGAAGGRGTRGFARHPALYDFVARFSSWGEDTLAVRRSLLRNNTPGNRAIGVHYDQSFMRYGEPTSVTAWVPMGDVRLEGGGLIYLEGGEALGAQIEDDFAAKARAAGMSDEETRDAFNANMMSTGFLSDGPAAFGRQHGRRWLVAAYEAGDVVLHSPHMIHASTINDDPDNRIRLGTDLRFVNSARPWDTSLGS

SEQ ID NO: 1561 - protein, 258 aa, Unknown
  Kingdom: Fungi, Phylum: Ascomycota
MPPRIPTEADFSDLSKTLPHTLHFPSPREATTSIMILFHGLGDSEGPFHNFARSISLPGVLAISVRGTSPLPPSLLPESAVDGKGHFHWGDDINMDPATGELDDDPGFEKASELVMNKLVKKVLIETCGWEWTDVLLFGFGQGGSLALGIAARLAAGERVTDITDGAGKESARRCKGVLSIGGPLPQSMVSTVSSRQKSSTSVLVCQFEPEQVEAARREFADVRVVNWKRRDVAMPRDREEVLPLMKFFADRLNSGWS

SEQ ID NO: 1562 - protein, 713 aa, Unknown
  Kingdom: Fungi, Phylum: Ascomycota
MDQQGAAGQRGRSPSHGQLHANNINHHSHTPSPSASFNAQDPSVGLGLGLDPNSQQNLNAFGANAYLSPQQQQQQQQAYSQNNVSDPAVFDPNATFGQTTGGVGDPTLSFDSSQSHTAFLSQELNDTDFSLFPSGGQGDNFDTPLFDQPSTLNPNDMNTMAAQHQSPTPPHLLQPDAPQPGSAHQSPSFNQHQFSPPGTHSRNVSLGPEAALLPGQIGDWNQPQFQGHRRTPSEYSDVSSVGHHSPHIVSSDTFDDPTGHSPLQRPSDGSLYQDVLQIGQFSLSDAQGSPALHGRSPSHSPAISPRILPQQMPDMNQQQGFGLGSHNNGFPAVPYTSIQVTSESYSNQSLGGGSDISQMAAPAINVTYAEPNAKANSFNQIKGELDQDSLTPPDRGRPRSRPRSVTDPFAPGTGLVNRPNNSSLSPMGPSLSPRSDTSRSLSPSSGISPSRRRQSTSAVPNNVIALRLADPEYQNSQDAGSSKRVQKHPATFQCTLCPKRFTRAYNLRSHLRTHTDERPFVCTVCGKAFARQHDRKRHESLHSGEKKFVCKGDLKTGGQWGCGRRFARADALGRHFRSEAGRVCIKPLLDEELMERQRQWQEQRMQQNMQNLSPQPGLGMDNGSGYPMDPSGNQWLPAALLAQYPALAQVNWSAPEMSSGMEDDLSGRSSFDASDFDDGDDGGYVSGPGTGYGEGGLGQNFGDIGYASDFGGR

SEQ ID NO: 1563 - protein, 302 aa, Unknown
  Kingdom: Fungi, Phylum: Ascomycota
MGWLPSFLGGEKSSTTIDPELRDFLNKEAPTRYTPAAPTTSQATAAAQSSPAKSIPSSSADEATEPKVPRESLYQDGRYAHLWKTYQSKTQIDAEHTSEHDKMTDLLEGFKERKVALQQIALENCAEQQEEWSNCMKHGKIEDQLQMCRHQVRRFERCYTMQTRFLRALGYGSNLGRPASVDEDIQMHADALYRRLLAHEAEAEEAKKEGRPVPVFDPAVPGVSKPRVEPPQDQQLRWQEALNKLPEDEREAEKAALLADWQAKSHLAAQVKGMKEKEKKEREASGKPSFGDFLGSLLGGGK

SEQ ID NO: 1564 - protein, 308 aa, Unknown
  Kingdom: Fungi, Phylum: Ascomycota
MRSATLLPFLITLGASHSGLTSKRGLGLISSTPDSDISFLTSNASAISWYYTWSPYAHPSISPDVVFFPLLHGIDAAEDSELHTILDRAPESSTHILTFNEPDHGTDDGGSDISPEDAAKAYIEYIVPLRKGKDGGRTWNISHPSVTGSGKGLDWLRDFNSSCYEMDSENGCPTDFIAVHWYGDFAGLASHMGVLRDFYGNGTNSEDDIPPMYITEMAQDDANEWTGDGVSLLNDDGGLTTLGAEYLGGEENGFKEGMGGGDEDEDDAGVGVRPRLLLMTVLTGLVMMGELGLTLGVNVAQRYHRLDA

SEQ ID NO: 1565 - protein, 590 aa, Unknown
  Kingdom: Fungi, Phylum: Ascomycota
MSSHGRKVRVKKLSVKTPLPVLREDQIDPSEYEALTTETQIVTGVEQAEENEIHLQSILKDAGTSNDQEIPVPPPQPSDVNYDYLYPSNYTKPSSYLRFSQTVEECISCQYDMTIEDNEFLKQYNSKPPAAGSLSEDDFERVMEVFEDTAAEQTPFASVDNTVVGYDMMVPSLHQLGSASILQHAKPVYEYWKSRRQEMGNKPLHPTLKFETHQESDDTDPYVCFRRREARQTRKTRGRDTKVTETLKRLRRELEDGRQLVLLAFEREMLKRELLHMDRAVFEERARLKHVKTRLGIKDADDDLINQKPQKRKAAETPAVQRPSGQHMRMPVRPDGRTMDQDLILLSDKLAEKENELNADIEMKVQNHRKWNLNHIDLTRDPLSPVQEKGEELKFRPAKTQYLMTPPASSASDDMDVDDDAPEPMQLDKDPGQVTVKDKSFKQTLPIVQFKAGGSGEFRGSQQPSFRRRIGRQGRLWIDRRGLASPPREREDRRSDRWRYDSDSDDDEPAVYEVDPFDTRALKFRATIPLSPFIFGNRRPQPPPDHGSQQRPVPVPVPVPVPVPQLPAPGQQHAVQVPQAPPQPQVPAAS

SEQ ID NO: 1566 - protein, 518 aa, Unknown
  Kingdom: Fungi, Phylum: Ascomycota
MGSSRRDEDSSHNGGSQLPERPPPYETTPLLKGVLNAGNLAPDGDTEASALLPQPVPHPPQDDASQPLPKFQLALICYARVAEPIAFFSIFPFIAQMVQRNGHLPSSDVGFYSGLIESLFSATQMCVLVAWGRLADRMGRKPILMISLVGMTIAPVLFGLSRSLGEMILFRCLAGVFSGSSLIIRTMIAEMSTKDNQATAYGWFAFASNVGIFIGPLIGGALADPAEQYPKIFKGIPFFENYPYALAGAVPGLIAASSAVLCSFFLIETLGKNDRKPTGNGAAASAESEEDAAKMSMWQLVRSPNVGTVLLAYGHVMLLAFAFTALVPVVLYTPVDLGGLGFSSREISLFMAVNGASQALWLILIYPRLHKRFGTKGVMWGCAVAYPWFFVSYIGLSSLLRDGSRPAITWFWILGSLVAVIGPGVSMAFTATQLALNDASPSTHVLGTLNAIAMTMSSGIRSFVPGIITVIYAVGVRGQILNGHLAWVILTPIAAALLFVVKALPRDIPPSQRQNGSA

SEQ ID NO: 1567 - protein, 421 aa, Unknown
  Kingdom: Fungi, Phylum: Ascomycota
MRIASRTCVDKLAARKLPEALCGLEQLVAGPAGTIVGCKRGNGLPKDREGDDVGGSAVGSSCCTNPAKAQRRRVPSSPASLHYQPLTGAGDEAAGLIQPNYWESTQRQHWLFTKDQLASMRQKLDDDNAEWVRSYPLPEQRHLAIFFNQQLLRLGKRLSVRQQALATAQVYLKRFYCRVQIRSSNPYLVLTTALYLACKMEEAPQHIRLVVTEARQLWQDFIGLDTSKIGECEFYLISEMSSQLIVHQPYRTLTALRPELSMTEEDYQMAKSVINDHYMTDLPLLHPPHIIALVGILLALVLRPIAPQSGGQGSTMSSSAAAGLAAAQAALHAAHMGGSGSGATGSSSGPGDGKDRPQTETRVHRVQMFVSWLSDSNVDVTAMVDATQEIISYYACYEAEYNDKNTKDQIHRFVKARHLDK

SEQ ID NO: 1568 - protein, 366 aa, Unknown
  Kingdom: Fungi, Phylum: Ascomycota
MLYLKALTAVTGLVASATAATLPRSFSQTKDNGFPKPSAQEILGISKEAGGKLPPGSLPTGLSPTSITTLQLIAFNELFEVAYFSSLLSNLTLNLDGYQIPSQAQTIEVVKAIRAQEQLHALGALAILETNNAFQPSSCEYAAPVANFDDAVNLAEVFTAVVLGALQGANFNFANDAAAVPLVPLISSIIGQEGEQNGAYRQFLQRIPSESPFLTAVPAPFAFSALQGFVVPGSCPYPLSNINLPIFPPLSVNGGPVALLQPGDQALTLSADLSSSEAAKAYVGGNGEGLFATFVTGQQAPYSVPVQSVTWSGSVVTFQATFPYTDLVAHGFSHVSLTTSNNFTDVNSIPGATLAAPGVIQVNNAV

SEQ ID NO: 1569 - protein, 741 aa, Unknown
  Kingdom: Fungi, Phylum: Ascomycota
MAPGFLKELRRRSRASFRTDHSTDTSSEGAVSHGTALSSGSVTPPSIAQQSDPALNLQLKSDSDPQSSQSQTSQARPALGNQSSNSSRYSVSGMSGLGSPSSNGRQSLPVSPYAPRIHNLTENAWVYQKVLLIYGSVGEQAIDGTVTASRLDDSFPPVSWPVCDSHFKALLYLQPGRNRLRFDFSSPKLNNNSSTNPIHSSFLTIHMLPPLNAPPLQLAILLGKDSPGTFDATPARAEREGNGLETAIRKFRMAAYLWQAFTAEQMWRNKFGRRSFRFEEEWATGSANYRDLEQGTMRSEARIHIIRCDKTVAELRDLNKAQQHQPATDKNALHKIAMDAARDYFKPMPGQTQYVSMLLLDAHWDTTEKVVTGHAALGSGSGDIRLGIFGSHCLHSYPSSFEEVVPAFTDCTPTDLNYVANDCNDAGSSWESANIGIGAHLHEVGHALGCPHQESGIMLRDYVVLNRSFVPREAYSTRTQTKGGLVMQSDECGWHRLDLLRFRSHPTFRLPNDPSMNSDASVQAFRIEGGSVMAMAATGISFVEIFAEDEDTCHAWMEFPLDYERLQRQVALNESELRAKLPPAKRKGVMKISVKCHGGGSITLDDFSQFASKDSTVKIPGGPLGGGTAYKSRSLGHSKMEGTQPQDLIFTSTTRQDRVMSRIVVYHGSALDGMEFVYDDETTQLFGNKKESGDAFELDLRRGEYITGFFVRAGFWIDGIQILTSTGRRSPVYGNAHGGDG

SEQ ID NO: 1570 - protein, 309 aa, Unknown
  Kingdom: Fungi, Phylum: Ascomycota
MKVQHKPLPALYTVYVLRSTVRHASLYIGSTPNPPRRLKQHNGEVKGGAVRTSREKLRPWEMITIVSGFPSSIAALKFEWALANPNLSLHIPSESRLTVSTKKKANGRPRRPPLSLKSVMSNLHLLTSVPSFARWPLKVHFFASEAHKAWLNWLKASGKTTRPGLRIITDFTPPPHTATESVTQGIDALPLDYSPLKDYVAKAQDIVGFEQEGQCVHCQQPLESGKGLQPMCPEPGCEAMGHIDCWSQHALQGSEANSVLPDMLQCPACHGDIRWDDMMKELTLRIRGGAEVEKLLKKTKRVKQAENAT

SEQ ID NO: 1571 - protein, 747 aa, Unknown
  Kingdom: Fungi, Phylum: Ascomycota
MASTSPHAPVAKPIPAPPSPDWMCDENWELLWCLLDTMMPSITSESAATDPYNQLVLSDKEFEDAVDRVSTALANPPSRADIVKYLNQRPSLDEAFRDDVRMLLGNSPARLQLANALTFLRTRFGSLMLTWCWSSLDQYPLGVREGVLRSWRVSNMRALRNLSKTLATVNAKANAVYNRFLHQLAGYTDAPKDWRPVEGYEFIFKQLEAGSEPHIIETDVVIVGSGLGGGLTAKNLAEAGHKVLVVDKGYWYPPSHLPMTQAAGCQLLYAAGGTQISEDGGLVTLSGSTWGGGGTVNWSVCLNTPDFVRTEWADAGLPLFRSSEYDECLLRVNKLVGATTEGLTHNHQNRVLLKGCEKLGWKVGEAAQNTAGKAHACGQCHLGCGSGSKMGPTLCSLPAAAKAGAEFMEGFKVEKINFAEDGVTATGVEGVWTARGPDGLVHTPANQRLQRRVIVKAKKTVICGGALYSPLVLMQSGVENPHLGKNLRLHPCNIVTAVCKEETRPWEGTIISTYGSEFDNLDGKGHGVKLEPVVSIPYALMTPQMWNSALDSKLLELRYPHMIGFISLVRDRDGGEVFPDPNTGMPRLKYEVSEFDRENAMVGVQALAKLCYVAGATEIRPCIAGVAPFITDQSKYGSSGSPLDDGKKVKDPQMEDPRFAAWLLELRQMGNAVPEAAWQTAHQMSTCRMGATAEDGVVDMMGKVWGRKGLYVADSSVLRSASGVNPMITTLACADWISRGMVKEMAG

SEQ ID NO: 1572 - protein, 502 aa, Unknown
  Kingdom: Fungi, Phylum: Ascomycota
MFSTRSLAMTTTLLQKLSLGVALFGTASHAIDVQWNSKDSIKEAAATAAYGLVKFYTGNNTGDVPGNLPAPHFWWEAGAMFGTLVDYWDMTGDESYNNITMQALIHQAGKDRDYMPENQTLQMGNDDQGFWVMSAMSAAEKRFPDPPEDEPQWLGLAQSAFNEWTGRWDEEHCGGGIRWQVFTFNTGFDYKNTISNGCFFNTASRLARYTGNKTYAEWAEKIFQWQLDTGLINDNWDVFDGRHVLQDDSCGKIDRHQWSYNAGVYLVGAATMWNHTEDEKWRNRTAGLLNNTMDKFFTDQVVYEQYCEPSGGCNQDQRTFKGYLLRWLAHTWQVAPFTRDAITPLLRKSGEAAAAACVGPAMENFKGHDGTACGYTWLPNPQGPFDGKVGVGEQMNAVDAFMYNLVADARPPVTKNDGGTSRGNPSGGVSDDRKIHRDRPMTLADKVGAGFVTAILVAGMVAFATCMIWEEKHVLQAVPPLQGSKRASKLPAEQRGGGELGQ

SEQ ID NO: 1573 - protein, 497 aa, Unknown
  Kingdom: Fungi, Phylum: Ascomycota
MTMLTVTQPTSYGHKSVHDLPTPPSTSRPSPPPAYQEQPHRNFSHFPRSLEHAAQPMSAPHRGLPPPAAMGLAPQQPTSTAAPPQPVHQSHSVSQQPPPPTMPQHSHVHSQPPGHLPPPPQQWQGGEESMKSWLAARAEEEKTKQEEAKIRQEELRLEQRRIEGDILRSSLSGGIPPALIPLVFAGMGNSGGAVSKAAFEWAQQYLTTSSQGHHPQLLPAAQVPVSPDHQRDFSSQAGAPYGSSTAGPAAGPQAQGGFAPHAGSPTRPRGQTLSGPLSRAPSGLSSFSSGGLQPGPGQSAHQPNSHGHAGPGQQEQALFFHHWQPPGTHGGSTSNPPGTPSGEVARKRKAPGSQPSSGGASDMRLRSPPLLAYSNTGDLASGRRGHKRQRSDMSWRLSSPGQGDWREQRERRRKSLSPQRESTDRMGRTVIKDPEMAMDQYHQMRAPPRHPRQREQESQEGTTTYPRHASEHGEDVRRTPPTASRRDDEHGQGGRPE

SEQ ID NO: 1574 - protein, 336 aa, Unknown
  Kingdom: Fungi, Phylum: Ascomycota
MESESPVAVFKKRGAKGRSNIRKRPATPPPASHSDSDSDGDYSSSEDESGRRIKRRKRTAVVTAKSTLNKADDKDLTASAYTADRMTAVTSANDATKQSNWYDEDAKDAMSAKNLLGSSKFATNSTSSSDGLYKGLSNQTSFIQKNPDAPNRTVGPVKAPTNIRTITVTDFAPDVCKDYKQTGFCGFGDNCKFLHDRSVVQQGWQIDREWEKVHKGKTNLGGTVVASADRTKTDATNGEEEEDKMLEKIPFACIICKQSYREPIITKCGHYFCEPCALKRYRKDPTCAACGAGTMGVFNSAKRLKKLLDRKREREAKRRQEALEAGEKLSDEEGDA

SEQ ID NO: 1575 - protein, 1900 aa, Unknown
  Kingdom: Fungi, Phylum: Ascomycota
MASRLDRLVTRSILETGSTKLIRDTAVNQLADWQKQHPDELFNLLSRVVPYLRHKEWETRSTAAKAIGKIVEHAPLFEPNSDGSPEPSKEESEFQKKEEPVAENGHVKKEEEGEPGLKPLDDSFGLDQLNVQHIIKYGRELLRGGVEYNLAALEPQARLEHQRKTLPGRLGLLGRRLEDEEIAVPIDQSAVPMTPADQPNGNGLSRSDPVNAQSQGTEESHLSSRQLNVLKRKRKREAMKASQGKSGFGDLSLRRSGTAGSDGFGGEDTPMPDPESKKNGKMDDYFNLDRPTDIDEDSKVVSEFKGPVLPIKSELETEDPQDTVDWPYERLCEFLKVDLFDPSWETRHGAAMGLREVIRVHGAGAGRSRNKSKAVNDALNRKWLDDLTARLCCVLMLDRFTDYSSDTSVAPIRESIGQTLGATLKHVPSDSVYKIYKVLYRMVMQEDLELERPIWAVGHGGMVGMRYVVAVRKDLLLQDSDMIDGVIRAVMRGLGDLDDDVRSVSAATLIPMAKEFVTMRPGSLDELINIVWESLSNLGDDLSASTGRVMDLLATLCSFPEVLDAMKASAAKDEERSFTLLVPRLYPFLRHTITSVRLAVLKALLTFANLDAEASQGWLNGRILRLIFQNLLVERDRDTLNMSLELWTALVRRLAENPTSLAEEFAPHVDPLMQLTLHPIGISRQPIPMNAGLFQKPSGGSYSVSVPVPSRKMSSPDPADRASKRRRKSAKVEDHAPAALTHDVDGAMIQGDVDLVGHDVLVRSRVSAAQAMGLIMSLMPTSSLDDFDALLIPGFTSAYSSSQLTACVVVDEFAKNRPAESEQARYITHLQTIVESERPTSYRDLVNYIQRVRAQCTQLIHMFRDHGKVSSSRLPILPVLVQGEPEAGPTAFSIVLAEKCVGEDYEKMRKAMPPGQRLIAGQQLAEARDTTAATIAEAQAAKTARDIRVKAAAACAIVAVGTLPKKPSPLIKGIMDSVKSEENQQLQGRSSDTIAKLVQLFSDKGRRGPADKVVANLVKFSCVEVAETPEFPVHAEKTSCILSMQKEEDRVDHADAAKWAKEAKAARITRRGAKEALEILSKTYGAELLEKVPTLRTYMEEPLTKAFSGDLPADAKDPEQTFGQEIVDAMSVIRTMTPTLDEALHPFVMDLLPLVIKALHSELSVFRYMAAKCLATICSVMTVEGMTALVEKVLPSISNPLDLNFRQGVTEAIYHLIAVMGDAILPYVIFLIVPVLGRMSDSDNEIRLIATTSFATLVKLVPLEAGIPDPPGLSEELLKGRDRERTFIAQLLDPKKVEQFQIPVAIKAELRSYQQEGVNWLHFLNKYHLHGILCDDMGLGKTLQTLCMVASDHHQRAEEFAKTQAPDCRKLPSLIVCPPTLSGHWQQEIKTYAPFLSVTAYVGPPVERKAMKDRLNDTDIVITSYDVCRNDAEVLEKYTWNYVVLDEGHLIKNPRAKITQAVKRLASNHRLILTGTPIQNNVLELWSLFDFLMPGFLGAEKVFLDRFAKPIASSRGSRASSKEQEAGALAIEALHKQVLPFLLRRLKEEVLDDLPPKILQNYYCDLSDLQKKLFEDFNKKQGKKLQAEAGRDDKDAKQHIFQALQYMRKLCNSPALVMKPGNHLYDDTQKILQKQGTTIEDVAHAPKLTALRDLLVDCGIGVEGGDSSDPLYQPIKPHRALIFCQMKEMLDMVQTQVLRDMLPSVSHLRLDGSVEANKRQDIVNKFNSDPSYDVLLLTTSVGGLGLNLTGADTVIFVEHDWNPQKDLQAMDRAHRIGQKKVVNVYRLITRGTLEEKILNLQRFKIDVASTVVNQQNAGLQTMDTDQILDLFNLGDSGPSLISDKPQNNLEGREEDMVDVETGDVRQPGKKAAWLDDLGEMWDSKQYEESFDLEDFMKTMG

SEQ ID NO: 1576 - protein, 1095 aa, Unknown
  Kingdom: Fungi, Phylum: Ascomycota
MSLLPADAHQELLQLLQALQSPDNTARAQAEEHLHNSWTSTRPEVLLMGLAEQIQGSQDNATRSFAAVIFKRISSRTRKNDAGTNVDLFFSLPNEQATVIRQKLLETLATESERSVRNKISYAVAEIARQYIDNESQWPELLGALFQLSQAPEPEKREVAFRVFATTPGIIQKQHEEPIIQAFQKGFRDDAVIVRLAAMDAFAAFFEITPKKAQVKYHGLIPDILNILPPIKDSQDSDDLSKALLALVGLAGVSPKMFRSMFNNLVQFSISVVQDKELDDVCRQNALELMATFADYAPSMCRKDPSYTNDMITQCLSLMTDLGEDDDDAAEWLSLDDPEQDESDQNHVTGEQTMDRLANRLGGQSILGPTFNWLPRMMTSMAWRDRHAALMAISAISEGCRDLMIAELSQVLDLVVPALQDPHPRVRWAGCNALGQMSTDFAPTMQTDYYDRVLKAIIPVLGNPEARVKSHAAAALVNFCEEAEKSILEPYLDDLLSHLFQLLQNEKRYVQEQALSTIATIADAAEAAFSKYYDTLMPLLVNVLQKDNEKEHQLLRAKAMECATLIALAVGKERLGQDAMTLVNLLGNIQNNITDADDPQAQYLMHCWGRMCRVMEQDFLPFLDTVMPPLLEMGAAKADLQLLDDEDQTDVAGEDEWHLVPFKGKMIGIRTSTMDDKNRAIELLVLYAQVLEGSFAPYVANIMEKIALPGLAFFFHDPVRYTSAKLIPQLLASYKKAYGPNSNELAGLWNATVDKLLEVLTAEPAIDTLAELYQCFYESVECLGKNCLTADHMNKYIDNVHSAIADYKDRVAARDEDKAAAGPDDAEDEEEELQLAIEEDETLLSDMNKAFHSIFKNHGAAFLPAWERLMQIYTGFLNSDDPTQRQWGLCIMDDVLEYCGPESIRYAEYIADPLIKGCKDSSAAIRQAAAYGIGVAAHRGGAPWQQFLGNSMQSLFGVTQVPEPRNEDNVYATENACAAIAKILHYSPNSVGDVQAVLGPWIETLPITNDEEAAPYAYAYIAELIDQQNPVIMNNASKIFTYVAQALEADTLQGQTANRVVTATKVMLTAANVNPAPLLQQFSPEAQQTIMTHFA

SEQ ID NO: 1577 - protein, 1469 aa, Unknown
  Kingdom: Fungi, Phylum: Ascomycota
MTQHTDKELELQAPEPAAAAIAPTEVERRDDAGYPTSARDVDPRKSLEEQIEPADDDDTTQDDEKVVRPTLTQTRSHATTMSLATSTGPVTKQEKPWYRNLNPLRWGPIPSIPTEPIVSREAKAGFWSKLTFTWMGPLMTTGYKRPLHQNDIWSVHPDRAATPLTEKVRTSFKRRAERGDKFPLFWSLHEAFFFEFYLGGVAALLTVIFQVVAPFTLRYLIQYAADAWMANELGTPEPPVGHGIGLAIGITAMQVLQSFSVGHFIYNGMMVGGQSRGVLIGLIYEKAMIISPRARAGDQTKVAQTPQEGEKPSNKPKKSKKNPDPVRDGLGWGNGRIVNLMSVDTYRIDQANAMFHLVWTAPVAVLITLALLIVNLTYSALAGFALIVVVMPLLGRAVKSLLSRRKGINRITDQRVSLTQEILQAVRFVKFFGWEKAFMNRLGDIRRKEIRAIQYLLALRNLINAFSMAMPLFASMIAFICYSLTQKNMPPAQIFSSLALFNTLRIPLNLLPLVLGQVADAWGSMVRVQEFLLEEEMEEQILVDHKIEHAVEVRDASFTWERTRTQESETNEKAQKAKASPTTESASQQNSPSEGSALVDEREPFKLNNLNFDIGRNELVAVIGGVGSGKSSLLGALAGDMRQTSGTVTFGATKAFCPQYAWIQNATLKKNITMGEEFHKEWYKEVIQACALQADLDMLPHGDQTEIGERGINISGGQKQRLNIARAIYFDADVVLMDDPLSAVDAHVGRHIFDNAILGLLKDKCRILATHQLWVLRRCDRIIWMENGTIQAIDTFDNLMQGNAAFRTLMETTDSEKKESEDDIQNKVVDAVPDDKEKDKKNKKQAALMQQEERAVSSVPWSVYGAYIRASGSLINLPIILFLLVFTQGTNITTSLWLSYWTSNKFGLNTGTYIGVFAALGLFQAFMMFVFSVSLTILGTQASKVMLKQAVYRVLRAPMSFFDTTPLGRITNRFSRDVDVMDNNLTDALRMYLFTVAMITSICGLIIAFFHYFAVALAPLYVLFILSAGYYRASAREVKRYESVQRSHVFAKFSEGLSGVASIRAYGLKDHFIQELRRSIDEMNAAYYLTFANQRWLSVRLDTIGNALVLTVGILVVTSRFSVNPSTGGLVLSYILAIVQMLQFSVRQLAEVENGMNAVERLHHYGTNLEEEAPEHTVEVRQSWPEKGEIVFDNVEMRYRENLPLVLSGFSMHVKGGERIGVVGRTGAGKSSIMSTLFRLVEISGGSINIDGINISTIGLHDLRSRLAIIPQDPTLFRGTVRSNLDPFDEHTDLELWSALRQADLIPADADPTDRQADSSRIHLDSVVEEDGLNFSLGQRQLMALARALVRNCQIIICDEATSSVDMETDDKIQNTIATGFRGKTLLCIAHRLRTIIGYDRICVMDAGQIAELDTPLELWRKGGIFRSMCDRSGIRMEDINGAREALAAMTEGAGPSTSSDFDDEKKEI

SEQ ID NO: 1578 - protein, 298 aa, Unknown
  Kingdom: Fungi, Phylum: Ascomycota
MRISTAVLAAAVAVPAAVSALDLRLLTYNVRIATKRPGKNELRWKDRRPMMTEQLKDESNANTLMCFQEAYHHVVEDINHDLGDRWSWVGRGRDDGDKKGEFSPIFYRHDVWDLRASHTYWLSKTPDKPSRSWDANHNRIVTVAELTHRDSRDKLTLLCTHFEWQGKTAQAKSADMILDLVRGYTALDVPVFVAGDLNLEPGEKPYKILTSGLTDFRTVATEHNMGGSVAYPEVLLEAGDDGVLTYTGFTAKEKDMLLDYIFIDDRATFRSSRYSVPSNVKDGKHISDHRPVVVDVQL

SEQ ID NO: 1579 - protein, 155 aa, Unknown
  Kingdom: Fungi, Phylum: Ascomycota
  misc_feature (6)..(6): Xaa can be any naturally occurring amino acid
MIWSNXPERIHQAPKPTITKRKSSSKPPIMPPHLHPRSRTTSTLFATTVFASFFVVALPHILPCPVPQTRFADGEVIIDENGRRRRWKRKETPEVRDGIAQFGQTAPDEELMGPGKKVPDKRECPVPKPGGMLGEWLGFHKDSEEMPVARRIEKQ

SEQ ID NO: 1580 - protein, 391 aa, Unknown
  Kingdom: Fungi, Phylum: Ascomycota
MSQPTKSGRARIRDVIPHLYLGKWSPGRLNSITDVPGVLVHTQSIEPDQDVHTGVTTILPRKNWHEYSSFAGVFRFNGCGEMTGSHWLNETGLLASPIIITATSSVGEGYRGVTEYCYRYHRNEQGDMDLFMFPLVAETFDGYLSDPAAFAVTPEHVIQGIKSATADRVPEGNTGGGTGMICHRWKGGTGSSSRIVKGFDVDGNVLDYTVGVLVQANYGSHDTLRIGGVPVGKILQDEGSVPSAAERPTDEGKEPRKDGSIIIIVATDAPLIPIQLQRLATRATVGLGKVGGYGSNTSGDIFLAFSTGNKVPSQELSMSSGPGLNPYQPLARAVQMTDNDTINGLFEAAADATEEAIYNAMAMAESMTGFKDRHVEALDLAKVKEIVERRL

SEQ ID NO: 1581 - protein, 463 aa, Unknown
  Kingdom: Fungi, Phylum: Ascomycota
MSAPPPTVDATVSDEPQSDGSKLRTFLGILRRFIGVSDLASVRFSLPAQLLEPTPNLEYWTYLDAPNAFVAIGNSDDPLDRMLEVIRFWLTKDLKYAKGKPCKPYNSCLGEFFRCNWETEDNAPRINTNELRGNDGTPKKDGMASLKAAVKNDKNASAMSLTVPQHGTSTPATVDRQYRISYLTEQTSHHPPVSAFVVSCPEKGITARGFDQITAKFTGTSVKVLPGEHNSGIFITLEKRDGETYQLTHPPAHLGGILRGSLSVSVSEMAYITCPQSKLKAILHYVEEGGWLGRSMNKIDGIVFKYDPENDDKTRVQDVPEEDILVRLSGPWKEKVMFSLGPTPMKNVPPEEQHVIIDIGPLNVAPKILPPEEKQAPNESLTLWGGVTKAILAKQFSQATQVKVELEEAQREKARQREKNNETWQPVFFLRATGNGGKPELTEKGQKVLEKAQKGEWDLAGIL

SEQ ID NO: 1582 - protein, 394 aa, Unknown
  Kingdom: Fungi, Phylum: Ascomycota
MSSHRPNAFNSLRMGEVIREKVQDGITGETRDLQYTQCKIVGNGSFGVVFQTKLSPSGEDAAIKRVLQDKRFKNRELQIMRIVRHPNIVQLKAFYYSNGERKDEVYLNLVQEFVPETVYRASRFFNKMKTTMPILEVKLYIYQLFRALAYIHSQGICHRDIKPQNLLLDPNSGILKLCDFGSAKILVENEPNVSYICSRYYRAPELIFGATNYTTKIDVWSTGCVMAELMLGQPLFPGESGIDQLVEIIKVLGTPTREQIRTMNPNYMEHKFPQIKPHPFNKVFRKADANAIDLIARLLEYTPTERQSAIDAMVHPFFDELRDPSTKLPDSRHGSGQLRDLPALFDFSRHELSIAPNLNPQLVPAHIKPVLASQGLDIDNFTPMTKQEMMAKLD

SEQ ID NO: 1583 - protein, 640 aa, Unknown
  Kingdom: Fungi, Phylum: Ascomycota
  misc_feature (610)..(610): Xaa can be any naturally occurring amino acid
MSSARPPIEGLLPQTHHYDYDHEKPSAAGPRRNTGRDKIRCLDGLRGIACLLVFNYHFLWPWTPAIMLGYGALPPRAPEPYTSWLSWPILCLLNRGRPMVAIFFAISGYVLCRHILRAIHERRLDAAYQGLASSVFRRVFRLYIPPTISMFIVAVLAQTGAFRSEFSIYKGPDSHYINGTVSVGKLASTSLCTNGTIHGLGPAGVAGVFGVADPEIVGNETIWGDQHVCVNMTSRAFSPALLYTIPDPLKRQKPNMTAISLGLEEDPTKSQDAAEEAFYKKAAGGVSMNLRIPKKMSKAKKKTIERELKWIQFGGSWEEHPFIHDNATYAMQNFTRSYAEWANPFNFGHYHPRYDPHTFTIPMELRGSMVLYIFLLGTAALQYKWRLRIASVLTAYSLTLGRWDMATFLGGMTLSEMDIRNSDAMDPPKEGSMIPSAARAQRDAAAGFFHTPRGKRITRWATIILALYLLSYPDSGAEYTPGFIFLSDWVPKYYIPLSGWMFYQAMGALLLLPCVLRSPLLVRLLESQPAQYMGRISFSFYLVHGPVLHCLGFWIMPRLFDYFGQQVGMVIGYIFLLALTLWLSGWWYRKVDLWSMGVGKRVEKMMTEGXVMSRSDPIRSDLGKRHQDRIHARAHWSCCR

SEQ ID NO: 1584 - protein, 2400 aa, Unknown
  Kingdom: Fungi, Phylum: Ascomycota
MSFQGNGSVSRRTNPFARPGSPSPSNSPRISNRPKSTTLTNPSPLSGPDPFTSSHTRSQSSNSSPFIQTSASIEKKHHRHDSRNTAVTSNTFAPSFIKTSEERRSNDAVKGIEGENDFSGKRYVWLKDPQQAFVKGWVVEELGRNRILVQCDDGTQREVDVDSVDKVNPAKFDKANDMAELTHLNEASVVHNLQMRYQSDLIYTYSGLFLVTVNPYCPLPIYGNDYVNMYKGRSREDTKPHIFAMADEAFRNLVEEGQNQSILVTGESGAGKTENTKKVIQYLAAVAQVDPASRQKSQHSNLSQQILRANPILEAFGNAQTVRNNNSSRFGKFIRIELTRTGAIAGAFIDWYLLEKSRVVRINPHERNYHIFYQLLRGADDRLKREFLLEGLDVQDFAYTRDGHDSIVGVSDRQEWETLMEAFEVMGFSGKDQKSILRTIAAVLHLGNIGVVKESRAADQARLEPNAKEQAAKVCQLLGVPLEPFLKGLLHPRVKAGREWVEKVQTPEQVRLGLDALSKGIYERGFGDLVNKVNRQFDQSGMGMDDAHFIGVLDIAGFEIFEENSFEQLCINYTNEKLQQFFNHHMFVLEQEEYAREQIEWQFIDFGRDLQPTIDLIELSNPIGIFSCLDEDCVMPKATDKSFTEKLNSLWDKKTPKYRPSRMGTGFILTHYAAEVEYSTEGWLEKNKDPLNDNITRLLAASTDKHIASLFADCAEDADESSGSRSRVKKGLFRTVAQRHKEQLHSLMSQLHSTHPHFVRCILPNHKKRPKQFNNLLVLDQLRCNGVLEGIRIARTGFPNRLPFAEFRQRYEVLCSDMPKGYVEGQAAASLMLEKLGLDKSLFRVGLTKVFFRAGVLAELEEQRDALITEIMSRFQSVARGFVQRRAAYKRLFRTEATRIVQRNFQVYLDLVENPWWQLIVKMKPLLGATRTATEVKKRDAMIKQLNEKMRQESENRQKLEEDRRNCHAEMMRIQKTLESERALALDKEEIFKRLQNREAELEDKLAGAIEDQERLEEELDELMEAKNKAEADVERFRAQLEQAASLIAKLEEEKSSIASRATELEASLAEISQRQSERSKQEAALENEIKMLQSQLSLKERKAQDLETKLLKVDQDLEVKLHTTQKELESTKLREASLKRENRDIQAQLSQLSKTSTDYEDLVRQKESELSILRKDTQKFEAERRSLEHQQRSLAAETEKATARAREAQADLVAMKSRQAQLEREAADAKQLLEARLSEDAQADQNRQLVEAQLKDLKEELYKVQKELSRERQSRDDVMLLGEHKLSALQEEFDRLNEAKITIEKELYVQQDTLRRAKEARATAEKERDEARNEIRKLRMAKTQAEEARMQAEVAGERQATKVARELEASLRRDLEAAQERLQWFEEECAKLNHQVEDLNKLILSSGEFGLKNDQAKERMERELNTVKSRLAASENDNRALLNKLQLKGLEIARSTSRASEASRGQLTGLQREKARLEEQNNKLNKQLGDSQLTIASLEKRVEKLQLSLEDVNHEIAREVQSSRNAEKASSTSTAQLAEANRTVDSERQLRTQAQATVRTLQASLESRDRELEELRAQMLNALRTADPELHIPPQSDGPSDKGLLKSYDLVRKVEELQQNLRVQSTARSNAEAQLAELRASRHESPSRPKLEEIHLNEAPFNGSPTQRRSTRFHARQYSNTSTPTRKHLDTDHFDSARSDKTIDTVTHNKRMDLKAENEELQNQLQLAQMQNRHLQSQVDRSTPVPDSFDDSPSARRVQKLEKVNSRLHEMLDDSSKKVSALEKSIRSGELSLRDIQARSHEELLDVFNSQEESRRSLLHSHKDAIAELTDVKSHFDKMRHERAKMELQLRDAKSDLREMTIARDQESQSRSQLLQEFSDLQIRLDAETSKLADVISSLELYKGRADEYFSKLEQAEIAVLKASRAEQFAKSQAREAEETYAEVMAERQKMDATIEDLQRANQRLEEKIEDISTDLEGVTQAKRRLQNELEDYRNQRAMDIEDKESGMEQTRKKYQAEFATLTKELDLAREERLFKQAEIARLREELDDLRSKWDDEVLNSSTWSKEKSRLESTLADVASSRDEAVNAHNEAQGKVVSLLSQVRTLRSSVDDITAERDSLLREKRSVEARLEEAKAGLDDLAKGDASLRDAASSDKEILELKSSLAQQEDLAAAAVEKMRRAEALVSEMQKDIAAERETSTHLQQQKTSLEKTLSEAQLKLVDLETKGYSSASQDIKFLHKRIQELESQLESQENERTKSQRSARNVDRAVKDLQTQLERKDKQNSQLSEDVGRMRDKVDKLLRTIDELQSSESSTQLSARRAERELREEKEKSLRLERELEGWKGLRGEKASSGSVMGSLRSRAGPWRASEADAFGLVDVPERKSSISRAPSLTKGFI

SEQ ID NO: 1585 - protein, 610 aa, Unknown
  Kingdom: Fungi, Phylum: Ascomycota
MSSPRGGSPGAEQQETPATTPQTPDPLNTDEHADETTDRSTDGIQPVSDGGPPSVGTAVENEAPPANTTTSTTGVESRTGANSDVDRLASQLSLLGTHFSASNPSPTADHQDSTAGPSTAPQQPQTTFLPPRSSSHMDPLQHPINLNHSLPPTPREENSGHDFGMPPARSETRRSTVTFRDHSDEHPSLAGSSSVRDYNVGSQGSSPRGPDAGRSATQQSLQSALDSEGSQQPDFVLPRWQPDAEVTYCPICQTQFSIFVRKHHCRKCGRVVCNSCSPHRIIIPHQYIVRPPGFEDLMQRGLIYEGLISGYGDGNGPAGGERVRLCNPCVPDPQTAPPQSPTTAADGTIRSAHQRSRSSYAGTYGSVSTSSRYPGSYAEGRGSDQWRRYSAGTRSITMVPGGRAGSSASSSRMGQHGSLQRVAQPGSSYPARHSSLASASSSSRNRTLPPTPQIAEEDECPICHRELPSRELPNFEAAREAHINSCILSHSTYGSPRNPTSGGTEPAGPPPPPRRTGMYKYVATEKDCVDDAECTICLEEFTVSSELHLGLVRKSPWTLPGSSARWLWILNYAIDSGSANDIEGSITGVEDCKRANAMLILLLNGTEGSL

SEQ ID NO: 1586 - protein, 340 aa, Unknown
  Kingdom: Fungi, Phylum: Ascomycota
MKYLPVHDFEAVTGALNFNTPDCNVTGGCDLYTTKSTGSDKKLYKNIDEDLNSQHDALVKLSASLSPPDRKHVLATSPAFSQSSAFGPLTELSSRRTFAYLIATLNASHPHYDFSHVLRPGDFKRERNVRRVMINLDSILQNVRPGFEAKSLGSSYGSDSHSVWGPQCWSRIDKEMRLNECTIFSYHPDNDPFEEDESAIWAVHYFFFNRALKRVAYLYVRVVPVISAQSPVLRPTRRGSIGKRSTDEYDGDFGSAGAKKRARYWLGERGAAELIGESPEDDGERLDDGLYWNRGEDGDIVPFSDDDYPEADEYDDDDDDDVLDKKERYMSEDVAGRMEI

SEQ ID NO: 1587 - protein, 857 aa, Unknown
  Kingdom: Fungi, Phylum: Ascomycota
MARFSFPVPGRKKHQAEPVVNQEPKSKAHKLLGSTPLNIDAPGPRIWDVVSNSAISVTVTDAPSPTLEDHDYHDYHHHNQDGRTGLARDWGDDSEILPRNYRTGYLDPNDDSTSDVTTALRSRQSSSTIKSWYDKSKQPLSVSQQTSASAMARGLPPKAQRMLDMDNSLAPPKNKKKPARLDLSSLNPHLRGKGHRNSERYVLGPDLATRSPSVLSQSSPSSGGGRRLRKRATKESLRQRPSITISDPIRPSTAGSGRYPNHPNGVPDLYGHYEQMSLRQIMDLESHHEEAIEDRSEVMHQAMFNPSIIRTSPSRRKGTNHVHTASQSTRSSKARHQSPSASVSSRHTRTSKASKRTDSSFQDADLHGKSVLSLSSDSEDDDGYGDKSPASVFARRPEDFEEHAASLDQWPSNSSGATSTSPGSRAKSGKRASFAPFHTYLPVPGDNPKPRPDSLGTSPSAPCLLQPSSPSRISSVSTSSASSAATWQSNKHDFGVHEARAVTMLPAQGPADQASSLESEWDWEKEPAPARRRSPVPRNSMSTINDQPTPPLSPSSVDFYIRSARSSIDGPSGGQNRFMAVSKQEELLLAALRQKRQLMRESFIAEEVSARIGRHSRKSSKGHNTKASTATITQDLFNFDFPTPPTGREDLSMSSSDLSGINRAELGGANHRVYEEESIGSVLFPAPKRVSHQSVTTASQEQDESQHKRASYLSEDRPVSPRTLSNFPEPGYGRVLEGDTRSILSNDGHLGDNEQILLPNRYSGGAGRRKSSQVLPGRGYRNRPSIVPEEPISPPPWEDKHFEADDAGIPRPDSPISPSKFPTIPVARVTVNKKLARLSAVGSAPLGSQPGWWGAED

SEQ ID NO: 1588 - protein, 337 aa, Unknown
  Kingdom: Fungi, Phylum: Ascomycota
MAGGYERVNAQDDDDHVSPEEPRPLRAAPNSPPPSFHSRASSPNRNRQVNPTLADAFDDSDESSDDEGDDRQRLVRRGSGPSVGTSSDALHNVNAPSIMPSSQIPSTPVSSAVRPQRVMGGGVGSDGVFANMSARPERVESEKEEMPPSYEQAAADAAPPYWETTILAPGMGGADDVYVEGMPVGSVFSFIWNCMISTSFQFVGFLLTYLLHSSHAAKNGSRAGLGITCIQYGFYMKGATDGDPPVMSGPDGYADPPDPNSHDFDAGDVTEGGGSIEDIGMSDWMGYILMVAGWFLLIKSIAEFLIARRHEQLVLQSPDRGLGVPIIAEGESTERVV

SEQ ID NO: 1589 - protein, 789 aa, Unknown
  Kingdom: Fungi, Phylum: Ascomycota
MRWANICLALSLATGSIANKHQAKYEEITYTTVGGYFLQDDPNTNPSSFDYAQVNLGLLNRTYPTDRSFDRDNKKPQWAKFARWVESLNKNCRKRSTHGRTVYKVLIMGRHGQGWHNAAESYYGTPAWNCYWAELDGNGTAVWADAKLTPAGEAQALKANAFFKSHFAQDGLPYFESYYSSPLTRCTTTAQLTFGGIQMPHNRPFKPVIKELLRESISIHTCDRRSSKSYIHSAVPNFSFEKGFTERDELWRGTEGETSDHQLARSKQVLDDIFSNDDSTWISITSHSGEISSLLKVLGHRSFSLSTGQIIPVLVKAELREVGPEPATTTAPGFTAEATSLAMDPAIEWEGLKGPPAPELLEGRLWVDGCFDFFHHGHAGAIVQARLLGTELYAGVHSDEDIMANKGPTVMTLDERLAATNACRWVTRSIGHAPYVTSLPYITHYGCKYVVHGDDITSDSEGNDCYRFVKEAGRFKVVKRSPGISTTDLVGRMLLCTKGHFIKSLEAVLAGEEGSGTEEERKALGESMLERMKLYATDETAKAPGARVFFWSASEPAKAEDTREENGSFRKLIDGKGPRPGQRVVYVDGGFDLFSSGHIEFLRKVMEAEEELARADGWFSEQAVNERVGKGADYPPAYIVVGVHEDQVINRWKGVNYPIMNIFERGLCVLQCKYIHEVIFGAPFTPTESYLTSLPLGRPDAIYHGPTSFMPLTYDPYTAPKAMGIYKEIGEHAFAGVNAGEIVQRIMKSRDLYEARQKAKGVKAEVEAAARQREILEEEQRKKEEEMTK

SEQ ID NO: 1590 - protein, 918 aa, Unknown
  Kingdom: Fungi, Phylum: Ascomycota
MEILTLLNTAATNSGKSTSREASPSSSSHEDLATPPSTTVPTPSPEPSWTRPQVADKNNGDAQPWDTEEASLSSHTDSGFGWNANFSFPFKGESIDYALEMNASGSGPSGGSTGRPHRIVTDSSSYRPQDPSSAEDAFVPPSADSFRLPDYRRHKYSDSHSSLASFATSRSDAHSRISSVTTINEIPSIDAVLSEVSRADASSPGLLESSPTQAEKRHKSKSQDASLSPRGRSRAGFIVPRITRAASPSDVALNMKQSAGVKPPSSATMSSHPPQKNTGRVAAPRTHKRAVSAPVFPPLPRRLPSFTINQSRPLLPPPHQMMTGSVGSSHSSEETLFHRHGPPNAVREHEQTRPGMFTRHSDSETTNTPSASASHLTSPTNVSQASMATKSKSQPDDVWDIDDENLRMPSFEELELHGMQDETVQCIFVDKCATNSPIRKSVSHFFGRNKGTTLQIPEHIWLVYCRQHYQRLRYRLGQKYALHQLDLVKVVIHRIERWGKDNKAKNDGAEVLDWQIMLRKCVRDEQERWTRYKQDLRRQALSQPEQDERYETFKMSRVGHSKYTQGMSQGNDVGLTQGLVEGSTNSAAETLMSIEKNYPWLLDTLGDHRSEEEVIAVIDHLRQDYKAALEAKTSNGVSIVKELPPIEFLPNLTNDNEDRPIKTGRKRGPARTARASESFKRRATRTADSPDAVLAAGVYPHASFDPASSLPHLGGSTPYDHPQMGHWIDRRGQDRGVSRPSFIVPQIQPLNYGYRPSPGSSVTPLPRETMPLATPLPGQERAEQSRNLLPVPRPTHHRSASAFTPMTRYSSTLERPSSSGEGAAIGRSNDQGDYFSSFATAGPPRNTHIFGDLGGYQVAPYSRASGFDFTPRSRPGAWADPGAPELPHVHAWAPYESSSASSGTFRGEDGNQESEGKH

SEQ ID NO: 1591 - protein, 250 aa, Unknown
  Kingdom: Fungi, Phylum: Ascomycota
MRARGISEDLLRWVEAFCSHRTATIHINGQTSEMQDLSQAGLPQGSPLSPVLFLFFNADLVQKRIDRHGGAVAFVDDFTAWVTSTTAQDNRAGIEAIIEKALDWERRSGATFNIQKTAIIHFTRKPHKSDAQPFTIKGQLVYPKTSVKVLGVIMDAGLKYNEHMATAANKGLEAAMGLRRLRGVTPATARQLFASTVAPAVDYASNVWMHACKNKSASAINRVQRVGAQAIVGTFLTAATVVAEAEAHIA

SEQ ID NO: 1592 - protein, 519 aa, Unknown
  Kingdom: Fungi, Phylum: Ascomycota
MANPTTSATSSQALRAPHQGPLVVTSRPDMWPIRKSAQEATEKRAFKSSAPENEMQNHLPSISPNAIREWLEGQLPASFYTHPPPHCRAIFSTRHGELPFRTMDHLLPKRSLHLWDREEIQVACNSLRLMYWDIMRNLQRPTGWMDMWQWFDAYDMYFYGAQNLWNCVNHLYDENMLIHADFRKESALEIGHWADNWCAIPANQEKLKAWDERKGPIFNLFSVEDSKSMGPISDDVIPVLSDAIKHRRHLLLQDPELLEHAMPNHLIPACQSGTIHNWMAGQRILSPNGLPPPPPVPYFYATPAVTDDTSGSTTPKAVTISSVSRKSSGQNRSAVEALHESAYPTFAPPSAVVPGTPSENEGKVRRTASAPACMVSDGREIQPTPRRFTVSVQSGSSSSTAVTSPSSCIDQSEAKSEAVTGNGNSPECLRNSYNYSSEIVQQTGKSPASSKVTVPTASDVTFRNASRKEENPAPGIQEPQFWQPPSTDHAISQGMTRHHGTEVSSNLPVMAQSSAQQRA

SEQ ID NO: 1593 - protein, 393 aa, Unknown
  Kingdom: Fungi, Phylum: Ascomycota
MATMTLTSVESIEPGNLGNLSPDQERALQEAWVHLLRLCGNQDVKHDAPDKSPIFMAHLKDKSPDHFRKSLWESTLGDNPDALVLRFLRARKWDVTKGVEMLVSAVNWRDERQIFKNIVGGGEGVGLKAKRTPEEESFMAQYRSGKAFVRGADKDGHPVYIIKVRLHDPHKQPASVMEDFALHNIETLRPMARGRKDKVCLIFDLTGFGLRNMDFHFIKFLISILEARYPETLNVVLVHNAPFVFWGIWNVIKHWLDPVIASKINFTSGSKGMAQFIPKDNLQKCYGGDDKYEYKYVEPVVGENECMQSEEKKVKILGERDELAEQFVQHTVEWVTLDPVSELAQEKNRQRGDVIRDLEENSWQLDPYIRSTTFYHRAGVLGRQGEINLTAAR

SEQ ID NO: 1594 - protein, 545 aa, Unknown
  Kingdom: Fungi, Phylum: Ascomycota
MASPVASAALKQRIRNPALLQKLCKPEDLLHHFPNGAYIGWSGFTGVGYPKITTPSTEWIYLTTLSQKKRKMPTFMADHVEQNNLQGKLKYSLFVGASSGAETENRWAALDMIDRRSPHQVGKQISKGINEGRINFFDKHLSMFPVDLVYGYYTKDRPNNKLDVTVVEATDIKEDGSIVPGASVGATPELIQMSNKIIVEVNTAIPSFDGLHDITGTDLPPYRKPVTITDVQDRIGSTSIKVDPSKIVGVIESDYQDATLPNTEADEASFRIAGHLIEFLEHEVAHGRLPKNLLPLQSGIGNVANAIIGGLNNSNFKNLTVWTEVIQDTFLDLFDSGRLDYATATSIRFSPDGFKRFYDNWEAYHNKLLLRSQSISNSPEVIRRLGVIGMNTPVEVDIYAHANSTCVMGSRMLNGLGGSADFLRNSKYSIMHTPSTRPSKTDPHGVSCIVPMCTHIDQTEHDLDVIVTEQGLADVRGLSPRERARVIISKCAHPVYQPILKHYFEKAESDCLRKGMGHEPHLLFNSFDLHKALQEEGSMQKVKPW

SEQ ID NO: 1595 - protein, 340 aa, Unknown
  Kingdom: Fungi, Phylum: Ascomycota
MRMSLSLLYQRNCSRTEITAIGASSSSSLSSAPSVFAVYKGMAPTSSWIDVFNLRSGAAISKISGSGAAFSPPGTTTSSSQQKVATVRDWAAPIGKAGEEVRYGRSILLRDVMATGGGKPLLELTDVEQGPVTWSRDGRLIAAVEGGGEEGSRVGVWDARTGERRGRVLGHSAAVTHIKFTPAGRLVSLGRDGVVRITNVERGRTEGRLVLPVGGGSAKLLELSEDGRTITSVWGPGSVYIWDSRLGSVDTYEMDVKRTTEGWPLSGGANGRWMVSRTEDGFDVMDLRAGEVVGEVRRREEDGVVYTAGAWVDGAGFGDGVVVMGRMDGVVEVWEVRVKG

SEQ ID NO: 1596 - protein, 698 aa, Unknown
  Kingdom: Fungi, Phylum: Ascomycota
MDMDGMDGMDGMDGMDDSGSGGHDHQSAGVNSAQNHAYARDYWYLAAGVVGTLLILRGISILQTRRRLSQCRNSKIEHPTRPHTRLSQAWATTTAIAREIGHPQLYVSIRGLRWATPPPLGRILVILVYFAVIAYMMFYQAVENDIYFFERIGYRNAWISITQFPMLYLLAMKANPIGWLVGLSHERINWLHRWVARIMFFTATVHGFHFWVQWEKADFTEIALQIMPLTKYGFGAWGIMLWNIVSGFVPIRRLAYEFWVVQHIVGAILMIWLLYQHIPVSARYNLWMAVSFLVFDRLARWIVLLWQNVRFRPNTSSCQGGKHLGHRISARAVGSNTTLLTIKNVHFQWKAGQFVYLWIPRIGPVESHPYTIACARRPPSGGGCYCNSIQLIVKAHGGFSKRLHTFANRNPGKDVTGFLSGPFGAPPRWDIFETVILIGASTGASFTVPFLEDMATKTDETCVKRVELVLLAKTSLEIEYYVQRVRDAARMVRGRGIDVLVHVAITGEKGRQSPTMNGEKAVLPSASSAEGQDTITEPPKACCGDSGLCACCPSKSIDDETSSFIQEDCCGTTTVTPSPYIKEYNSRPDIEALIRDPVEKAAGQAWSIIAAPVMELPPGSDLCKSFLTLNIPFISVMKEKKPPPPRRETMLLQWSSMRHWTSNRWLETALPMHTSPGRLQLPDLHSRAGNLKCYVAHL

SEQ ID NO: 1597 - protein, 367 aa, Unknown
  Kingdom: Fungi, Phylum: Ascomycota
MRARYKSPNGTGTIDLPDDVTLQGVLDELRRCTGLGRFTIKFGPPMAMRTLDLMRHSETAKSLGLHGETLTIVPDEPRSLTPPSGGVPAAPSHAGEAQAATQENPEDMNVPWPERDGTLLLRVMPSDNSCLFTAFGGALPEQIPAQKLRKMMAEYISEHLDVYSEAVLGSPPSQYCRSIQDPDRWGGGIELSILSSIFDVQISTYDVQAQNLINFGEGKRDRCILVYSGIHYDRVAFSYSDYPHTSTTLPPEVDRTLWPTDDEEVLAQAQKLVEKLNKAHYYTDTEGLILRCDVPGCNWIGSGQLEGKKHAEKTGHVELSEIRDEEEDNALHTCDAPGCSFMGQGNAATTRHRHDTGHKKFSVIPDY

SEQ ID NO: 1598 - protein, 191 aa, Unknown
  Kingdom: Fungi, Phylum: Ascomycota
MADTASKEVPATYVGTSKVAQTEYPLIDNDPHFKRVIGYARPSDYLAGGIAAAAGPGLLMAMEKFQPSEVGRGGFPKALRLSGFLGLAGGFLYFYQRSALRFYGASENAREIEMDMREMVGKVKAGKPLYGEVTLSPYIQGVAARQGRYSALFNDVIPWFNFVNHNQHGVDTAKYYQQAERELEAERQAKA

SEQ ID NO: 1599 - protein, 295 aa, Unknown
  Kingdom: Fungi, Phylum: Ascomycota
MPDNGSETFVEEVQEEESPNFALFRDCLSATLLKPASAPPSSAPKQRRVRRRRARSSAGDATSSSSTSAREAQSRDVAAFGGQREGDAEELADFIEYLASEIFDSFPDPLKELDHRSWREDEALQTEYALPLTVSSLASLDLPIDITDSLRTYSLISPDPTLDSHLPSSPEAFLIPILTPYITTLTTPPPASYATRPDACEICGRDWIPLSYHHLIPRFVHDKAVKRGWHKKEDLQNVAWLCGACHRFVHQWRSHEELARDFYTVDLLLEEEEVRRFAAWAGKLRWKGGRSRSKR

SEQ ID NO: 1600 - protein, 242 aa, Unknown
  Kingdom: Fungi, Phylum: Ascomycota
MADQRPAKRQKAVHPIDTANQRTDEEFLKEYMRPSSGWQTWHHPSTKEEHILRFARPSNLTSSDLEACYRLVEETSRPDYEASTVGWNEEAKRAEMKSADLKYVLLEGKDRKTREGDESLLGGQEKTTGRLRGFVSMMPTFEEGEAVVYCYEIHVKPYLQGTGIAQLLMSYVTNTACNIPSVGKTMLTCFTSNTRGRRFYERLGFEVDERISPRERKLRGGKVVKPDYMVLSRVEREEGSGC

SEQ ID NO: 1601 - protein, 200 aa, Unknown
  Kingdom: Fungi, Phylum: Ascomycota
MSAKPQTKKFGKGSRDVPAPAERAQKWYPADDDSQPKTVRKAVRAWAPRKSLQPGTVLILLAGRFRGKRVVLVKALDQGVLLVTGPFKINGVPLRRVNARYVIATSYKVDVTGLDEKKVEEVSQPKYFTADKAKEKAGEEAFFKQGEKPQKKEINSTRAADQKAIDKALIANIKKVDLLPSYLASSFSLRSGDKPHEMKW

SEQ ID NO: 1602 - protein, 439 aa, Unknown
  Kingdom: Fungi, Phylum: Ascomycota
MGELADYLVEHDPNFRKARLPALYSDFRPQQTLNPDGYRANISAWRHALSLLASSGVLPAKSSSTPFILDLDTSLIRSLQNRQFGQPLALGTVVRETVAERGFVPVQDFLKSQRSVYYHGWGEVPWSVVGWTLRTLGVTGPGTGEDKLPKGRFVIMENVEKAGKEVQARLEGRTSKFERIFTKEQFRREFATDLVGEQQRLGEEDVEVLLRFLSRDRGLVEYDGKIVKVKVAGERGGVTEEDSTIASIKELTARLQHQIQLLNKRTEELEQAAKSAVARKQRVPALAALKSKKQAEASLSARYNTLSQLEAVAAKIEQASDQVQILKVMEASTSVLKGLNEQIGGVERVEGVMDGLRDQMADVDEVAEMIGEGGRVVDDEEIGEELEALEREEREKEEAEERRKLAELPDVPREVTPTTETGIAQLSIDERGREAVRAE

SEQ ID NO: 1603 - protein, 106 aa, Unknown
  Kingdom: Fungi, Phylum: Ascomycota
MVQITFIAGLLFAAAASAQLVPNAAGAANVGNGQGKQFTTGGCVSDADCQEGCCAGGATSFNGVAAGICSGIGAEFQNGKTGCGFNDPNAQQNIADAKDLSAEQGF

SEQ ID NO: 1604 - protein, 128 aa, Unknown
  Kingdom: Fungi, Phylum: Ascomycota
MAEQLSTPRINARYLDSFTGKLVMIWGKVTQLRGEQASIDSDGVVNVLLNREAHLTNANIVQIIGKVNPDLTVKVLSSKDLGTGVGTFQPPLTPAVTWFASTTVRHMALYHHVVDITHKHRSIFGSDN

SEQ ID NO: 1605 - protein, 506 aa, Unknown
  Kingdom: Fungi, Phylum: Ascomycota
MRFTSAIAAATLAYTQVAQAAAPEKPSVQAKNVIYIVPDGYGQASQTLARDLYSLQETGSTHGKPEILSLAADELVSGLVKTWAANNLITDSAASGTAFAAGHKSNNGAISVLPDGSPVGSILEAAKLAGMRTALVVTSTINHATPAGTIFHTDGMTRAFNTIADQQIGYSHPLGRMADILFGGGRCSFYPRGHSRSCRSDNVDLWKYAEEEGYYVARNLSEFEALDGGLSDAHLPWLGLFNDGDLRYEIDRKVTKDEPSLLDMVKTALTRLDKATSCRKKGYFIMIEASRIDHAGHANDAAAHAVDTLMYNTVMDYVREWIDEHPDTIMMSAADHECGGLTLNGYSPLRLSQAKHSGEHIQSIWDNRPSGADRRQFLVSEILPAAGLADATSAEINTILDASSISGEALRLQARRAGVNWSTGGHTGSDITLFGYAAEQQRRALQADLSGVWDNTQLPRYVEKILGVDMDAVTQKLLSAARGDPSWLGKRGLEARMMNEELGHDH

SEQ ID NO: 1606 - protein, 276 aa, Unknown
  Kingdom: Fungi, Phylum: Ascomycota
MEESKYCLPSISNLINLADAGSPTSEAPPSQLSPRTEGPPAQRHRFETPAVKGESRPGSGYAPGPQGSRGLPPTPPMSVDASFESRNSPSAQSVSQLSTSSGPTGYYHETTPPLEADSRRPQPASRTQLPHYPQHAPAPTSYPPGPPPAGLYAQAPPPAQPLPQVHSLFYQRPLPQAFPPAMPVAVGGSNPWQHHHYLNPSHGPSYPQSQDRYICQTCNKAFSRPSSLRIHCHSHTGEKPFKCPHAGCGKAFSVRSNMKRHERGCHSFEVTPGLGR

SEQ ID NO: 1607 - protein, 522 aa, Unknown
  Kingdom: Fungi, Phylum: Ascomycota
MGNSNGKPVDLDGNVNLNHFRLLRVVGRGAFGKVRIVERKDTGLSFALKYIRKDEGTTAWFLKRTDDGLAEAAMVAFQDIEYMYLVVDLMSGGDLRFHISRKTFTEEAVRFWIAELGCALRYIHGQNIIHRDVKPDNVLLDADGHVHLTDFNVASDVVSGRTLTSKSGTLAYLAPEVYAGKGYDVRADWWSLGVLFYECIYNKRPFDGNSENSLGSQIQAASPKYPVTQPPVSLPCLYAIGAALDPNPDTRMGATWESFIYNDFFKAIDFDLLEKKMIEPVFVPSSEKTNFDATYDLEELLLEEAPLEARARRQKPRERLKDDATDKQIREDELYRMIESDFRPFDYTIAAYKKITEASESLRDETTPAATPGTEVPQAVTTDDAVPAMNGATPQGSQGYQPNPPADSRPGRVPARPAPLPPAPAPPAPPSDYMSAVPQRPNRRITSPTGGVQVTLEAGGSWSDIARQDATLPADANTPADGKAEGSGGMFGFLKSKKGRNNSPKPKERGVLGKEGARVVIG

SEQ ID NO: 1608 - protein, 512 aa, Unknown
  Kingdom: Fungi, Phylum: Ascomycota
  misc_feature (468)..(474): Xaa can be any naturally occurring amino acid
MTLINGSRPSWEVLAAQKQKELFSSIPAEWRVPGDLLPPASQDNVTDWPETSGWLTAQEVSITSLDATTLVGQLTAGKLKSVDVVRAFCKRACAAHQLVNCLSETLFERALATAEARDEYLAKTGQPVGPLHGLPISLKDNFNLIGRDSTVGIASHIGDPSRIDSTLPQLLEAAGAIVYVKTNVPTAMMIAESVNNVFGRTLNPRNRRTTSGGSSGGESALLVLKGSPLGVGSDIGGSLRIPAACSGIFTIRPSFGRFPGRDCRSGMPGQEAVQSVNGPLARTLSDVIIYSQVVINSQPWLRDPKCLPIPWRKEELPEKLKIGVMWNDSMVIPTPPVARALEEVVTKLRKAGHDVVDWDPKDQPEATQLLGRMFLADGGKTIRHELQRTGEPWRDEMLDYSAAQELGTSEMWKLHLERTAFQNKYLDRWNAAGLDAILCPTTPYSTTKNGSFRHVGYTGVFNVLDYSXXXXXXXDDPELVHGHPISLQLVARRLEEEKVLAMTETILQLLKL

SEQ ID NO: 1609 - protein, 425 aa, Unknown
  Kingdom: Fungi, Phylum: Ascomycota
MPQTEPLDPGIILDDWINRVQNLPEEIRFVQDEIADKDRQYNECIRLIEDRDAKIQKWIKTNGSHEPNPKEDALRAQIRDSYAKADQLSQDKITLTQKMQLAMDKHLRALDIQIKLLYDRAEPGFTDPDEVPSLLRPSAANHSAPSARSINPSHMVGAAGPTPAPRAAGTGNPVMARLPSHPQIRQAQAQQQASVQQHSASAPTTPAASIIMNRQRESSAGPAPKRGVRAASGLANAPATSSGLARHASVGPGTPKAGTPVARAGSAGPRASSVKASSGPASRRNTPSGGNRKKPPNKSNLSRVKKVSSRNSPASTADSELSDAESASGDEEPGERPSRGTPAVDGKDEDGDEVLEDAEEEEEEEEEGGDDKKYCLCQNVSHGDMVACDNDNCPYEWFHWTCVGLKSEPTGTWYCPVCEKNRKAK

SEQ ID NO: 1610 - protein, 1635 aa, Unknown
  Kingdom: Fungi, Phylum: Ascomycota
MLPQAPSDLAALGPADFVAWLTNANSQKPKAAAVKKAAAAKPAPKKKMVQSTLKTTKAAPKKRPIPPSDDESDAKMDESGFSNTPPSAKKQKPTPPVKKAGGVPLAELENDSLMPDTPEKAAPKTKKTATQMYQKLSQIEHIIKRPDTYIGSVERTEQQMWVFNKETSLMEYRTVNFVPGLYKIFDEILVNAADNKQRDASMTQMKINIDRAEGVISVENNGQGIPVVIHEQEKIYIPELIFGHLLAGSNFDDDEKKTVGGRNGYGAKLCNVFSTEFTLECQDSEHGKRYKQTWTDNMQKMGKAKITSSKTSDFTRVTFKPDFNRFGMPEGIDDDLEALLYRRVYDMAGTVRGIKVHLNGEHIKLKDFKSYCDLYAKSIAKERSLEEGGEPTCTVEIDKDKGHPRWEVGFAVSDGTFQQVSFVNSIATTSGGTHVNYIADQITGSLLKQLNKRKKGHTLKQNQLKNHIFIFVNCLISNPAFTSQTKEQMTTKPSAFGSKCNLGEDFLKKIGKSEAIQNILEAADRKADKLMAKSDGSKRSRVSNAKLVEANLAGTRRGHECTLILTEGDSAKGLAVSGRAMLDPDRIGVFPLRGKMLNVRDASIDQITKNSEIQNIKQFLGLKHKQVYTDTKSLRYGHLMIMADQDHDGSHIKGLLINFLQVQYPSLLQIDDFFQEFITPIVKVWQGNPKEPTKSKFFFTQPEYEDWKDGHAGQLSKWESKYLKGLGTSTADDAKSYFSKLDEHLKNFETMKPEEADMFDLVFSKKKADARKEWLGNFVPGTYLDHSASAITYNDFVNKELILFSMADNMRSIPSVLDGLKPGQRKVMFGIFKRNQTKDKKVVDLAGYVSGTTAYHHGETSLQQTIIGLAQNYVGSNNINCLEPSGMFGSRLQGGSDAASPRYIYTRLTPFARKIYSKLDEPNLKTQYEEGAAIEPEVYYPVIPMILVNGADGIGTGWSTSIPNYHPMDIVNNLRQRMGRVGGEETEERPFVTMTPWFRGWKGTPEPAGPDRYKFNGIAYQSESNPNEVVITELPIRMWTDDFKARLEKIISGVDGPSWIKDYKEFNDHNVVHFEIQCDEKHMPKILEEGLLERFKLTKQVATSNLVAFNARGQIRKYEKVEDILEEYYEHRLVMYTKRKEHWLAVYHAEYRKLSNQARFIKEIIDGELVVGRKKKDVLVQELRTRKYEPFPRGADAKKKTTEDEINEEHDEDEENMEGGARDYDYLLSMPLWSLTLERLEKLKQAIANKKQEHDALEKKSEKDLWCDDLDEFCEEWARFEEEEAENAKKIRKMGRRVSKKIGAGNVGGRKKAKNADDDEYDPGKKAKGKAKAAPVKVEAKASKLLAEKFSAKPAKPKELPQAEASPRVEEIKEDSSDNDFSALSRTKPTAKSSQISNVTKPASEPVADAGRNKRAAAAKSAKAFLIDSDSELDDNLGDVGAMVKGIGAGEDKGRVSLYAMNRPQSSHGNGSDSLPKLKTKPSKRFDADSADETNYEMLANSSPYKAPGKDNKLVDDLLSDDEDAPAPAPEPKKRGRPATASKAAPKEAAKPKAAKKSTVLSPAAKAYAARKNSARDESDDEMAEADSPPPKPAARGRPGRAAAARRPIIVDEDSSSMVATEEEESDDPFDMDDE

SEQ ID NO: 1611 - protein, 481 aa, Unknown
  Kingdom: Fungi, Phylum: Ascomycota
MAALSFGSPESRVQEPEEERLEACSDSAIPRRKRTAYVALGSNLGDRVAEIERACREMDARGVKVKRTSSLWETEPMYVVDQDRFLNGACEVETDLAPLELLDVLQGIENDMGRMKVIDKGPRNIDLDILLYEGEKVNHERLQIPHPGIKEREFVLRPLAELIPSQPLDASKPWTLIQDHLNELPQGEPLSSFTPVSPSLSLTPLTPRRETNIMAILNLTPDSFSDGGTNTSSTLRATLENMLSSGATIIDIGGQSTAPGREQISGEEELSRVLPAVELIRSMPQGRDVTISIDTYRASVAEQSIAAGADMINDVSAGTLDPDMLRTVARLGKTICLMHMRGDPLTMNSLTSYSPAGLVPTVASELLSRVRAAEEAGIRRWRIVLDPGLGFAKNHDQNLQLLREAAELRSWPGLEGLPWLWGPSRKRFVGRATGVDEPRQRTWGTAAAVTAAVQGGADVVRVHDAREMTMVARMADAIWRV

SEQ ID NO: 1612 - protein, 340 aa, Unknown
  Kingdom: Fungi, Phylum: Ascomycota
MAEQPSLRTYDPLYPEPVENKYLLGRMFEFRDAFEPVFARQTAKVKRQAALALIEISCTSYTVSPSNLPWYRTKSRKTVNAGTFLVLGNWLGKSKVDDKRLHYTPSDELLKDISANPFITHEPDHRVKKRLMTAAKGPNTALTSQNTLVSKEPSTSASRINKGKCKRPNAMKPSGVLPGQRPAKRLARVELPVKSKRQKGATKNATEHEEATKCLEKKSIHGKVKAQGGSGSALYEIRQKLKLAQREDHALSELKISRAARTEAGSAPNDEVGRAHIAGARTAVDQFRDGPYMERMIADIIKESGRSYIKRLLDESLELIWRQIMPDESIANAVDAAFSG

SEQ ID NO: 1613 - protein, 558 aa, Unknown
  Kingdom: Fungi, Phylum: Ascomycota
MATVISDPDVKRTTDTKGSVVVPGDTSDSNKSSDDTETQRSTHLGSTDDHVFADPATAEYWRLKYEKAGYENRHRFDPELTWTAEEEKKLVRKVDKRIMVWAWVMFCALDLHRRNINRAISDNMLGELGMNTNDFNYGQTIFLVSFLSAELPSGLVSKKLGADVWIPFIMCGWSIVAGSQAFLSNRAGFFAIKALLGLLMGGFIPDIVLWLTYFYKSNELPLRLAWFWTALSTVNIVGSLIAAGVLQMRGVAGWGGWRWLFLLEGIVTLGIGILSWGLMPPGPTQTKNWFRGKNGWFTDREEFIMVNRLLRDDPSKGDMNNRQAVGPARLWLALKDWEQWPLYLVGLTTYIPPSPPSTYLSFILRQIGFSVFEANLLAIPSQFLFAVNLLIISWVSERIKERAIISSLANIWIFPWLVALVTLPATASPWVRYALLTGLLSYPYCHAILVGWNARNSNSVRTRAVSAALYNMTVQSGNIVASNIYREDDKPLYKRGNKILLAICCFNVLLLYGVKAFYIWRNKKRDKQWNAMSREEREYYILNTTDEGMKRLDFRFAH

SEQ ID NO: 1614 - protein, 619 aa, Unknown
  Kingdom: Fungi, Phylum: Ascomycota
  misc_feature (553)..(559): Xaa can be any naturally occurring amino acid
  misc_feature (598)..(603): Xaa can be any naturally occurring amino acid
MAGVASRLSDLERLIPSMAPAIGQSVHTGSVIPSRSFRQESDAASHTHEGCSVDAVSMENQQAFGNEILVQRGSRSQYFSEGFIARVIEKQQDIQSVLSTPQTDRTEHIGSLASKPIAIFPPAQSPRGSSALFPSSQVGLRLWNVYVERIDACTGSKVLHIPTDEVRVCAAIDNPTQTPAEDRAFCYAIFYAAILALRPAEARAILEEDIAVAQGRFKAGIEQSLAEAEILDHPTLTLLRALSIYLAALRQCSSGNSIWILDGLALRMAQSVGFHRDGERLKLSPFESEMRRRVWWHLLAFDSLTAKDHGIQRLSNMRSDANLPLNVNDADLYPEMEQLPRPRPGLTAMTFSLVGYHIVCTENRLEHIVASSTPSAPPDEALRLQVIAETRDHIEKWLQDCNPVVPRQRLAILASRLAIRKIDLSSRQQWLALHHRGCCDALTTEENLVNAVEMLEIVLEMRNDKILEPYAWLWKSHPEYDATMYLLWHLCTRMEGPNIDRAWQIVDRLPELEHDFESSGGSRRVILSTLMAKAEKIRSGERERPLESPCRQXXXXXXXDHLGATVETRDESRAPVQDPDLDWGLFAEAFQLDSQLFXXXXXXERHELGDQTIGVQQDL

SEQ ID NO: 1615 - protein, 593 aa, Unknown
  Kingdom: Fungi, Phylum: Ascomycota
MAASSTPKAVSPPPVLNDSASNKDLQTAYSKLLAKFQLVENNFKKARELLERRKTEREQWVKRTAMLQEELDKLQHSGKDDSMALRTPLGEVASSAILHAMHTSSELSAPQKPASPARPIRQTPCSTQSDADDGPEVALPILSGSADQQGPAVKQEPSSDSPVVVSERSVRKRKRDLDQDEPAPARVKIETTQESNPPPRLDRFIFNSEDNLDLGEVAQRISTPRKRRDARVEDGDGRTPTAAPQIPPAIRQARPGLYARATPGSVRPSPLTPIDGNRRSKKVTALTSGTKRTQKDIEYGLGLLAEDGISYGLKEKPSHNLAGTPVSRSRLDDLLNNPTVGEPSPNISRSVARKLAQPATPRDDLLMPKPRELPFDKSVRASGEYAFVDKSEPSPSVTRRNRSPKRRENPSLQKRYGALRTQPLSELKLDDFKINPKANEGVNYAFSDVVRDKSERAALPGCTDPHCCGEEFRALAISQRPNPPLTSDQRREEQRLLEEYLGDHAYRLAAMTKQERADVWIDAKTHELANKYGKHRHRYSRMRSPPGFWNADFPNTQEIEKEKQEASIRERKIIEERRREAMRPGGRWVFRDE

SEQ ID NO: 1616 - protein, 1393 aa, Unknown
  Kingdom: Fungi, Phylum: Ascomycota
MAASVSSQAGAVTSRKRRGRRRRQDKPALSARLVLDNHIKGDVGILSEDLFSNLFPQLALDNDQDSTPDVLHVALAPWAPNVTPDDAAWSIVPIIRSSALAPSTLQFSPSSPALQSFAVTLQQVAPSKLSSHSRSGIDILLLDVAPLPLETVYVSLESELTKRLENGEGTFFRDHPKAIEAKTSNNAGPEVRLASALRTALGSLKVVHAGDLFPLPLPPHPVTHIPPNPGKIMLCEPVAQGILTEATKIILMRGRVHVKRQQVIATNRRLNGVSEEDEETSTDQFFSAAEERYRTDAATEATETATETETDLSDHDLEDELSDDSMDDMISLQAPALPTTNASGVSTMQPGTPMTLGTLRGRRTNGIATPGSVFSNFTATTARPDRPRGRLFRAQGLMRPIPSDILHPKPTAEDDDEARIYVDTSSLSKIGCFSGDWVRVEVAEEPPANGFGAFGLGSFGQAEPDAASWRPVRVFGLPEGYSQRAVARLPSSKPGERRLSFFESQIQRPTTSTAFASPILIANLEDAAFVRIAPLKKASYHGKGTNPKFASASRPPYARDITIHHIRTPISAERAYQTAVLGGLKRYFAQKTRLVRSGDLIAVPVDAQLGRVLQEVPGAGGSEVDDVVGLSAPDTSSQSPAAHYDSVAWFKVGHIRVQRSDDDEDESTEGFWGSVASIDSSSVAMHGSGFETSKIPGIRQSTWQYYLGLKKNPRRNSDPTVPHLAERVQPYISPLRRQLCELLAAATSRRAVHLQMPPMAILITSTHRNIGKATLAMNACADIGLHTYSIDAFDIISDDGGGGGDVKTEGFLRTRAERAASCGPDCCALLIQHVEALTADRIESTMKEILEDTRVLIATTNDVDKVPDGVRGLFTHELEVTAPDEAEREAILKNVIDGRGVSLEPSIDLNAIALKTAALVAGDLVDVVERASIARQARLEELLTRLSSDTTTLAMRDIQVAGGPLARCLTRSDFDLAVEAARKNFSDSIGAPKIPNVTWDDVGGLGNVKDAITETIQLPLERPELFAKGMKKRSGILFYGPPGTGKTLLAKAIATEYSLNFFSVKGPELLNMYIGESEANVRRVFQRARDARPCVVFFDELDSVAPKRGNQGDSGGVMDRIVSQLLAELDGMSGGEDNGGGVFVVGATNRPDLLDPALLRPGRFDKMLYLGVSDTHEKQLTILQALTRKFALHPSLSLKNVAQSLPFTYTGADFYALCSDAMLKAVTRQATSVDAKLRALNASRPEGTPPMSTAYWFDHHATAEDVAVTVTEEDFLKANEELVPSVSAGELRHYEKVRETFEGGRGEEKKGLEQQGREAVGTAAVLPGPTSKGKGKAIVGKGKGKAVATSDDDDDEYEGDMSVLGNGHVNGKGKGKAVAGFQDGTASDDDGLY

SEQ ID NO: 1617 - protein, 775 aa, Unknown
  Kingdom: Fungi, Phylum: Ascomycota
  misc_feature (260)..(262): Xaa can be any naturally occurring amino acid
MAQDASTLSRKRPQSPDPTEDLAAKRPKLSDSPATPTGFAGLNAIANKISQAFGYNSQAVQNHAVPPPPSVPQNGFQTATQTFNPAASPQRPNTIPALAATSPSPAKYRPAIKLAALRGTKWDDGTGTKSPSPKKTTPRRRPAGAGSVQGTPTKGTPTPNKGSPLKRAAAVGDVDSGDDLSASGRTPVSATKSAGAKRLFSTTKASTPKSILTPKKKRGRPPKNVKFGSRLEDDEAAADEDEGEGDIVCGICARGHSKAXXXNQIILCDNCDFAVHQECYEVPEIPTGEWLCKSCAQEDVLKMPKKLDEVAAIVKNVEVPDIPNLGAHVRSLQRVLLDRCTGHRPLRIFGQQEAQDKARQLIEQTVVAGEGNSMLLIGARGSGKTTLLEGIISDLSKEHAKEFHVVRLNGFIHTDDKLAVKEIWRQLGKEMEVDDDLININNYADTMTSLLALLSHPSEIMGTGDGVTSQSVVFIIDEFDMFAAHPRQTLLYNLFDVAQSRKAPISVLGCTTRLDVVEMLEKRVKSRFSHRYVYLHLPRSLPAYWQMCKQGLIVDKDDAEAEGIDVELEGYEEFRNYWSHKIEALYKERAFQDLLQYHYYTSKSPTAFFAEWIMALASISASDLTLNVPPAACNDGTSLLPPDSRMHLLSTLSELDLGLLISAARLDIIAHTDTVNFAMAYDEYSSLVGRQRIQSATSGMLAIGGGARAWSRGVAGIAWERLVSLGLLVPAGIGGARSLGHGGLEGKMWKVDVALEEIPTGVKLNAMLAKWCREI

SEQ ID NO: 1618 - protein, 993 aa, Unknown
  Kingdom: Fungi, Phylum: Ascomycota
MNPRSRDVAPSEDAEREDEIQYGSVGMTREELDKEYPNRPRNHSKTLPFSDLFRDLFNPLNENKKQPSGGQQRKRGPHGASKLSPQEQRRNIIERFIGRWRKEVGDDFYPALRLILPDKDRDRGVYGLKENTIGKLLVKLMKIDKNSEDGYNLLHWKLPGQTTASRLAGDFAGRCFEIISKRPILTEVGNMTIAEVNEQLDKLAASTGEAENLRVFELFYNKMNAEEMMWLIRIILKQMKVGATERTLLDLWHPDGEALFNVSSSLRRVCWELYSPEVRLESDEAGIAVMQCFQPQLAQFQMPASFQKMIDLLRPTEEDPEYWIEEKLDGERMQMHMVADPSHPGGRRFCFWSRKAKDYTYLYGNGLKDENSSLTRHLNNAFAKGVRNIILDGEMITWDMDVDKIVPFGTLKTAALAEQQNKSGSNSTGHRPVFRVFDILLLNDKQLTQYTLRDRRNALEKAVKSVPRRLEIHTYTSATSADAIEPLLREVVANASEGLVLKNPRSMYRLNSRNDDWLKVKPEYMSEFGESLDCVIIGGYYGSGRRGGQLSSFLCGLRVTQNHIQAGANPEKCFSFFKVGGGFRAEDYAEIRHRTEGKWIEWDQKNPPSEYIELGGGEARQYERPDMWIRPKDSVVISAKAASVGPSDQFAKGFTLRFPRFRRLRLDRSWDTALSLEEFVDLKKRVEEEAKDKAMTVEDRKRRAPKRVKRELVIAGEDAAPAVFEGPKSKVFAGLEFCVLSESAKPYKKTKTQLESIIKENGGTVSQRAVPKSDMVLIAEKKVVKVASLVKGGDVDIIKPKWIQDCTEQNFDGSIPLPYEESHLFHATAALASAAALNTDQYGDSYARDVPVDELREILDGMPKLEMTEPFNKSEFLEQLESRGKGLSELRSWMFSRCIISLRPASSGDEKTADRLSSLVRYAGGRCVNDRKDAEVTHVVIVGEDAMEAGEMADMLRREMSERRKMPRIVSGKWIEDCWTEKTMLDEEAYAVQ

SEQ ID NO: 1619 - protein, 1576 aa, Unknown
  Kingdom: Fungi, Phylum: Ascomycota
MSAPSRTRTHARTAGDAPIAVRAPPAAEYGTMPTPKQLRYFEPTAATASMFLYAQGASVLLAVDNQSEKGGGRLVVSYDAGQTAIVWDLMTGDEISRFASFEDLTVASWMRSGNVAFGNTQGNIIMFEPTTSEHISTRTIDQIAITALAPSADCRTFAIGYQNGSLLIATLQPRFTIIHQLQTPTRAPSPVVTLSWHASSSRQRSDMLAVQAHDGDLRVWSVAKSPSSDDGAKIVRLLKRADDLTTGANWMGWSKNGRIIQFTDSQTHSWDVRTKHVTCDSIPTLEHVKGLAVYGPGATLFTLGPNGTVQQFDLNSPAIMVANVQHPVNPLPPSPPNSIEEPGVKSAHSTTTINTSASESELSSIPVGETVSESDEDHLSPFQRITRHHDMDVGVDPVNERIESPASSRSGMSSLSRSSAGSGTPRRHPGSAISRGMSDHTYISAGSSVRTSTVGRKDLDTLSMGYTMPSSSFASQSSARSRQRPSRLRNEVPRSPDDNKVHELFVYTRARLTDIPYKHPASSDFSRLTNDDLRRQMLSTIFGWHKEVDDLIRDEMSRHPAGSTTRILLAKWLGDFDSGTMVADSKNMSSSDWMLLALSGIGGQASQHKLGRTYVSRLLESGDIHAAVTIMLGMGDFNDAIEAYMAHKRYMEALILTCLEFPSVWERQAAIVRKWGEWAIQHNRQQLAIRCFACTDMESTEPWTSPSAQQLNFKNITASIPEILSPPLSPPGVQRGPQRSIAKSSALKLITSFGDQNKKSKFYSQGDGGQTPLAAGVTPIAESAVSPGGFEAATAFLRPSNNSRFNTPTSASAMGPRGRLPSIGEIPSDLNREALRSEASRGSDHRGGHTRRASSGQDNLAEGLSLQRAATASPMMMRDQRPARARAATHGEAPPAPDKKVMEMMEKGDFARRNGSRDRMPRGLRLDLAPDEDTEIISPEQSVSSSTRFHWPTRRRGPGSVSSSVTSSSAGRSLRGRVRHPDDYIHSLDAASSLKVARKAQSSRERATGSIRQASRERKGAKSRETSEDRGRSSARMWHKPKRSPTSPVPMSPEDIAILSNPIFTEPSEPRTVRKSSVVKRKTGSRTSSRGSRRQSPDARPAPLDLRGRSKDRDGGARQRSPSSPLPMSATAMHYAGSEDDEDFQRAMQAQEEFRAKHSRSVTRGLNSPIVSKREHSQARQKDVAEAIENLPSIPAAQSRTASTDQAGDLRRMKEERLRKKEQAARELEERRQSLAQRGLATPIPPPNQGGYNFPRLGIETSNPDSNADIPPRSATTSPPRSMYARGGPHLGLPATPKAMRLIIEGDPNVRVSQAMPEVPTIPSQYVQQASQSQQPAEESKQKPLAAEPELLTLLPSTVYQPPVRPPPRSMSAPIPDDPSKGRSRRKASTGEIKPIAEKLSDSEVMPPPPPPAPPMLKELQHLAIPPPPPPAPLPNAQRSQQNTALSSGMIEIVMDDEEEPEPAGVAAPNDNMVPVLSPPLPPHSRGRSIGDGSSIASTFAKAKDRLRSGSRGRKEPARNPGKESPYESVPTTQLQPTIRSPPPVMYDQDALRTPIGIDSKLSKHMSTGLHQSEMI

SEQ ID NO: 1620 - protein, 303 aa, Unknown
  Kingdom: Fungi, Phylum: Ascomycota
MFEGLEPFTLTTQDDPHVVIYGLRSGNANANANASRPALLLLHGFPQSRHIWHRVAPQLLEQYTLVIPDLRGYGESSKVGSVEAYAKSAMARDLVSVMDQLGHETFYVCAHDRGARVAHKMCVDFPDRVLKVMLLDICPTLAMYESTNFEFAKAYFHWFLLIQPAPLPETLIAGDPRKVLSMFLGAREGDNLSIFDKECFDYYALIMEKPDAVHAMCNDYRAAATVDLEEAREDLRQGRRVKCPVRVLWGKYGVIERSFDALAEWRAVSDPGVAVDGQAVESGHYIPEERPEAVVAAIKDFFV

SEQ ID NO: 1621 - protein, 404 aa, Unknown
  Kingdom: Fungi, Phylum: Ascomycota
MAQDRKPVLIIGAGVVGLALANGLKKIGVPFRIFERDAHACARGQGWAITLHWALPFLRELVSPATFAAIEAVQVDPDADRQGLGKFVFINLATLEPKFLIPPGDRRRVNREKMRRALLAEVEEHVCWSKRLASVEETNDGVAAIFEDGTRAEGCLLVGVEGSNSRTRKALAPETYKNLPLPIRFTGAALDLTPEQVKPLKDIDPLLFQGCQPTTNVFFWFSMLETPLVNGSAGTEREHYRVQIMISWPVVSPEDEVKPTDAGRLANMKARAEGFHPALRDIVEMIPEGTEVTEVVLQDWPCLPWDSHGGKMTLAGDAAHAMTMYRGEAANHGLLDAHRLCKAIGGFFSGEVEMKKAIDGYEAEVRERTSTAVLLSRQACLDAHDFAGLNENSAVLKKRAIAGV

SEQ ID NO: 1622 - protein, 448 aa, Unknown
  Kingdom: Fungi, Phylum: Ascomycota
MATETGGPGAAGPASEGKASQEKPAKAASKDSQPAQGDAGAAGEKKLSNAELKKKAKEEKAARRAQAKASSAGPGSGAQGSTDGKGGKAKQKQDGPQGQQQGRPQARPAAPVPTIPKEVKPTVPECFSHLSVARRIDMTQADKDVHPAVLALGQHMSTFAISDSITRLEATLLAFKKVIDSYTPPHGTSFSRHFTSHILNPQIEYLSACRPMCFSMGNAVRWLKLQISKIDIDLPDTDAKKLLSESIDNFISERISLADYVIVKTAADMIEDGEVILTYAHHHLVEKTLLRAKEQGKSFEVILVDDPYERVGLAHAKTLSAAGIPVSYSPDLGALRSNLRESTSLFVAAEAMFSNGAMYARAGTCDAAAAATDLGLRVVALCETINFTERVSIDSLTYNEIDPERNSGEGFRLLFDTTRDKFVTVVVTELGNTAPTSVPAILRKLEEL

SEQ ID NO: 1623 - protein, 408 aa, Unknown
  Kingdom: Fungi, Phylum: Ascomycota
MMLVSLTVGKVDAGVTVLLTPDKRLIEFPSILLPPDISSGSIVDIAVSQNLEKEAKAEQDFRALQERIFSSFGAAEPAIPVLRCRNATQTSVVLEWDPIELATADLISLSLYRNGQKAGNIPRPLQMHSTKISGLAVDTKYVFHLVLRTSAGTFTSEKVEVATHKMTDLSGITITTGILPAAIKERLTETVQRIGAKLVDSVRIDTTHFVTTEGRGQAWEKAVENNIPVVRPEWVDACEKNGRILGVAKFYLDAMRPGPPVEEAPQRSQPAAAPPVQKELPQAPQSADEGNAAAEGSTAKDYASVGGEKKQSEAGDQSSSEEDDDDDDANEPEQKSRNAAPEEEQKVRAEDVEEQKLAMRPAAPDAANTNGDDAQGSKSDDADKIKDEDHEKDAAQTPDGASFTDVQL

SEQ ID NO: 1624 - protein, 806 aa, Unknown
  Kingdom: Fungi, Phylum: Ascomycota
MPGASVAVLPPPAASTPSSRKASLAPERKYKCQFCNRAFSRSEHRSRHERSHTKERPFKCMKCRSTFVRRDLLLRHDRTVHAKDGGVPLHSDGKRRAGPKTRAVGGPAKSSLALDAGALEQMEAGNDNIFDVEAAAMLVADLHHKATASMRDESNYEDSPSMAYSPHNSSMMESTVTYPSGAIALPQVQWDGFMPQSVAEPKAHSITSSAGSFDSPQAYAAATGRHMHPNQLPPLSGRTNNGLVPALHAMISSLPNSGAGTPVPQSPAMADSAQAGFRVPQVANDDERHMILDNIRKHDIERSIIDSFRLPGLGSLNRYLSTYFGLFHHHLPFLHPTSFQPSQVSSPLLLAALSIGALYAFDQEQAYMLHIGSKMLVNQFLQNKESFSSRKCPLWTMQATLLNMIFASWSGDPKGLEWACSIKSLLANMVAGNKYELKLRQEARGGAKPSRAEWVEDEGCRRTYYAVYIFFGLLTLTYNHTPAIGFNEFEDLQLPSSETMWNLNVTDESTWSEQLQISPIVSFIDAHDKLFQGENMRYSAFGARVMINALFLEVWYHKRSPEALQDVVTEYKLRLALETWEKSLEFCEPENSTVPLSAPHKGHPLVFNATAMLRNARVRLEVDLKSVQEALRYHDPYEVGAAMSNARDRVKRSGEMIKVIEECYNCIQTAVVQGIRWVARTSPTNWSVEHPLCGLDLMIILSLWLYRLEHDEEPATQEELIMYNKVRQLFAKDIDEPLIGNLSSVVARLWGEMLDEVVVWGITRLMGESFKLHAQALVGYVDDLEASSNPSTPSMTSQGADEDSVY

SEQ ID NO: 1625 - protein, 785 aa, Unknown
  Kingdom: Fungi, Phylum: Ascomycota
MVKPKVLFAALIVLPFTSGKWTNGRSVHVPLGSLFNNKAFGASPGEASLNILNESYPADPVGVDGVYQSTDTGISYLFPGYNPDKTAKDNVICAGQTIDADPSDSYFAASMLLVSDTRSTTVSGNVTLLYTDNTTSTAEVRAHAFWWFLAIRRGEITFPYFFTHNDTNHNASHIYERSVILEPGKRLQGIVLPDTTNTTTGRLHLFSLSLWETKTAGLQIQHVRPTQNTDGHGRQLVEVVVDHAGSGCISNMAVAIEGRGIKTPTPAIVKRLCSGDQKRILVAVKGTASAATVKVSLKARKQPLIEASFDNVDFGLREWNSQSKSLVKHEAPEWYDGAKFGIFIHWGPYSVPGWGNSTPYESYAEWFWWYSTRVKEHAAADRSGFNAYRLRTFGPDLNYDDFFENYTASKYEPKEWVNLFADSGAKYFVFTTKHHDGFANFDTGASTNRSSLHYGPRRDLLGELFEAAKKYQPHLKRGTYFSLPEWFNPDWGKYGFTQFDRVTSTSHPGIIARNPYTGKNEPYTGRLPIGDFIGDLMVPQMKTLAYEYDTDIMWCDAGASNGTDVFAAEWFNWARSQGRQVAINDRCGSPWAADFDTPEYATFSVAQTRKWESNQGMDPFSYGFNRATNADEYMNATTLVHNLVDIVSKNGNLLLNVGPRPDGTIHQKMMDHLREAGTWINRHGAAIFNTTYWYVTPEEGDLRFTQTNDAFYILSLKEPAQGSMSIESKVPIVAGDKITALGMDKERDVEWSLSDAGQLTIEVTEEMVAADKFCWVFQIKYSSRC

SEQ ID NO: 1626 - protein, 363 aa, Unknown
  Kingdom: Fungi, Phylum: Ascomycota
MTMESVDHLPLSYKAAVYDKPGDLSIKITEKTMPVPGPGEALVKLTHSGVCHSDLSVMKNGWQMPFPVPDTQVGGHEGAGTVAHFGPGADAYGFKVGDPVGIKWLRDICGSCVYCLAGEDGLCGKQSVSGLFQPGTFQQYVTVPARYLTPLPAGLDPAMAAPMLCAGLTSYGALRKANTKPGNWLVVSGAGGGLGHLVTQIASRAFGQRVIGIDQASKESIVKESGAEFFLDVTKAGGDMVAKVMELTGLGAHTVIVCAASNAAFGQGLELLRPGGTLVGVGLPDGDPVPISTATPGLIVTRQLKLLGSVLGNRQDAIDVLDLAARGIVTLHYQVRGLGDLQQVFEEMDNGTIVGRVVLDLDR

SEQ ID NO: 1627 - protein, 216 aa, Unknown
  Kingdom: Fungi, Phylum: Ascomycota
MASQAAPSTSTRIKQEGDTTELYWQPDIDGRLMQLFYLDGCWDMASMDKSFELEVLTKLQSLEALIPAFEARINRSDHGFDAWKRLHQFEMNAGRAQFIQMFVKMVKWDKDRTVKKVLWADQKWEVRYAWIVRQREELATIRFSHLEQLGLFPDHEGFFGPQVERPSRIRAKKDRKKEIKGGAKRINQKWSAPVDERLMEAAGGPGTRYDMFRAAF

SEQ ID NO: 1628 - protein, 294 aa, Unknown
  Kingdom: Fungi, Phylum: Ascomycota
MSEDVRDEIEALNSIYGDGTLGPAMGEAPCANIWILQLPRGGEDGQDEDASSLRIRFPPNYPEASAPEVLGTEHASGGRRGAGERDLRLFREAVAETWQAGAVCLFDAVEDFNRRLAEEIQREEAEAEAADEEGVSVEKPEKQQDHLEELLAKMDTPPWTLSEVVTDMKSTFVAHVAPVSSPDQASLYIAHLLASDKRIRTATHNITAWRIRDDSTGTTYQDSDDDGETAAGARVLHLMQLMGLWNAVVVVTRWYGGVKLGPRRFAVINAVARDGFVRAGMVVEKPEGGKRKGK

SEQ ID NO: 1629 - protein, 256 aa, Unknown
  Kingdom: Fungi, Phylum: Ascomycota
MTVATINTATTAAAPAANTEPFLPPNVALPSHSLDGSDGGADSLIRNHAARRCSRILRSSIPSRRTSHACVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQVDLRDDPSVREKLSKQKMSPVRKEDGERMAKELGAVKYVECSALTQFKLKDVFDEAIVAALEPPAPKKKSKKCLVL

SEQ ID NO: 1630 - protein, 315 aa, Unknown
  Kingdom: Fungi, Phylum: Ascomycota
MTESVSSSSDAAAQRAAEQARLRKERREAKIKAGGSARLNKITGMGGRPEIDTADASTPPKPSPTPSAPSAADADPEEVDISQHFYAPSRSARIPQDTPQAALGDEQLRQMMLGFERGNANASPSPMAGMPPGAEEDPIMKMMAQMMGGAGVPGGAGGFPGMPGMQGMPGMPGMAQQQPAVPDPYTSLWRLLHALVALGLGLYITILTPFTGTKLSRERSVEAHLSGADDEDMHRKNLFFWVFATAESVLLTTRFFLDKSRPPPSGIVGTVVGFLPEPFKGYVMTAMRYWQIFGTVRSDILACMFVLGVCHWLRA

SEQ ID NO: 1631 - protein, 379 aa, Unknown
  Kingdom: Fungi, Phylum: Ascomycota
MAQFPPPPTNTIDWSNVGFRVREVNGHIESTYTRATGKWTPLRFVADPFMRIHGMAPALNYGQQAYEGLKAFREPGDKGIAIFRPDRNAVRMQHSADVVSMPRVPVDMFVDAVKAAVALNAEFVPPHETGAAMYIRPQLYGSSAQLGLTAPEEYTFCVFVIPTGVYHGTHPVKALILDDFDRTAPKGTGNAKVGGNYAPVLRWSDGAAKEGFGITLHLDSARHEEIDEFSTSGFIGVTKKSDSDITMVVPDSNCVIASVTSDSIQELAKSYGWKVEKRPIKYAELPNFTEVMAAGTAAALVPIRSITRRASKGLAQGDKVTTTEEEETVTYLPESQEEPGEFCVKLLSHLKGIQVGKEKDQFGWRFQVEEKDGKVEGAA

SEQ ID NO: 1632 - protein, 241 aa, Unknown
  Kingdom: Fungi, Phylum: Ascomycota
MAKNTTSFARIAHFLLVPGSAVNVWVTTYKNYAVNSDTSSFSTLDVSDPLNLGLLQDETYTLKAPGPDADRQAQPHLHHPVVEPTGKYSLWPDLGADLIRNFEVQDGWIAWKHIAPSVATPGSGPRHEYTNGLGLIKVFDIRTRSGNVSVPASTNAAELVASEASFTILAFDGKAEIPSDPRITFKTAPVGGMNPRSFSPNADGTLVASALQDDNRVVIVKRNIRAGKFGGFVAWAMVEEG

SEQ ID NO: 1633 - protein, 697 aa, Unknown
  Kingdom: Fungi, Phylum: Ascomycota
MSSDYSYDDQAQFFPFFILTLTGLVTLPLTYTLLRPSTDDDALAPRIKTDYKPQHGEVVEALRSKQKRKQRRVKRALVVVLGWAIMGAMVYLIMVTQRTVLKIWNPYDILGISDSATEKQIKSHYKKLSIKFHPDKVRPDPAKNETVESLNNYYVELTKAYQALTDEEIRNNYIQYGHPDGKQSFSIGIALPQALVSDGNGKYVVLLYTALLGILLPYVVGSWWYGTKRRSKEGVLMESANSLFRQYDDSMDEAGVVAALSTGKEFEEILKGDQADSGLSKIESRIGTQNSNGGYACGFSAKDKAKLEDLENGVRRKTLALLWAYLGRIELDDAALTKSKFEVAPIAQALNQSFRAIALAYGNIKPIVGSFQATQHLVQALSPKSSPLLQLPHFTPQIAAAVDGDSKAQSTVQEFLDLPDARRRQLVVGNGLLSEQQYKTVLSVGRQLPYLRVAKAFFKVTGERVIIPSSLVNLVIKGRIIPPGAENVPEINELDLEDVDPAEDDLDAINGRKKTIKGPDGKLTTVETESVLPPRTFAPHYARNHTPNWFIFLSDSKQGKMAVPPFTFTKFDQPIFDDDGKPTFNMQTFKAQFAAPPQAGHYTFVMHVVCDGYVGFDTRMEVTLVVEEANKAAAMAAEDDISEPEEDSIAGQMHALKTGQVPQGGKTRKIEEDSDESGTEEEDDDTSATNTDTEDES

SEQ ID NO: 1634 - protein, 483 aa, Unknown
  Kingdom: Fungi, Phylum: Ascomycota
  misc_feature (367)..(375): Xaa can be any naturally occurring amino acid
MISKALLLNAALLATVLGAPLEERLEERQACASQWGQCGGISWSGATCCQSGSTCTKQNDYYFQCLPGAAATTTSTSVRSTTTAAGSSSSSTRVTSGAPASSTTAATRTTSASGTTSASGSSTTRAPPVGSGTATWSGNPFSGVDLWANSYYSSEVHTLAIPQLSGAMATAAAKVAEVPSFMWLDTFSKTPLMDQTLSDIRAANKAGSNYAGQFVVYDLPDRDCAAAASNGEYSIANGGVANYKKYIDAIRAIIVKYSDIRILLVIEPDSLANMVTNMDVAKCAGAKSAYLECTNYAIKQLNLPNVAMYLDAGHAGWLGWPANQAPAAQLYAQVYKDAGQPSSLRGLATNVANYNAWSLSSAPAYTXXXXXXXXXSNGWDAKFIIDQGRSGRQPSLQNAWGDWCNVIGAGFGKRPSANTGDALVDAFVWVKPGGECDGTSDTTAARYDYHCGLADALKPAPEAGSWFQAYFEQLITYADPPFL

SEQ ID NO: 1635 - protein, 687 aa, Unknown
  Kingdom: Fungi, Phylum: Ascomycota
MRSGSRVGPPPTEKTAGVACERCRKRKIKCDRHIPCSKCTRAKVDCSFPGGGERSRPASRKHVQALETQIKSLESYIEKLTSSDEVTRSRILAERATVAPNKAASPPEDSTGGRAPESTSTPESGSLVLARMREGRMYRFSARRAAQFYGGTSLSQLHSAGQAVPVTAHYAIISPSTQGHAAPSVPAAIDPLPFPFHAKDAVCRQLMAAFFQNIYHHNMHIYREYFLRDYAAAGGPYYSDALMFSICAASALISEDHEIRKLSPVFARHAGTIVFNSLDMPDLTTLQSLITLGHLEVGQGRSSKGWLYCGMAFRLAHEMGLHLDPTNWCSNKAESSLDREILRRVYWAVFVADKQLSLYFGRPPALYPQEADVRNTIRIPYPPEWESLLDEYISKGTSATAFEDGIRMIRCFVHHVELAKIFHTLIVDVFENRTRRSDAAAAAAAAHRVHTDLERWHSLLPKSLHWNQWTLEQVPHYVLNLHMLFHTCMIILHRPPRQHLDDEAVARSEGVEVCYQSLSAILRLLRSYQRYYRLEIMPLALVQTLSAAAEVIMLKRYLEKSSWSDKDISKPTAQILEAMGVIQDVYPCIRDIRQSIVTNQEAEDSTAHANVQEPGPVELDLMDFLQAGAAPFPSWLHDDSPSSNGSDLGFLVTDDLVGEPESFDPILDPASSRSWGWHPSSAAGVDQ

SEQ ID NO: 1636 - protein, 478 aa, Unknown
  Kingdom: Fungi, Phylum: Ascomycota
MPYGIQRLNVKRSQPNPNVVFIKPLAGPDEKVAQDFLERIAAQCLPVMRDNMLSVMSLEEFPPNREFVGRNFNAGEVIQLVLKSPSTGRWLPFEYVQMVMMHELAHCKQMNHSKAFWAVRNQYAAQMYGLWSKGYTGDGIWGRGANLRTGEWENNTVLSSEVLPEHLCGGTYRSRGRKRKAKPSLTYQEKKERRILKKFGKNGMALGADEEAKVKLEKGKKVQGKPRVAGSARGRELRAAAALARFEQAKTEPDIKGEEAADSCSESEYEDGDPDAKDALDLDGSRLVDGHGRGMIKVCEDEVLDDPSARDETKELRDVLRGKVKTEPIEINDDSDGEASRETANRTKPDGSRQPRSLWDVPPAPPSAHQSKAPASSRDKPVIDGEGASHQSMRNTTSDDKSLSAPRRSTEKSTRLECGICTFSNSSSALRCDMCANVLQRTADPEAWLCTSQVCKAKEYVNAGDCGLCGLCGNKKPV

SEQ ID NO: 1637 - protein, 986 aa, Unknown
  Kingdom: Fungi, Phylum: Ascomycota
  misc_feature (958)..(964): Xaa can be any naturally occurring amino acid
MFTFCPLQGALSEGLSSQSLLELDGGVKILVDVGWDESFDTEKLKELEKQVPTLSLILLTHATASHLAAFVHCCKNIPLFTRIPVYATRPVIDLGRTLAQDLYSSTPAAATTIPQSSLSETAYAYSQTASTAHNLLLQSPTPDEIARYFGLVQPLKYSQPLEPLPSPFSPPLNGLTITAYNSGHTLGGTIWHIQHGLESIVYAVDWNQARENVFAGAAWLGGAGGGGAEVIEQLRKPTALICSSRGGDKNATGGRAKRDEQLLDMIKACVSRGGTVLIPVDSSARVLEMAYLLEHAWRADAADENSDGALRSTKLYLAGRNMSSTMRYARSMLEWMDDSIVQEFEAFAEDQRRTNGNDSKKLGGPFDFKYLRLLERRAQIAKLLSRDAENVETQGRVILASDSSLEWGLSKDLLKGLAKDSRNLVILTDRPSSASADKSSVARTLWEWWKERKDGVAVEQSRSGENLELIYAGGRELEIREARRQALEGDELALYQQWLATQRQLQATQQAGGAGGLEAAADTVDDASSESSSDSEDDGEQQGKALNVSTALGQAGRKSVVVKDEDLGVNILIKKKGVYDFDTRGKKGRERSFPLAVRRKRNDDFGELIRPEDFLRAEEKEDDNADGGNVAADDDKLGKKRKWDDVAKEARGANGRRPLNRAGSAEHGEGDGTTADGFVADELDDVEDVEPEEPVGPSKLIWHTENVAANLRIGYVDFSGLHDKRSLNMLIPLIQPRKLILIAGSHEETMALAEDCRTAMNLEAGAGEQGKRAGDVLTPRVGESVDASVDTNAWVVKLADPLVKKLKWQNVRGLGIVTISGRLLAAALASQSDKDAESSQPDDEHSNKRQKTDPSSAVVPLSSSLTTTPLPTLDVLPATAQHRISASRPLHVGDLRLADLRRAMLSAGHHVEFRGEGVLVVDGTVAVRKTAEGRVEVESVGLPGGRRGTMGEVKRVIXXXXXXXGGGRGGGGGQGQSGELYGENVV

SEQ ID NO: 1638 - protein, 108 aa, Unknown
  Kingdom: Fungi, Phylum: Ascomycota
MDMFVPPILCYETNPANEGLNRLSQAEQRTLEQRMQKRQVKEFMSAYGGLVEHCFDSCINDFTSKALSTSENGCISRCVQKWMVTQQRVSDRFQEHNAQLSQQQQQGR

SEQ ID NO: 1639 - protein, 603 aa, Unknown
  Kingdom: Fungi, Phylum: Ascomycota
MALAKPVRVLLLVAVVLWCIFLWQMFFTSAPSISGPEGKNVNFDRDPNLDLTGEPEGNLVRTSDNYNVDAEHTERINATILALVRNSEVDAMVRSMVDLERTWNRKFNYPWTFFNDEPFSEEFKKKTSAATKANCRYEQIPADHWEMPNWIDEQIYEESAKVLKENGVQYGNTSSYHRMCRWNSGMFYKHPALQDMEYYWRVEPDVRFFCDVDYDVFRYMHDNDKTYGFTINLYDDPKTLPTLWPETVKFLAEHPDYLHEESAIKWLTDDTARPKHNQKAQGYSTCHFWSNFEVAKLSFWRSPQYEEYFAHLDRAGGFFYERWGDAPVHSIALGLFEDRRKIHWFRDIGYQHTPFFQCPNSPKCSGCTPGRLTDGEKWLHQDDCRPNWFKGPPRDRDLRGNLPGQGIPGPDSTFASTARFAASHLITDQDVSFLAAEDRLQSETLVLPTGIRGSDQHGLSISSKRDACHACPENISGTLAHPYIVCPHPSIDTAGNDFWASDGQACNRISCLVQHLDGLEAAALHVPHAHSGVESATDDEALAITTKTDTVDACCMTMLITAEPTSRHSFSDIPQKNRSISTCGYEALVVLCDIKTQDLIAMG

SEQ ID NO: 1640 - protein, 294 aa, Unknown
  Kingdom: Fungi, Phylum: Ascomycota
MATSRYVVIIATALLSFLLSRSPILMASSPPTKVWADSPMRLVTTPQFETQKTDLFTTGATHMALLHNTIIRSFNTIYNQANHVVEADKPDFINYALTWHKFVVSHHDDEEANLFPKVEEVLDDKNIWQETHEEHETFLGGLAEFKKYLTSLSAPSDFSGPALIEIMDSFKAPFEHHFHHEIAVIAALATHPNVPAPSTPAHESASAVFKTWGKKTVSKAGMADVLPLFLLNLDRTAEGGLWANWPPLPAPIRWMMVNVVGSWYGSWWRFASCDSAGQPQELYALKGVDGANAS

SEQ ID NO: 1641 - protein, 462 aa, Unknown
  Kingdom: Fungi, Phylum: Ascomycota
MVQRSQSHSLTQGQLDAISIIERVNSVLSLFGSLFIIVTFCFSKAFHKPINRLVFYATFGNMLTNVGTLMSRSHNSEPDSIGCQFQAFLIQMFMPADAFWILAMAINVYLTFYFKFDSRRLRRMEIPYFLICYGIPMVPALVYLFLKDSEGQRVYGNATLWCWVVPEWGLMRIATFYGPVWILILCTFFIYIRAGRTIYEKRRQLHDFSSSDPDPLSVNGDIMGTIKTTEVRITTEIRNEPDDLDSNSRRLRASDTPADGRSAQDAYTITISAETDPYNSNNPAPAPFEPAFQRRPVTTARRRMYEVNNAAWAYTKCALLFFTALLITWIPSSANRVYSFVHAKSSSPPLEFMSAFVLPLQGWWNAVIYVVTSWNACKSLREDWRLTRRPSVTELVIGKHTEDSAGASTVRSQVRRASHLRSGVQLSDLRPGNKSSPKNSETESMTEFAHTRETSEDEGART

SEQ ID NO: 1642 - protein, 614 aa, Unknown
  Kingdom: Fungi, Phylum: Ascomycota
MSKLGAGTLAVAPNSDVLTGSAYDEKHGSGNEGADRGNLGSVGSSNTIHTRPQQRKLHDSDVSFEEYFYYAQKTRAEEDLQPQSQTEKSWLSILFPSKSSGGVDGVKENSDGSANKNLADPAVRANISDEEWTNASRALRTATRGAIFYLITTDILGPFGLPYAFATMGWGPGIALFTVFAAMAGYSGYLLWDVFMGLDSYQYPVRGFSDMGFRLYGPYMRHLFNFLQAVQLILNVGLIVISNGEALSQAVKFKLCFIVCCLLWAIAGFVLGQVRTLQKFGWLANAAVWINLVCMFISMGGAAHSPPNYQAASQAAGASIGDGSSVQPNAQGIFPPVTTTGGLPASPEFYGSVSGAMQAIFAYGGSMIFPEFMAEMKRPKDFLTAMWCAQTFIYVCYMFYGLFMYGYQGQYTVNPSYLGVSKYDIQTAGNAFAMASALIAAALYGNIGVKVIYNNILVEWFKCPSINSRGGKFMFAAIIPIYWAIAFVIAAGIPNFSGLTSVVAAFCILQFTYTFPPMLSIAFWIKKYAMQDGEGWDPATGQVTHHDRGFGRTMRGFMGGKDRKRGLVNIFNVLYCGGALAMAGLGAYASIMVLKTAFAANTTSSYVCKSPLQG

SEQ ID NO: 1643 - protein, 609 aa, Unknown
  Kingdom: Fungi, Phylum: Ascomycota
MTVNHSTVNGHATVPDGQGRTNNDLDIPVLIVGGGPAGLLQGYLLAKLGVQTLIVERYPQRLGAPKAHALSPRSLEICRQFGLDLEHIRSLGAQRDDAYWVNFLTTLSGDVVGRLPYERMDVGVLDYTPEMIHNISQPDFEQYVFEELSKLDNVEVRKGVSFVSLQDHGDSVTTTVEERASGKLYTLKSKFVIACDGAKSKVREYMGIQGEGEDSYETMMTIHFSANLRNIVGDRVGMLHWLFDPLASGFIIAYDLSGNAVLITNFDSEKYPPEAWNEALCKEVLTGAIGQNHDAKILSYRPWILSRRVAKSYRKGSVFLAGDAAHAFPPTGGLGLNSGLADVHNLAFKIAAVLDHEAGDSLLDSYEADRRHVAEVNSRQSVKNGQAIFRLLKTLGTAGIADVEEARRNLKAAIHDPEQMKKVAVGVEEQREHFDNLNLHIGYVYGDTSIPKSASHFTPSFQRGARLPHAWLGDKVPSFVRDQIKPVNLRYVRELSQQEVETKLYSSLDLCAPNSWTLLLPSGASSVDQAAEGLSQTAKRLNFNVLKLDRDFSVLSGAAGDAWTRDSGLGGGRGLLIRPDQHILCSIDSGTKSEDLSKVMGDFLGVSLS

SEQ ID NO: 1644 - protein, 636 aa, Unknown
  Kingdom: Fungi, Phylum: Ascomycota
MHLVKAFAIGVSVLGVVIEALPGRAQSLAKRQVTELRDEYDFVIVGGGTAGLTVAHRVSAAFPKKTVLVIEHGTIEGTVGYFDPPEDGRGASRLVISSPPVASVNNRTATVILGMTVGGGSAVNGQFLDRGSRYDYDEWQRLGSPEFDDAEEIWDWENFGPSFKKSVFLTEPSGELVDQYCYTWDSSYYDGDSIEASFPPFQWPVQNIGWKAYEEFGIETPKSCDNGDKHGLCWVPSAQNSQTVQRSHAGIGHYTRVADSLPNLDLLVSHKVLRLIIDRDDEDHHAPPTVEFRAVNGGDVKTIRPKNEVILSAGAIHTPQILQRSGVASKEYLQSEGIVVVEDLPGVGQNFQDHCGVPIVFDYDSPSPSEAELNSNETLAAEAVAQFRERPARGPYTLAMGNSAAYQSLREVTPQWENIVADIRAQIEDGSALQYLPRTAGKTVQDGYLAQLEILAQALEHPEHPILEMPFATGPGTAFLLKPLSRGSVVLDPSDHDATPIVNYATGANPIDLDIMATYADYMRRVYSTETWKARNAVEIAPGANVTEHEALVEFVKDTVIQSLMHPCCTAAMLPREKGGVVDSSLSVYGIPGLRVADCSIMPTVPAAHTTTTAYAIGEKAAEIIIKKWKKCSKKT

SEQ ID NO: 1645 - protein, 676 aa, Unknown
  Kingdom: Fungi, Phylum: Ascomycota
MVKAAPPSAAGPGVYSATYSGIPVYEFQFGADLKEHVMRRRHDDWINATHILKAAQFDKPARTRILERDVQKDTHEKIQGGYGKYQGTWIPLESGVNLAQRHNVYDRLRPIFEFVPGNESPPPAPRHASKPKAPKSKPPLPRWTNPAPVVEEYDNGDTIMEEDTPDNITIASASYMGEDERFDLSHMSTGHRKRKKDEQAQDFIEAQHSLYGDELLDYFLLSRNEQPAVKPDPPANFQPNWFIDADNHTALHWAAAMGDVDVIKQLKRFNASTSVQNKRGETPLMRSLHFTNCYEKQTFPAVMKELFDTVDARDSTGCTVIHHAAVMKNGRAYSPSCSRYYLDNILNKLQEALDPSAFQQLIDAQDNDGNTALHLAVQANARKCIRALLGRHASTSIANHEGVRAEDLIMELNASKRERGPQRSSSPFAPDSQRHASFRDALANDRSSSRRNVTFQSAAALSVQSRITPAIQDKFQELAKSYDAEWHEKDAAEAEAQRILVNSQAELHMVRQQIAELEAQLETDEAAAKVKNEANLATHQVLSLITHQNRIHVQQAVDAEVSKMNGDASNADDSTTYEERLALARHLSSILAEQRAAEVEYVDALSMVGTGDKIDKYRRLLRRCLDPKDGEELDANLDSLIEMMEEDRPAPAAEAVDGAGAPAVGAAEPMDFSVGA

SEQ ID NO: 1646 - protein, 295 aa, Unknown
  Kingdom: Fungi, Phylum: Ascomycota
MCGAVYAEPTLEIPIGLLLASARAGPTQIQSSGNTKDGRKLKPRSYPKFDNLEDERLYRKQHLAAAFRVFADRGFDEGVAGHISVRDPILTDHFWLNPLSMHFSLIKVSDLILCDEDGNVVEGNECVNGAAFAIHSEIHKARPDVTAACHAHSVHGKAFAAFGRELEMITQDALRFYKSHGVYRDFRGVAVDAEEGRRIAAALGDGKAAILQNHGLLTVGKSVDEAAFWFISLDKTCQAQLLADAAAAGGYEKQIIDDEEAAFTAQQVGGPDKGWLAFQPYYDEQLAKTKGDFLN

SEQ ID NO: 1647 - protein, 469 aa, Unknown
  Kingdom: Fungi, Phylum: Ascomycota
MTVLRTQVPVQQQQQQRPASFLITNHDIPEKLIKPWKLPPQKTYIFKNARVVDPLKHSASPLTTVTISEGTIASVESGNDSAEVSYTAEVIDLGGKYLCPGLIDCHVHITAVAGDASLSGAISSTDLAPSHFRQPYLCGQMLSRGFTTIRDTGGGTLALKEALEDEVFPGPRLFTANKALSQTGGHGDTRGVHDVNQGCCTKVSGISVVVDGVPECIRAAREQLRTGGDFIKIMSGGGVASPTDRLENTQFTAKEIQAISEVAESFGTMVTAHAYTPKAIRHAVDNGVTGIEHGNMIDKETAEYMAERNVWLTPTLVTYDAMGSDKYAGFLPPTNKAKNQAVLEAGLESLRIAHAAGVTICHGSDLLGPLQAEQSREFEIRSQALSSTTVLQGATVNAAKMLRQEEFLGQIKPGFAADMLILNKNPHEDVSILSKPEKNILAVIKNGRVFVSRWSKLPVDVQQHVSLIE

SEQ ID NO: 1648 - protein, 216 aa, Unknown
  Kingdom: Fungi, Phylum: Ascomycota
MSGKPDHTALCDVARLFGVPLDEAWGRYVESRGFTELHEVLLGIYGAEETLDEYLNRFATEGRLAGIIDAPDFSGRSALAWAVAYGWARAAASLVAHGANVNQRTPSGLGELPVLHIALAGPASGEPTCDFLAIVSLLLSAGADPNAVDHEGWTALHIAASWNSYDAITILLRCSRSPVNMSALNYEGKTAARVAMESGADRMLIDVLASGVSAAE

SEQ ID NO: 1649 - protein, 323 aa, Unknown
  Kingdom: Fungi, Phylum: Ascomycota
MMHRLTINSITPTLISNSSSSNSNNSSNSSNSNSTEGQYISTTPDFQHQASVSMANSIKLMLMDPSQMADHRLGQPTFGGPGSVVASLYNTMPPTTQASQSQHAASRLKRPRLDELDIPLASMSSMDQPGLDSIHNTPIAGPYSQAPGPQHHHHHLPDSGPPSKLARREEGGGGAPSVVGQAGMPQPAARPRGPKLKFTPEDDQLLIDLKEHKNLTWKQIADFFPGRTSGTLQVRYCTKLKAKTTLWTDETDHKLRTALQDYENEKWRIVANKVGTGFTPAACRERFEQLLVGAPPGSETNLNSPPVSGAALGETSMYAQQLR

SEQ ID NO: 1650 - protein, 520 aa, Unknown
  Kingdom: Fungi, Phylum: Ascomycota
  misc_feature (506)..(511): Xaa can be any naturally occurring amino acid
MVDPSTHVLHQPLFEQQLPLTHGAVTPAKADGPRSGARRMDKLQAILLGSPSLQGSHQAYRDLDVELRSQAEAVTKQLPETARALITAHPQEILEWLSPAQHTISYAAVLDVLVRPETTIDRAWLQNKVEAFLEGFDWIHIRFIGDALTRLLSRISVMGLFKPQRTIELLASTILRVDPTASVFTSSHLVLANHALTLGIVDPALPVLDRDITAYPPTASVRGGRPLSDPSLSATIYVSTFTGLTEPVKASMVLDYGATLSQIYISRKDWQKARASLEQVITHPSKDKGVVKAMTSAYRRWILVSLLQGGKSPLLPSYTPSAAKAHYVSQVPYNALATAFEASDPAQLQTELKTHEATYESDGTLALVQQVLQAYQKWQVINLRLSYLRISISRIREETFSGETGQRLPSTEAMDALLREMIEAGMLKARFELDEHGNETYLAFEEDTNTLSETEFAQEIARRHKAISELTAQYKVVNERLSVNKEYAKYVYREQKRQNDEGNQPXXXXXXLRGARFATE

SEQ ID NO: 1651 - protein, 947 aa, Unknown
  Kingdom: Fungi, Phylum: Ascomycota
MYSSSTLNGRVQLPCPAARDLDPAMAAKLHPAVVEVAVDKIAVRRCCHLTNWRYLRPGPAVAQSRIIKSIPTGGDLLLLIPFMPRWMGSSACWAVCGDRMGAVLHCQQHPAQRPSLRHSPPIECGQGAAVYLPSGASRAGPPTGWYGVHEVDWWPHSQQRSAKAPDPTTETARSPSCCCLSASRAPALLLLLLLLLLRLSSSSPPRQPTRHLSPTSNPPSPLLRSTLWHGRILFPGALRHDKLPLCSTRLCFLSRVVPVTLARSHSSLPPLLPIASSGAASQTPSHRRLLENLRLLQLLLGRASLPHAAVQIATLPSPHAGPPTVFNGTPFAAPILESPRDEFAIPTVLRPPSGKSTPSASLSSEPLDDLDDTLLSRRRKRGQEDDPDKTPRIENTIVMANGTDDLQDEEDEAVRCICGSEDYPGRPPVEGPDADFFAGIELTEEVTGFFVQCDICKVWQHGACVGIFSAEASPDEYFCEQCRKDLHRIHTASNGLAVLQPCPHEAQKPPGQGFHAGSFDALLPDRISPLTLPLNRQKYSKYLPLHQASRTTSRATSIAKDGARSPKPGGSKRERLSSASQAAAKRRSTMNSRDAAYDDELLRRVIEASKEDAPPDTSDTASRPAKRGRSDSEELVSHTSQAIDTGLTSHRNGTIAKRQRTGSRSVSPPVEQPDTNGGDASDEDSSARNGAKKSRNNRSQREKSEKEDKEQQRQEAANKRKGRAERRRAEDSDLSEEMPLTAAKVVQSKSVEPPSVEETPTPAQPPGTPPTSNPTGTAGTTHKRAARSSHKRGKGRNQYTKDREADDESPARSMSRDIQKNADEPSHGKAPGDGKHGHKGKQAAAHKMSMLDMKRRVAAIMEFISRTQVDLAGEHGGSTTTTSGADTPQKDEAAGANGDATAAKAGGEGRNGATPDASDAKGFKELSCMEMMDVLTRDMVKWQNQYS

SEQ ID NO: 1652 - protein, 422 aa, Unknown
  Kingdom: Fungi, Phylum: Ascomycota
MQPEQFFTTVCGAPLAANTAVNKDIGIYHQNLTPYSVSHAFKKSSAPPHCLAVSDTHVFTAQENKAHVHVYSRAKGNQECFVSFPERIRCIALIGHVLVLGTVEGRLILWEVFTGRQVITPACHVQGISCLAVTPYHILSGSDDANVNVWSLARLLELDNQAELEPEQILSNHRGAITSLAISPSTNPETNLCVSASKDKTCIIWNYQSGQVLRTLLFPAAPLCVALDPASRAVTAMTESGDLFCIEFFGSAPILGSRATEQSSIVMQVKSPLGNAKDEAGAANCIAMSYDGTCVLTGHAKGKIMRWTLRESEHPTEIASLNASVTNLFFIPRAAEKITPAQQTVIKPHLSQRKYNLMAQIAGHATTESRFSKLSSGEGFSGDVLEEAIASFMNEREKKNGESVGAYDDETLRAIMGDLLAR

SEQ ID NO: 1653 - protein, 1227 aa, Unknown
  Kingdom: Fungi, Phylum: Ascomycota
MPSGGRRTMPPSNQRPATNAPASPRSTAKYTNKDGSKFITVPKAAGGQAVTNAADASAVSPLATPDSSNTPVDANLETESAPTVNRKKQKRRQKAAAKAAAEQAANGHPAPAAATANKTHHTDSVDADAAESDNEDDNDSRDHRPNSDLNGHSSHQVSSKSKKNKKKKKKGGANANEGSLHGEASSDSHTPQALMQRGPSFSRDKIWSTSNHEERERIKEFWLGLGEDERKSLVKVEKDAVLKKMKEQQKHTCSCTVCGRKRTAIEEELEGLYDAYYLELEQFANQGEGPPMLAPPPRDYPTRPLRGLPSPYPTHPPARGRIVEHVDLEAEDDEVEEIYSEDEVDDDDYSDDEPPDDYGDSHERDVADFLTFGNSLQVKGTQLLDAFLNRYGNMDLGGILTVADDLLKNDGKRFIEMMEQLAERRMAREEDAREHVSRGGYGHPNGSYSSPHNQPPPEDDDYEDDEDEEEDYDDSQDEEYEEEEVYSNPSAMPPSHHTECCCQDQMTEEQRMEEGRRMFQIFAARMFEQRVLSAYKEKVAKERQQKLLEELEEESRQVDEQKAKKAKNAQKKKDKAAQKKQALAEEKARKEAEKAAEEAARLEAEQRRINEQKQKAEEKRKAREAQKRAEEEARLKKEADRLRRLHEQREKQAEQERKAREAKEREKKLKEEQRLKDQEMRERKEREAQERKEKQERDKREKEARAAKAAKEAQEAREAKEKAREEKAAAQRPQPAPSQPAAPLPTQPTKRASVPTVPIPTVLPQHPPNPANYASPKVTVATPAIPKAPTPIRPRNASQQQDGSQSASQSASVSASSQNPSPHPMTPIQSSPGPIGGLRKSSGSTPAPSHIPQSTSPPEGHPAPFQMPPMGIQPPPGLAHHGPPPGFPGRLPQDPNFGPAFRPGPNMMIPPLGMNGPAGRGFPPMPMGPPPGFAPGPNDGFGMGGPPMPQHARQGSGSFDAPPHATAAQPIGRPAPIGRPGSVVHGRSRDDKDDETKHLGSSALVDDEDDAPELNPGSFRNSHQPPGPRGFGASPYLESAFPMTGHANPWGPPSAPANPFVSPAFGGGASAWGVTGPPAPPGFHVGSPVANLATFRPAAQPPRHIAVRLMLCQACRELSTSPASDPSGFVDISVVKSHIDTLSGGDSSITEQDLLDLCDTEGSLSNGGGTFDVRRDESSSKDLIRFIPDQLNGGAPQPPYRAVGAPPPAVGEIGSPLMSQASIRGGV

SEQ ID NO: 1654 - protein, 745 aa, Unknown
  Kingdom: Fungi, Phylum: Ascomycota
MADDGMLLNFEIGSAPIKSQIKFKGGRWRDRKRAEKIANAGPPKASHDAPDDELDRAQGPNKRRRVDDDGGPYSPYVPRTGGEDLRGGRAGNATGAQFGGQGKRQPQDPSKPPRQVVSKLFSFNPEQKTVFDDEPTEWKAPEATNAPLELANFGSLQLSSRLVDELSKMRLVRPTAIQNKVVPHMMSSSGDAFVQAETGSGKTFAYLLPILHRVLLLSSKAGGKQIHRDSGLFAIIVAPTRELAKQTHTVLEQLLRPFPWLVSTAITGGESKKAEKSRIRKGVNFLVATPGRLADHIDNTKALNLGTVRWLVLDEGDRLMDLGFEEDLKKTIDALKKVQVIKQTPDGTSLEALPERRVTVLCSATMKMNVQKLGEMTLADATFLAAEKGEDETIETANKDVHKAPAQLHQSYTIVPAKLRLVTLIAFLKATFARRGRTMKAIIFISCADSVDFHYELLGLKSDATPGETLPKDAELISKTVSKAAYITSPASPEVVLHRMHGSLSQPIRTATLKSFSACKQPSVLITTDVSSRGLDIPEVDLVIEYDPAFSFADHIHRVGRTARAGRSGDALLFLLPGTEEGYIELLKASGPPSHQSYETILQKAFMNKMEFPVETEAVASEHGSYHNKAETLQLHLEQRLLKDPKQLELARNGFKSHIRAYATHTREERVHFDITELHLGHTAKSFGLREAPGGIGSGLDRKAKKNGKDKGSKYAETDAKPAQNILNQKSRMLMSSAADEFNIG

SEQ ID NO: 1655 - protein, 683 aa, Unknown
  Kingdom: Fungi, Phylum: Ascomycota
MARSDIRSKTGCLTCRQRKKKCNEEKPICSGCRRNCLQCYWPTAESSRGSINKSTKEHTGVFWRVLHPSRDLRVEGTTEGSSLPVASSQAAHASDNDTQHQGITVAVSRSDAATDGQRDRSPAQHSLDFLPIFGGSGSTSSQEESRTCFPAMTTRAWEDNDRSGFNTDDANHPASLARLEAVDGHSPAHAASIRQELSTSPPGAELANIGEQGCDISPGSQYIVLSGDEAASGETMCTSDNSSRRNMDADNDDNIANLTACGSFSVSDTADQNPEASESISNTAGSESMSLSVPGRVSLFPQQDPDAFQLLSFYLSRTANSMGNGSTDSNPFLSTLIPLAFSDQLTLQLLLAQSAVHRQVGQAHASSDLVAQRYYTGSLRLFRSAIREYISGKSKDRLILTTGSLILSLTEVARGDINGNIFDHIIAAKSLLVELSADDGKVVPQDFMDFLIEYYTHMSVLSMISVNPQHCSNPLLDVTIERLARKLIEKRYVGQLCGCWLELLLTIPHIFDLGQRMRTPDRPSPDDMIMFGLLQAQITAFEPEARVSEATRLAALVFKQAVLLYLWSILGCFQQEQGDSMHSDLMSTAVTEGIALLEQIPATCRINTSLCWPLTIIGCCTTEESLRATLRTRLRSMFSCIGLGNMGETLLLLELVWTLPLEQRSPWFLSIIAAVSRFPHCSF

SEQ ID NO: 1656 - protein, 730 aa, Unknown
  Kingdom: Fungi, Phylum: Ascomycota
  misc_feature (63)..(67): Xaa can be any naturally occurring amino acid
MSGFERTPISADSVEYGAGRAEGGGRERSGRKKWSPGRKKRRPDEIRHGPCPSSRVSVIDSTXXXXXDQSRPSRVELPSSVLTAGMADPSAVAPQFRVRKLRKGTHSCQQCRRRKAKCVFEVERSKICVGCAARGLECRPQTVAPRHERYNSREAYAGTEGVAAEGLTDSLARLDEILSSIASSSTPEDALNRRSLASPSTDQTLEFSLSTWGQSSSELDVLDCSVAHNARKVTSPGCGATLFPAAAIFGSPLAEDGALSSKQRSISAQLYAYLPPECTSKLLIGNGPSMFLGPHGPGSHDYRIRPTDHPVLIAKRLMMLALCLQQLPSSFDMDTLVFHSNVDRGHLVRTWVDAVSSMVTSDDGVVANVQGVETLILQAIVQGDSGQLRKAWMTGRKAISMAMLLGLHTDSPSNSTPVSSCIPGEIVLPQTINSLWFRANCIDRYASLVLGLPPTSVDTSFASEARMRDDEPEDRLGKAYAVCAGRICERNQRIASGQDAGDLTRSIELELESVAHLVDNAWWHPPPLRMAGSGLSGELMVMNLQVRHYVLTVLLQLPYMLQEGQLQEDAGSREHSRLTCMHACRAVIHRFLRFRSVYKSVATGRQIDYAALLSSMTLLQGHIARQQLATSGSAGEASLRSDDVALVDSARQIMQEIAACNRGDTLSSEAAESLQDLLIYLQEPSGCAIAPGTDTVGAELWDDALFDTVGPQEQFLTGLDPALVFPVESF

SEQ ID NO: 1657 - protein, 485 aa, Unknown
  Kingdom: Fungi, Phylum: Ascomycota
MPSVVSQATGPGRLSATGPFAASPTETDPYVYQCGFGNRFATEALPGVLPNACNTPQRLKYDLVSEQLNGTPFVSPRASLLHAWFYRIQPSVVHGHIRNLPPNVDLQAVFSKYNPEILFSPQDRGWDPLPIPDAEKDTDFICGIKTIGGHGDPTTKDGLAIHIFAANCDMQNRAFCNHDGDMLILPQQGRLDIQTEYGHLMVRPGELVVLQAGMRFTVSLPDGLARGYIQEIYGSHYELPELGPVGSNGMALPRDFEYPVASFDIDQSQWQVVVKLAGQLFSYEQNHTPYDVVAWHGNYAPYKYAMEKFINTATVDRDQSDPSIYCVLTAKSKMPGVSLSDFLVFTPKWSVTRNTFRPPYYHRNLATEIMGVIYGTWGGSSTHLSPGGLTYEPSYMPHGESYERWKEATAADLQPARVGEHTMGFMMHVSGHCSLTKYALERTGCLQPVQEAKWDDFEPGLLKHLDQIKADLAGAGLPGLSTITK

SEQ ID NO: 1658 - protein, 1160 aa, Unknown
  Kingdom: Fungi, Phylum: Ascomycota
MEGFGIAANVIAVVDLSVKVAALCVDYGKDVKNAKNDIVRLHLEVAGLQNAANAVQELLRGPSGGRLITSKQLCNAVRHCQSQLQALFERLRPKTAPEALTPVSLRALKWPFQSKEVERIVQDMERYAQVMNQALQVDQTNLLFDLDRRAVLGRLEDEAAKGASFDSRAEEHNPTCLPNTRVEILQQISGWVLDPGAEAVFWLNGMAGTGKSTISRTIAQTFSGTGHLGASFFFKKGESDRGNMSKFVSTIAADLTRRVPATARHIKAVLEDDPGILRRTMREQFQRLIWGPVSMLSKDSVNRGPIVIVVDALDECENEDDIRVMIRLFSRARTLLTVRLKFFLTSRPELPIRTGFSGIKGRYQDLILHGIPMPAIEHDISTFFVHEMTRIREEYNSLVSAELHLASDWPGPSKIDALVKLATPLFIAASTICRFIAEARIGTPDKQLERILGSQIGRNGTPLGTIYQPILDNLVTGTFVDQREEIIQDFRSVVGTIVTLASPLSISALASMLHVPRRAVEGRLATLHSVLSIPETTDAPVRLFHLSFRDFLVDAAHRTGNAFWINEQESHQDMVTHCLRVLKCLKRDICAVKAPGTHRSAIDQCKVDASIPPEVQYASLYWVYHLQNGATPVRYCDQVMTFLEGHFLHWLESLSLIGRSREGVHLIGTLQLLFKDGGIKRLSEFLDDAMRFVQTYSFAIENTPLQLYSSLLVFSPERSKVRATFASDIPPWISTQPKVNDDWGNCIQTLEGHHSGVISVAFTHDSALVASGSDDSTIRLWRTATGECIRTLEGHDSMVKSVAFSHDSALVVSGSNDETIRVWRTATGECVQILKGHSDGVTSVAFSHDSALVLSGSSDKTIRVWRTATSECIQTLVGHDLSVTSVAILHDSALVLSGSYDNTVRIWRTTTSECAQALKGYDNGVSSVVFSHDSTLVVSGSRDKAIRFWRTATGECIQTLKGHSDNVTSVAFTHDSALVASGSDDKTLRVWRTATGECIQTLEGHLDSVVSVAFSHDSALVASGAEDETIRVWRTANGECLQTLDVGFHPYNISFRADDLYLLTDHGSVAILQVPIWSSAERSTDCASKGNSFLSISADGCWIAWKGSPLLWLPKDYRPFDSAVSGSFTALGSASGHVTIIGVSHELLPDGWHEEKWVPQ

SEQ ID NO: 1659 - protein, 92 aa, Unknown
  Kingdom: Fungi, Phylum: Ascomycota
MTGNNNNTAGEQAADAGKFVTSTLGNTIGGLGRTVGNVTGAATRGVGDTVTGATGSTGRPVGDALGNIGTGVQDGVNSVSKGVEDAGQWKKQ

SEQ ID NO: 1660 - protein, 305 aa, Unknown
  Kingdom: Fungi, Phylum: Ascomycota
MSDRGQLPSDLIVFGPDANCTLAICPVEWSVYQYRPNLAANIIFLVLFAIAMLVHIYLGIRWKSWFFMSFMIAGCTMEVIGYIGRIIMHGNPFSFPGFMIQIVFITTGPVWYTAAIYVTLSKTIYALAPEVSRVNPKFFYWIFIPADIVCLVLQAAGGALSTVSQGSSQTGIDIAMAGLILQVIILALFVVALSDYMIRYFRSGATGALNSRTRIYFGGLTTAIILILGRCFYRCYELSQGYQDSELVTDEALFIALEGVLILLAVYSLCIGHPGLVQGAKAKDMSRGASDEETMSERKPHSVVA

SEQ ID NO: 1661 - protein, 591 aa, Unknown
  Kingdom: Fungi, Phylum: Ascomycota
MHLLQVLSGLALLVSSIAMAEPSSEERSPGQEPQFHNSARHSGADPHVIFDAKSGLFYAYSTEGADEGYNFAIYSSPDLSTWHRHPGGVLKACRDKDGNPIEGGQACWARDWYWAPETYHNEKTGWYFFFFAGRLREDLTKDHFRYSEFEEPSKLGVAVSRSPTGPFNEIEPKPIEYYPFDPDYYDVNLIMDEKQMLPPQSLEEGHTAPRGTYIPHIDVNIFFDDDDRIYLYVSRNAYRNWNWDKKLGKYIEESNIIMVEMERAWWDDPTASTMPEIIASQRDIHAKDAPKLPCNITSYNGTGELGNPPRKDGWKTVISYGADPQEWENYHVHDYAKFNGEKKDRRWSEGSTLIKRTGRDGKAVYMLTYSANNFEASNYGVGFATAESPSGPFKKSANNPVLAQKPDGEFPIYSVGHGSIVASPPTRDHEHVGAQDVTLGTPKGAELFYVHHGRNDTERSRSMYTSRMEIHDDAVYFGSSEAVSMSLTPLDQPLPRNTYPLMLDIKYTKDKDESKYQVRVLSKIGAPFDLSEGSNRVVGLPGNIQAELVVEKPNEAGWYQASFGSAELKEIVYQRLGVHGEWFDVTSKSVH

SEQ ID NO: 1662 - protein, 200 aa, Unknown
  Kingdom: Fungi, Phylum: Ascomycota
MSSANQQNVIRRKLVIIGDGACGKTSLLSVFTLGYFPTHYIPTVFENYVTDCRVDGKSVQLALWDTAGQEDYERLRPLAYSKAHVILVGFSIDTPDSLDNVKHKWVEEATRLCAGVPIILVGLKKDLREDPIAIEEMRRKSQRFVSTHDGEAVAREIGAKRYLECSSLSGEGVDDVFEAATRAALLKFEKGEGGGCCVIL

SEQ ID NO: 1663 - protein, 234 aa, Unknown
  Kingdom: Fungi, Phylum: Ascomycota
MPRHPLQRLTAPSRSLSLILHAAGILSFTYNFLFLYSWETPISGSYGSHFQFLTILGLAASLIAFILGLAADITLNQTLFQLKNAINVITTPLEFVISVLYWGIHLINPELLFADEFRLPLLTDIGFHLAPAVFLTADLILFSPPWTIPAYAVMLLSTGLAFMYWYWVELCFSVNGWYPYPMFAVLNTTQRALLFTFAAGLSTMSSVALKWVYGKVNGFEAIRREAHKPLKKVQ

SEQ ID NO: 1664 - protein, 463 aa, Unknown
  Kingdom: Fungi, Phylum: Ascomycota
MFAFGAASLIMALFFAELKFTDVQIGLFMTLTLAGDVALSFVMSLMADGLGRRRVLLAGGLLMATSGLIFVVFENFWILLIAAVVGVISASGGDFGPFRAIEESTLSHITNPKTRSDVLSWYVTVSSLGSAAGTEMSGRIVDLLRNLEGWDILSAYHALFWVYVIMGLVNVLLAASLSSRCELNSSQSDDQTEPSGESAQGLLDPSQQDEDDEDGGDAQTSKTTQPTPPNKSRFSQISAATRSVMYKLWFLLTVDSLADGMVSYSLTNYYLDRKFHLPKSRLGDIMSICYILGAISTVFAGPLARHIGLVNTMVFTHVPSSLAVLLFPAPSGLVLTIVLLFVRTGLNNMDQAPRTAFIAAVVKPEERTAVMGITSTLRTMAATLGPTLTGALAHTDKFWVAFVIGGALRLAYDFGLWAMFINMRLYEHEDGGDEQLDAQRRESDEESLELQPVRQTRDRDGLE

SEQ ID NO: 1665 - protein, 409 aa, Unknown
  Kingdom: Fungi, Phylum: Ascomycota
MSTLAIPPPFPLPAFRREPHWDSIRSSAHSLPRLDTRNALPSIRELVPEHLLNSQPQERSSAGSKTLLTSPASAGPLQTSPGYTHAPQGQKRRRLSAEENRESERARQVPRLYHPSESSTFSRRESPQAAVAAPAPAPPAPRPDGYYSDVKARPSSSGKYPTSGEVERLDLRHPVSSLTPATRPFERDGHSPYRADGGAVDGYHSRAGQPSAPGRAPSTEQPAPSSYRGDYAYSSFQPSNRYASATSSATTYERTPFTAPPYSMQYGEYSRFGGEMGPAGLVGETKQRKRRGNLPKETTDKLRAWFVAHLQHPYPTEDEKQELMRQTGLQMNQISNWFINARRRQLPNMINDARAESEAMSGRSLSKSDLGQRYERGSRDHLNLSDGEGRHYEEDLRLRRAQAQSRESI

SEQ ID NO: 1666 - protein, 524 aa, Unknown
  Kingdom: Fungi, Phylum: Ascomycota
MATLSTSFGQVAQRQALAPIPKRVCPRCTIPSRLQTSRRISPSSVRGFSSGSGKRPRFSQRLGEALRNSKVQWYQIPVGLGIGFLGLVQFYKVSSREREKQKNTENGEFEDGTPTKRPRVKLEGPWQVRVMSTLPLKAMSRLWGRFNELTIPYYLRVPGFKLYSFIFGVNLDEVAEDDLHVYPNLAAFFYRQLKPGSRPLHPDPHMLLSPADGRVLQFGQIEGGDIEQVKGMTYSIDALLGKHTPSPSVSSISLDSEPQEAQKAPRELSKDETLVKQEEEFAKVNGISYTLPDIMSGPGNRVKAQDASTESNPRTVSEVRAELALGERPWYDILSGDKTTSLYYAVVYLAPGDYHRFHSPTNWVVERRRHFAGELYSVSPYLQRTLPGLFTLNERVVLLGRWRWGFFSYIPVGATNVGSIKINFDKELRTNSLTTDTAADRAAAEANRRGEPWLGFVEATYEKASPVLGGHALRRGDEMGGFQLGSTIVLVFEAPSEEKGGWKWMVEKGQKVAMGQAMGRVIEE

SEQ ID NO: 1667 - protein, 331 aa, Unknown
  Kingdom: Fungi, Phylum: Ascomycota
MPAQPRYSRLQLEQYYDRIRIPQPARVYDVSAWTPEAQLSHLRLLVKHHLVTIPFENLTLHYSWHRVISTDAQHVFDKIVNQPGRGGYCMENNSFFHFVLASLGFDVYMVGSRVFESEEVGYGGTTHCLNIITIGDVRYTADVAFGGNGPIHPHVLEEGLVQEHITPAQMRYCRGQLPGTTREAGKVWVYEHRQRPDAPWCPMYCFADAEVLPADIRTMNLAPATSRTSIFHKLVMCVRFTTGSQVDSAGALEQQKGRDATLPEIEGEIDGVVITDGSNLKWRRKGEKKLELNFASEEERLSAFETYYGIYMQEKDRLGIRGTTTEIAKGP

SEQ ID NO: 1668 - protein, 312 aa, Unknown
  Kingdom: Fungi, Phylum: Ascomycota
MPPRLAPSVRFSVLRRLYSTAADQTPLVRVTNIPAAGSGHVRVFEMNRPSARNALSRSLVAALRTEIDDLHRQYTPEGAETPHAVATSDGPTRAVVLASAVDASFCAGADLKERKTFTQKETADFLSHLRETFNLLAALPIPSICAISSIALGGGLELALTTDLRVFSSNAVVGLPETRLGIIPGGGGCHRLPPLIGPSRARDVILTGRRVAAPEAYFLGIADRLVEVEVPEGSPKEDVLPLARKAALDEAVRLAQEICEGAPIAIRASLEAARWAREDKENEMSRRVVVTEDRNEALRAFAEKRKPVFKGY

SEQ ID NO: 1669 - protein, 169 aa, Unknown
  Kingdom: Fungi, Phylum: Ascomycota
MSQSLRPYLQCVRSSLTAALTLTNFASQSAERHNVPEIEAQTSPEVLLQPLTIARNENERVLIESSINSVRVSIKIKQADEIEHILVHKFARFLTQRAEAFFILRRKPVPGYDISFLITNFHTSEMLKHKLVDFIIEFMEEVDKEISEMKLFLNARARFVAESFLTPFD

SEQ ID NO: 1670 - protein, 884 aa, Unknown
  Kingdom: Fungi, Phylum: Ascomycota
MASTQRLPSRERRPSTGAPLVDIQGAVGPAGISRPKHKRTVTGFGPGEIKNVEASIPEPQREAWKRSQVKAFETAEDFEKEVVRHVETSLARSMFNCDEYAAYAATSLAFRDKLVLDWNRTQQRQTFRDPKRVYYLSLEFLMGRTLDNAMLNVGLKNAAKTGLNELGFRIEDVITQEHDAALGNGGLGRLAACFLDSLASLDFPAWGYGLRYRYGIFKQEIIDGYQVEVPDYWLDFNPWEFPRHDVTVDIQFFGNVRKEINSEGKTISHWEGGEVVRAVAYDVPIPGYDTPTTNNLRLWSSKASHGEFDFQKFNSGDYESSVADQQRAETISAVLYPNDNLERGKELRLKQQYFWVAASLYDIVRRFKKSKRPWKEFPDQVAIQLNDTHPTLAVVELQRILIDIEGLEWSEAWDIVTSTFGYTNHTVLPEALEKWPVGLVQHLLPRHLQIIYDINLFFLQGVEKAFPNDRDLLRRVSIIEESQPKMVRMAFLAIVGSHKVNGVAELHSDLIKTTIFKDFVEIYGPDKFTNVTNGITPRRWLHQANPRLSELIASKCGGHGFLKDLTNLNQLEKYIDDKEFRKEWAEIKYANKVRLAQHIKKSTGVTVNPSALFDVQVKRIHEYKRQQLNIFGVIHRYLTLKAMSPEERKKQQPRVSIFGGKAAPGYWMAKQIIHLINAVGSVVNSDEDIGDLLKVIFLEDYNVSKAEIITPASDISEHISTAGTEASGTSNMKFVLNGGLIIGTCDGANIEITREIGENNIFLFGNLAEDVEDLRHSHTYGSHSIDPDLAKVFEEIQKGTFGSSNDFQALINAVKDHGDYYLVSDDFHSYIETHAMVDEAYRNQDEWLEKCITAVARMGFFSSDRCINEYAEGIWNIEPQSTKD

SEQ ID NO: 1671 - protein, 513 aa, Unknown
  Kingdom: Fungi, Phylum: Ascomycota
MASLPTPAGHFLKNVALIIISLLLLPLDTTIFVTLDILHRVKTQIYGNNGVIKRIPADKRKTILITGVNMTKGIVLARLFHRAGHKVVAADTNRLAPGRLSRAVSRFHVLPRSNHEMGAEDPYIRRLVSVVQDEEVDLWVSASDVNGAMADALAKELIERHTDAKAVQFGEQAISTLHEKDVFMQHTKDLGLTIPDTEVVHDRESVLSFLQQRGGLELKPGGTQYLVKPIGVDDLGRNDMPLLPLSSEADTRSRIDAMPFTQSEKPAYVMQQFVSGAEYCTHALIVRGEVRSFVACPSSDMLMHYTALPATTALHRAMLEFTQRQASSFGQDLTGHMSFDFLVKHTPPPPRGVKGADEVEQQQQEDKPTLYPIECNPRVHTAIVLLKDTIDTVDEYLSVLSPTRRTRRLSSINFIPTHPQQYYWIGHDLANLVLYHLYLTVVVGTMTPSEYCDSLRVFADHVVNWKDGLFEMWDPWPCWWLYHVYWPLQFVGYLLKGRWHKINVSTGKAFKAA

SEQ ID NO: 1672 - protein, 509 aa, Unknown
  Kingdom: Fungi, Phylum: Ascomycota
MTFKSSIHTFYDGKPQPSTSSSSNTFSSIDPATAKPLATIHTTTPEQLDKAIASAHAAFKEWSQTPAPRRSAILLRAAAILRERNEALALTETLDTGKAWSETSTVDVITGADVLEYYAHLIAGSQPGQHTRLRPDAFVLTTHEPLGVCAGIGAWNYPIQIALWKSAPCLAAGNCMVYKPSEVTPLHANTLAEIYIEAGVPAGVFNVVYGDGPSVGVPLVAHPDIAKVSFTGQVSTGSKVASQAAKDMKGITMELGGKSPLIILPDANVDEAADVAMVANFFSTGQVCTNGTRVFVPDTLLSKIETALVQRCRDGIRMGMPRDEKTNFGPVVSKPHQEKVLGYIKHGRNVDKAKVLYDGASDAQKKLPTSDGYWVPPVIFTNCTDNMKVAREEIFGPVMCILPYKTQGLSQDQWLPDVVRRANDTPMGLAAGVVSTDVGLAQDVIRQLHAGITWINTWGESPAEMPVGGWKMSGIGLENGEEGIRAYMRTKSTLVQLGRDACKGVFAKL

SEQ ID NO: 1673 - protein, 1207 aa, Unknown
  Kingdom: Fungi, Phylum: Ascomycota
  misc_feature (372)..(372): Xaa can be any naturally occurring amino acid
MRPVRVAALGAGILPIATANLLRRDLTPPKTPQNGWEYIGCFIDSVEERALDLARHYDTEALTGQSCVEWCADNGFTYAGTEYKAECFCGNTRPASAADEEDCNMACTGDEDQPCGGSNRLNVYTSDVMAPAVADWAYSGCYEDSVAKRVLTGDYHADPAEMTPEVCIDYCKNGGFKYAGVEYGAECFCGNTLPPKKEEDGDCKMPCPGDTDRTCGAGNRLQLYASNADAPPDPDAPPEIEGWLYAGCVKEGNGGRTLTHQVWLPGGASTMTNERCVAACDAQGYHYAGTEYAGECFCGNEYENEGGELTDEGCNMKCLGDRTQFCGGPNRLSAWSINELPPPSTDTSTADTSTATSTTEVETSTTEVETEXTSTTAVETETSTTETETSTTEVETETSTAETETSTTEVETSTTEVETETSTTEVETETSTAETDTATLTESETEVSTTASETSTSAPSATGGLPEGWAYKACYIDPPGRAMNGVPGSPSNDMTPEKCIGICIGLGYTVAGVEYAEECFCGNALNNGASKTSESDCNMACKGDNTQMCGAGNRLSIYSKGDFPVWPVPKVQKDDLPGDWEYKGCVFDNANPYILEWLWEDAPNYASSKMTIPICLERCQKFGYSAAGVEYGRQCVCGDLGKVEERGDVWKDDGFCSMPCPGDRDHTCGAGNHINYYEWAGEPLNTFHYASGPEAGRYEHFSTSPIVPLISSVGINDKVIFVEKHGTSLDNTEGSFEFDYSTNTYRELALKTDVFCSASFTLPDKAGRMINIGGWSAESVYGIRFFTPDSPQGENTGTNVWEEDYAQLRLFDPRWYPTAIVLSNGSLLAMGGESGSDAPMVPSAEVLPHPPGVTESTYLDYLARAEAIGRTNSYPHMAILPSGGIFFAQFNESRILSQADFHSMQKLPDMPGSPVNPLTGRNYPLQGTMMLMPQKAPYTDLLEIVLCGGTTHEPGNDALDNCVSIQPDKPGAEWAIERMPSKRVMPTMVGLPDGRYVICNGAHVGRGGFGLADDPNLNAVMYDPTKPLGSRMTVLANTTIARLYHSEGVLLSDGKVLISGSDPQDNGKHPQEKRLEYFYPDYLLSGATPPTFTIEDRDWEYDEAYEFEITSTLAEGFANMRVSLIASIGSTHGITMGQRTLFPEVSCSGTTCTVVAPPNAFVSPPSWYQMFVLDGPTPSHAIWVRIGGDPAGLGNWPQLPGFTAPGV

SEQ ID NO: 1674 - protein, 571 aa, Unknown
  Kingdom: Fungi, Phylum: Ascomycota
MASTGTGGSLPPNFLLTPQQQSLLFAALNSNKQSNTINNPPTASPAVFNNAAAPGNGQANSFNDSPFLDNLDTLDYNDFGDSSFDFSFANGDQSIVGDTSVATIKSESPENGDAHEKRSHPDDEEGTPVESDAKRRESTDKVPKKPGRKPLTSEPSSKRKAQNRAAQRAFRERKEQHLKDLETKVEELQKASEDANNENSVLRAKVEQMTSELNQYKKKIALMSQSSPQARDKFSSFGSNPLSGFNDLDFQFDFPTFGVPTPPTDKSQRSVSQPISPHQSNLGSSAASKSGSVKSPSQDAAFNAQFNEELAKFNNGFTPSMSSSVTNASRASLDSASFSIGGATSSPSASSQSNAGPSSSCGTSPEPATQSPMGFKPVETLTTIGEEPPAMSTSAQPFTQFSNMTFDTTNFDWLAQQNGGQFDPQLFGDYREPQNNVLSNPSFDDFFNDPAENDFFTPFNMPPVPALGSKKNICDEIDAQKDTVHEEPVKIDKASMSCNQIWEKLQSCPNAQNGEFDLDALCSDLTKKAKCSGNGPVVGEADFNTILKKYMGNKDASCVASKLGIEVEKAT

SEQ ID NO: 1675 - protein, 388 aa, Unknown
  Kingdom: Fungi, Phylum: Ascomycota
MDPTLLIGDIVERDDKEIKKPVDFSDEPFTATPTGFPKHRRRWRPTKKSEAGATSSPGNEPEKPASFDEVEKQRIDAENRQRINDMSPEEIAQAQEDIMKGLNPALIQRLLRRANIDQEPSDDAPKRGNEKTPSGSAPSEKHKEKEKVTENKQAAATRTPNPRSNPIDDLPPPRIPPDLFPITDQPERTHFPVPPALPDLDPSDPNFLETLHKKYFPDLPADPSKMAWMAPVPTPDSVADKESPYYPGDDLAVSALRFDFLGRFLSPRVSRKIASTKGLHHHGLAPEAAGYTVAELAHLARSAVPAQRCMAFQTLGRILFRLGNGEWGKTKDDPIAMGVWSAVKEGRVLDSLTEAAMEEGGHRGSRAYATEALWLFEKGGWREQHQGR

SEQ ID NO: 1676 - protein, 477 aa, Unknown
  Kingdom: Fungi, Phylum: Ascomycota
MAVVGSGPAGFYTAYRVMSKIPGAKVDMYEALPVPFGLVRHGVAPDHPEVKNCQDKFDEVASSPNFTFIGNVSVGQPTRQAERVSVELPALLQNYDSVLFAYGASEDRKLGIPGESTLRGIYSARQFVGWYNGHPDCTELSPDLTRGEEAVIIGQGNVALDVARILLEDVDVLRKTDITDHALAEIARSKIKRVHVVGRRGPMQAAFTIKEVRELMKLKDVAFHGVDRSLIPSDVKSLPRASRRLMEVLLKGTPGTPSGAAKSWALDSCLAPAHFLAQADQTDSVSSTKFDVTRLTDPFEPRSGVETTGESTVLPSSVVFRSVGYRSTPLSGFAEAGIQFDERRGVVDNDGLGRVTRLVSADSGEHVATQQIPGIYCAGWLKNGPTGVIASTMQDAFTTGEAIAYDWASGAEFLQPRNGGGCRGWESVREGLSDFGQSAVTWNQWRKIDDAERKRGQTQGKEREKFTSISEMLAVLG

SEQ ID NO: 1677 - protein, 1463 aa, Unknown
  Kingdom: Fungi, Phylum: Ascomycota
MLSSSCLARNAQQAARRSGVQAMQRRAYAAAASSASFETGDVSGLKVASRDLGAPTTKLAVVAKAGTRFQPLPGLSAGLGEFAFKSTKNRSALRIQREAELLGGQLATRVYREALVLEASFLRDDLPYFAELLAEVVSSTKYTTHEFHEEVETALSLKQAAAQYDAAAIALDNAHAVAFHNGLGSPVFPASTTPYKKYLSDDHVAAFADAAYTRPNIAVIGDGANASALSSWVERFFKDVPVSANSGQSIKSEATKYFGGEQRQNASVGNAITIAFPGSDYNNAKPEIAVLAALLGGKSTIKWSPGFSLIGKATAGLPDLQVSTSNLSYSDAGLLTIQISGSAASVRKAAFEAAKALKSVADGTVPKEELEKAIATAKFDALNASELRESSILLAGAGLVNTGKPFELNALSKAIEGVTAQKLKTAAKALVDGKATVSSVGDLFVLPYAEEIGLQVPQTTIGQSSFLILRTVPSTTALLPIPQISSGLSSALLATATTTAFTSNPHPPDAASTISDRVQPRAKTKPHPSTSHHGPPPKSRLITSSDSLLSSPPGALSAVLLAFVLPLSVSSLDASLCLFPADELPELDLCASGCVLCLSLQHLSPSFFLGDRSKFRTDTAISNSRFGNERVLQPWVPDASDALDGSLEKTSASGGGGWDQFAENERLFGLKTDYDENMYTTVINKSHPQYRERKAIAEKKAQEIERSAPATAHVAEERVMDYVPGQQRGDDKDNEEDKYSGVRRQDFPPLSDGRGNKYTPPAKRAPAGQSTVKGAPVDPAIISSQIKAPPKKQPAPVPAPVEEKPKARASDSGPSTGSQNSLEVTTNDSQPAVPESKSTTATPTPAASKLTSVSPDAKPTDNGTATAKSSTTPSRNLSPSKRDPSTPAAPSATSTVEVDVLKEFKHFASQQRMNAEKARSTKARHDKETKLADLKKFADQFKLTTPVPTDLVSIIAKDPAKQKEIQAKAIKNAEEMAKKAENNKDNAIASKDAQPKSTETKTPANDARTARAPTAPQNAANGPNRHQGSRQQYPQQGMFHGQQPYRNNRGGPQHNPMQHQQPGTLAQRLRHVEQQRYSQAPVTQPHASAPDVRVPPTGPANNLDPNYNRRASAVPGHLSAAKALNPNTQEFQPRASAAPFNPNGLSAGSSPRSAVNNASELSSASPQSPLIRRKTKAIDPKKCFILAHVKTFKPPSGRNWEDNGGLRPSYDTLPTWRQLQDDEKAESTMHLTYKEHFERQPFSGPSLSTPNPQHAMPQIPHQHQLPFHLQQGAHNMGMRQSPHMGHMQMHGNQHGPGQHPPFGNDDHRMLPSSSSQSFASPRMGQAPMAYNGMGSPAHVPYNQPVFIPPGAPQMGYRSFSNSQQYMPPQQAHQPMMMQPQFMHAPQAMVGPQMMYPGHPQFMPPAGPHQPMPGANGYPSPGRPQAPMMVHQGSQQGQSMYGMSPNVQYNQPAYGPGQGGGPSQ

SEQ ID NO: 1678 - protein, 348 aa, Unknown
  Kingdom: Fungi, Phylum: Ascomycota
MGSLREIFNVRGNGVRKGGQRKHAVPDSARNIITVILGEFCGTFMFLLLSFIGAQTAITTNDPGFPNTPLKAYSLMYISSCFGGALAVNVWIFYRVTGGMFNPAVTLGLLLVGAVKPLRALAIIPTQLVAGIAAAAVTHGLIPGPLLVRNALSDDMSIVRGLFLEMFLTAQLVLTVYFLAVEKHRATFLAPIGIGLSVFMAHMCATNYTGTSINPARSFGPAVIAGFVGYHWIYWLGPFMGALLSWVVYSLFKWLEYWTANPGQDADDIERANKAMAESPRSGHFFNGNLKDAEGGFLQSKPPQDRLRSDSVMDGQNTSPTTLAAVPAATGPAANGVAAPNGIPACTA

SEQ ID NO: 1679 - protein, 854 aa, Unknown
  Kingdom: Fungi, Phylum: Ascomycota
MLSASSIRNACPRCQFTMGLLRQLPRPIQHLNNSSTNAARRQLAQRPFRTTGRAFSSSRSWQAEEASNDIQAIEVFVRETKQRFRDTLPKGYLNEEELRIYLRLYGPPLRETEPDDVGIPSHAKVGEELPRSATEGTILRELEGGDFEEITYELPQERQTEQTDERKLTEHELLEEEEALIEEDEELIEITPEIAEALMAQEAEFAEAAAGKDPDYIDSVARNQREHDALKKLQDDFESAQEKQQEEEKVAQAEANEAEEAEALETYWPPEREPIPHGLREEGTGESRRFHPLTLQGRFHDSPVEISLPREELILPVREMLERTHIRHVQTAAEESFGGRGLPLSPATQGGQRNGRMDGVGLPPGQRHMTEVEGDAFLAGYLPPVYASSMAVLREVRKRLGSDWLQTMLKRSDGTGPRILDAGAGGGALVAWDQIVRAEWDILKEKGEVTGSEPPGKKTVLAASDRLRDRLKGILHNTTFLPRLPDYQHSGDMGGAHLDAGSKPQPRKTFDVVIASHLLLAEKLDHHRQAVLNNLWNLTNKDGGVVIFVEKAHPRGFEAVAHVRDTLLRRYLNPHPGQPTEAPEDFNPAFHRVLEDGHIIAPCTTHATCPMYKLPGKSSGRRDFCHFSQRFVAPTFYSRMLSGSSQGEVEFSYVALQRGVSKQHLLSPREATEQAAKGYEHRSDRPDMQQLPRMILPPLKRTGHITLDLCTPEGKTERWTVPKSFSKLAYHDARKARWGDLWALGAKTRVERKVRTGRGADDGGLRAGREGANKGPRRVTITMDGDKVSATERNAGRQRRGKNGKKARSEELLRELEEDDAEVEREVDEEMEAVWAEQEAEEEAARRRRRGGDY

SEQ ID NO: 1680 - protein, 256 aa, Unknown
  Kingdom: Fungi, Phylum: Ascomycota
MYTCILSLVGLLVAETLAHGAVTSYRIAGTTYPGYQGFSPSNSPNVIQWQWPNYDPVTSCTASQLRCNGGRSATLSAPAAPGDEVTAIWQQWTHSQGPILVWMYRCPGAFSSCTGDGAGWFKIAEAGFSGDGKTVFLDTESPSGWAIAKLNGGGQFTTTIPQGLAAGNYLIRHELIALHQANAPQFYPECAQIVVSGAGSAEPSASQKASIPGYCSNSDSNIRVPINDHSIPQTYKIPGPPVFRGTGSKKAREFSA

SEQ ID NO: 1681 - protein, 458 aa, Unknown
  Kingdom: Fungi, Phylum: Ascomycota
MGQGQSGMGGEGREDKDKKKDKPKYEPPPRPTTRVGRKKRKQGGTSAAAKLPAIYPTSRCKLRLLRMQRVHDHLLLEEEYVENQERLRKAKAAKEGNAAAATDAETGDRMADERGRVDDMRGSPMGVGTLEELIDDDHAIVSSTTGPEYYVSIMSFVDKDLLEPGASVLLHHKSVSIVGVLTDDADPIVSVMKLDKAPTESYADIGGLEQQIQEVRESVELPLLHPELYEEMGIKPPKGVILYGAPGTGKTLLAKAVANQTSATFLRIVGSELIQKYLGDGPRLVRQLFQVAGENAPSIVFIDEIDAIGTKRYDSTSGGEREVQRTMLELLNQLDGFDDRGDVKVIMATNKIETLDPALIRPGRIDRKILFENPDQNTKRKIFTLHTSKMNLNDDVDLEEFISQKDDLSGADIKAICSEAGMMALRERRMRVQMADFRAARERVLRTKQEGEPEGLYL

SEQ ID NO: 1682 - protein, 284 aa, Unknown
  Kingdom: Fungi, Phylum: Ascomycota
MAVQLLKGTAFITGAASDHDIPRAMPSNSKTHPGIGQAAAIAFARHGITKLALADVNFKALQASNAEIRKSFPHVEILDLEMDVRKTADVKRGIAETVERFGRLDVALNNAGLGGAGRQTHETEEEEWDMVIDIDLNGVRRCQKEEIAVMLKQENLGPREGRGRIINVASMYGLVAPCGTMHHTAYAAAKHGVMGLTKGDANSYGGEHAIRINAICPGYVETPLLTGAMALEGDSPLALDIRRTPLRRMCKMDEIADAIVFLASPMSSFMQGAGLVADGGFTSN

SEQ ID NO: 1683 - protein, 557 aa, Unknown
  Kingdom: Fungi, Phylum: Ascomycota
MAIPAKVNLTDPFEVDTLLEIRTSGMKKMTGLNIESGIDKKLCPGPMKVGKLGLEGDEHDPTFHGGPDKAILGSPDQIKDCSSHYADWQQSYPERTDRFVPGGFGENFVTARMNERNVCIGDVISVGPELVLQVSLPRQPCFKLNHRFSLKNFAPVTYQTSRTGWYYRVVREGTVRVGDDIRLVERKWPQWTVERVQEYLHRTTDNLEMNQQLADVDALGEESRGQFRKRVAKALRKARAEAEDTWKDFRITGRKMETPRIVSLVLEAVNPDPETELPLAGAHARIKLPNGLIRSYSIAAGGDSLFKVTDKFELGVALDENSRGGSRYLHETSKVGDILQVGRITTDIGFAKSASNHCFIAGGIGITAFLPLIRGMDAIHLNYKLHYAVRSADDIPFLDRLEPHKENIVFYDKSKGERMDVKKIVKDLMWNSHLYVCGPNRMMEATKAAVEESGIPPDEVHYEAFAADISGDPFEAELSGKKSQVLKVGEDESLLEVLRRELPDFPSSCEVGNCGTCKITVKSGRVDHRGSALLPEEKETSMLACVSRGIGRIAIEV

SEQ ID NO: 1684 - protein, 856 aa, Unknown
  Kingdom: Fungi, Phylum: Ascomycota
MRRQNHSCDYCRKSKKACDGFALNRFRLITPGGSSPSSSSSPASRPASDLLPCSYCVRTKKQCSFNANWGRSPAASVTERNEAQHNSTKRLKSDEEAQEGSMLDYDLELTLDDLSQAIRGHDSVCSSFPSASTPGVQSQGQVQQSDSGVDGLSYGHQYPHQTRIYAGQHHGIGLESWTDLVDSGLPWDTVDMASLNDNTASQASHVDFSSGYWCGDGISDGMSLPDTDPGSLTNLGKRKGRRASQLDDERSLSVYNTDFRISSAANNHLIIGNLLGIYHDVLENNLACWLAEENCPYKMHRPERAYHLVNHKSPSKGIMSTSPQVGRGSMEWGRDWSNRIYRRVTQLDRMAVRSRSIKMSRAQSHDASRALSLVIMAFATQWSQGRRRHDMQTRRPSQGNRDEEMEKDFERHLQKSVWRQAKRALDDVADVESFRVAYAEMVFGLMERPWDDEDEIAEVLLGEPASDLGPEAVQSKVVDILAQDGPPVMLERAARKMQVLKFRFESENADSLLSNASPRPSSGNMTDEDRETIGLLYWLAVMFDTVSAPMNERPVALGDEECQHDAARERQSQGELGEQPTDSRSSLRWNIQLFTRGGQDISAGDLSWPCSHDVAASAIARSAPIKILIFRHLFYLQNILRRKEFGQPIEDALWEATLVYRYWNTVYARFYRDLVQNYETVPTRIRAWFVCIYIPWHLACLMLADIVELVGQNKVGLSEHTRTRERADMVSRIRTQSAHELSELARVTAPGDGTEQLPDYHHAVNEGPLLTEPWTVLLVRAFAKSALFYLCRAQKAVKVPEDPPAHHGTASDQNIVRARYCIKALASLGKKSTMARQIANAFNRALGKQEMDRGYT

SEQ ID NO: 1685 - protein, 309 aa, Unknown
  Kingdom: Fungi, Phylum: Ascomycota
MQNDNPSESRINQLPSACRIGRPLNHNLSVTLLVSSATASSRRKSPAGKGRALVTMADPFEVRMRFTSQLQGLNASVNSAQKAAQYALKYRDMDEDLHSCILEQVERTNMNTRANIMFFIEHFLDQAQRDGHSDYVRMMQRDIIRVVDAVAPDDGSGAANVKVVRKVLHNLQSKGLLEVQVVTQIEDVIKERETTNDDSDVGSPNGGLPDAPPSQTIPRSDRKGAPPRLEKRQIEQRIEEDRERHKRQRESIWAVPAGQDQESTKLWEETSEYGEDDDRLVAEEARDFEAEMEMQRCHHRQQITNGQRP

SEQ ID NO: 1686 - protein, 540 aa, Unknown
  Kingdom: Fungi, Phylum: Ascomycota
  misc_feature (499)..(505): Xaa can be any naturally occurring amino acid
MPQTIPPPQTPQSQDVSLPPNSAAGAYVAATPVPAPAPPKTTPTKSTLKALPTVRDHTTDQLNPTGDEYIPRETDEFGEKKVMANGQLLGGRSYRCRTFLVPNRGDKLFMLATECARVLGYRDSYLLFNKNRSLYKIIASQPEKDDLVQQEILPFSYRSRQIAIVTARSMFRQFGSRVIENGRRVRDDYWETKARKQGFTEADLAGEKRPGAAKAREAAAEQAQNNVMMAGPHTEIVYNNNPGPYPGPPQPHLVQPGMLGATPGNAARMPGLTTGPELTDARPRDYGSIVKGGPRQEITGPPYQDQTRPAPLGEIHSQANHAADFNRSVNQQREMRSDYIQGMWRRPHEQPANTLPQPVGSTDSTVPTTRTSGSPHTTATGMSQPPVVSAQSPQMMMTNPPYSQSIHAQNTLGQAPLRGSSGSLGQGGAPSYNYQSNPAMWSQNPQNPQQNYGSYTAQNQPPHHPQSPASHVRQPGSSQMQPGMQFPGMGGMQYGAGQXXXXXXXREAPLSHSPGLDITRLLNSGGLHHSNRSRGCRIKL

SEQ ID NO: 1687 - protein, 472 aa, Unknown
  Kingdom: Fungi, Phylum: Ascomycota
MSYQDSSSAGGIAVPTIPCLFTSPPPIKDNLPTESSILQDATVEECLPFLTNSSNFHAHVNTHGIPHLDRSRHVAFLHKQLGKLPPQFKAADPSRPWFFYWCLAALAVLGEDVEDYRSRLVGTVRPMQNQGGGFAGGFGQMSHLATTYATVLALVLVGGEDAYETVDRRAMWRWLSSLKQPDGGFQMAVGGEEDVRGAYCAAVIISLLNLPLDLAPDSPARASGHTRLFDGLAEWVRRCQTYEGGISAKPGVEAHGAYAFCALGCLSILDSPTRSFAKYLDIPRLMSWLSSRQDAPAAGFSGRTNKLVDGCYSHWVGGCWPLIEASLSAASGGSSPPPPEKQQPTPTAGRPSAATSTAALFSRDGLIRYILCCCQDQTKRGGLRDKPSKFSDAYHTCYVLSGLSSAQHKWDLVTTRADEGILDTDEWAASPFSEGKQIFDEEDRVKPVHPVYVIPKDKAEAARQYFMMKTGF

SEQ ID NO: 1688 - protein, 505 aa, Unknown
  Kingdom: Fungi, Phylum: Ascomycota
MQHHHAPYGYPSPPASPAYDIPQCTPQAYAPRQYQPRCVPLAPEERLGKLLQGKLHLTEILGTGAYGVVYSAYDINTGIRYAVKCLSKFNPDGTPLERRQALYQQREIRLHYLASAHENVVSMLKIVDDADCIYVILEYCPEGDLFLNITERGRYVGKDELSKKIFLQILDAVEYCHNLGIYHRDLKPENILVTDHGDTVKLADFGLATSDDRSEDYGCGSTFYMSPECLQPSSRKPFYRCAPNDVWGLGVILVNLTCGRNPWKQASFQDSTYRAFARDPSFLKTILPLTDELNDILGRIFSPSPEHRITLPELRNRILNCSQFTVPAMSVSPPSPPVMPDHTNAYVAPEEAVVDDFDYESPLSPASTSSDEGSLTSSAPTIDDFDDEVFIDGPSSQPDMSQDMNVVAYEPDLSNGTTAFHAQEYIPQQHYTGPVPTAPVVVHSQPPVPPQPHMQAQPHVTAQASCQPKSYFPFWDVVKYVQQAPVMPNHVSFHQPVSFFPVQGY

SEQ ID NO: 1689 - protein, 565 aa, Unknown
  Kingdom: Fungi, Phylum: Ascomycota
MASMFEQPRNGTLFLGGQKISGSDIRDQNVLATQAIANVVKSSFGPSGLDKMMVDDIGDVTVTNDGATILSLLDVEDAAGKILVDLAQQQDKEVGDGTTSVVLIAAELLRRGNELMKNRIHPTTIITGYRLALREAVKFLNDNVSVKVENLGRESLINIAKTSMSSKIIGADSEFFSNMVVDAMQAVKTTNPRNEVKYPVKAVNILKAHGKSTLESLLVKGYALNCTVASQAMPTHIADAKIAILDMNLQKERMKLGVQITVDDPQQLEQIRARESGMVLERVELILKAGANVILTTKGIDDLVLKMLVERGCMGVRRCKKEDLRRIAKATGGTLLSTLSDLNGDERFEASYLGTAEEVVQERISDDELILVKGTKVHSSASIILRGPNDFSLDEMERSVHDSLCAVKRTLESGSIVPGGGAVETALHIYLEEFAGTVGSREQLAIGEFAQSLLIIPKTLAVNAAKDATELVAQLRSRHALSQRTQEGEGNEDEKTIARKKNYKNYGLDLARGKVVDEIKLGVLEPSISKIRQLKSAVEACISIMRIDTLIKLDPEAPADDGHGH

SEQ ID NO: 1690 - protein, 1471 aa, Unknown
  Kingdom: Fungi, Phylum: Ascomycota
MPRVDHRAKLAELKALRQSGKKAFENYQVDDADNLYDEVDEDGYKKIVRERLNQDDFVVDDNGEGYADDGREDWDRVQRYDSESEDEALPARGRQSKAAKKARQDEQAARDANDRDISEYFTKGAGKTQPKTKVVKTKADDDFLQDLLGEVDTNIPAPMPRQSKYERSGERRKARNLSPAPEPASKKKKTLDTRLPALSAPGNTLEDDDGYMPPMDDDLPSAADVPMSDPAPSSPAAKAAQRKIQIKQEPKEDEEEEDMMEVAHAGAVNTTSVNMAGARPVKKLLKTEPYPSPATSSPLKPTQNDVDSSSWNALTDKLNVMSSPASETRSVGKIDHNDAIETDGSLNFFWTDYTEVNGSLCLFGKVLNKKTGNYVSCFVKVDNILRKLYFLPRQHRVQHGEETDEEVEMMDVYSEVDEIMTKMNVGMHKIKQCTRKYAFELQGIPKEARYMKLLYPYTKPQVDASVTGETFSHVFGTNTSLFEQFVLWKNIMGPCWLKIEDADFGSIKNASHCKLEVLAEHPNMVSILTESDNLDAPPLTLMSLALRTAFNAKENKQEILAISARIYENVLLSDTTPADKLPCRTFTVIRPHGQTFPLGFDQLVQKRRKGLIATKKTEAEILSFFLAQVDVADPDVILGHQLEGVDYSILLNRLHEKKTPQWSRLGRFRRTQWPASLGKMGGNVFAERQIMAGRLLCDLANDAGKSVMFKCQTWSLTEMCSLYLTGDNRRRDVDNEAALNSWAKEKQGLMDYITHMEADTHFIAALGLGVQMLPLTKVLTNLAGNSWARTLTGTRAERNEYILLHEFHRNKYICPDKQTFRGRQKAEEEREGEGADSKKKDKYKGGLVFEPEKGLYDKFVLVMDFNSLYPSIIQEFNICFTTVDRTPTMEDDDAVPEVPTDQEQGILPKLIATLVSRRRQVKKLMKDKSATPEQLATWDIKQLALKLTANSMYGCLGYTKSRFYARPLAVLTTFKGREILRSTKQLAEEKSLQVIYGDTDSVMINANVDSVAEAFRVGQEFKKAVNEQYRLLEIDIDNVFRRILLQAKKKYAAINLVEKDGKFIEKMEVKGLDMRRREYCALSKEISQHLLDEILSGDETETSVARIHEYLRDIAAKMREQAIPVPKYTIYTQLGKGPKEYPNADSMPQVQVALRDIARGKTVRKGDVVAYIITGDKSSSEPAPKRAYAPQDFKTDPSLTVDVEWYIGKQIFPPVERLCANIVGTSSSQLAEQLGLDVRRYTNTSAHSGSGIGEDLEIHPLESQIPDEVRFAECARLLLRCRKCKASSTFEGLLQDGATTRVTAAGVICPACEAIIPTLSVVAQVEIAIRAQTSRYYEGWLMCDDAQCGIRTRQMSVYGTRCLGRSGLARDCLGRMKYEYSEKAIYNQLVYFASLFDVDRARATASPAGGQQTQLSGQDRDRILALAEHNRVRFGTVKGVVDKYLDKCGRQWVAMDTLFAKLGFNKLIAAA

SEQ ID NO: 1691 - protein, 135 aa, Unknown
  Kingdom: Fungi, Phylum: Ascomycota
MAPQAGKDSITCHVLDTTAGRPAKGIRVVLEQTSSSAAAAGQAQPATFEARTDDDGRITRWQATGAASSSLTVDDVLASVKGASRWALRFDTESYFGEGKTFFPEATIIFRVDEGQHYHVPLLLSPYSYTTYRGS

SEQ ID NO: 1692 - protein, 411 aa, Unknown
  Kingdom: Fungi, Phylum: Ascomycota
MPPALPTNPALDNDDSMLTRRFGKEIINYYSGSSANRYSFLRADGNFLRRAAAAPRTRYVALSGFNPLTNAEGTHLTRYTHKDISSLIGEQPFAVSEDDAVKQWDSTKKLPLIVFLGMVDEKDSDSIESTEHGVIKGNALFAVDVTPQKPFEQAAEDFLANHVKNGGQLQTNPRAMSLEAHDAALFAQSRSIIDWNSRIPFCAGCGHPTLSVHAGYKRVCPPTDLRGTSSAVELPSCPSRKGITNIAFPRTDPTMIAAIVSADGQRLLLGRQKSWPEHMYSTLAGFLEPGESIEESVRREAWEESGVKVGRVVVHSSQPWPYPASLMIGAIAQTLPGEGEKIQLNDKELDTAKWFEFDEVRKALDTSTGPLHLPPPEGYQPGTLRLPPQQAIANRLITAVVNGYLSGVPKM

SEQ ID NO: 1693 - protein, 2502 aa, Unknown
  Kingdom: Fungi, Phylum: Ascomycota
MGSIPAQHDTDMHNTKLCTENTNFETVHELVAHTATRHGEKTALLCGEDHLTYAQLEEYASNLARALVQHGVGHEDLVAVCLDRSVDMVIAILGVWKAGAAYVPIEPTLPPDRIDQMLQDSGPMFIITKNGKPADLQLETTAEYLSIEVSRQRHPDRSQQCQDKGKKSALAYVMYTSGSTGRPKGVEVTHGSIVNLLHAMKHQPGCTEDDKLLAITTISFDMAIPELFLPLTCGATVVIARTREIQDMPVLTRMLEKHRITILQGTPALYRMLLDSGWHARPRLRQIWCGGEALPKALASRLLDLCDSMWNLYGPTEATVYGAMWEVQRGEEVIIGSPIPNGHLYVLDEELNPVPFGQVGELYIGGAGVARGYRNNTELTRTRFLTDPFHAGSIYKTGDAARFVGPMRIGVLGRLDGQIKIRGHRIEPGDIEAAMTAMDVISAAVVVSRDERLIGYYIRRDGKKTQLGPAEVDPFHKTMRSSLGRHLPAYMVPDFFVEVATFPITSNGKVDRKALPDVVDIFTNGHSQSSPSTVLEAQLVTIWADVLGHRSFGVQDSFFDVGGDSLRLVRLQRELQALLGRPVPAHLLLEKYTIKTLLEYLNLSPESLSLPPQVTEPEALSDFQDGIAVISTACRLPGGIESPEDLWRLLDTGGDAITAVPRDRWSTSHGILDDHLRCQKGGFISSINAFDLSFFGISPREARHLDPAQYMMLETSWEAFERAGYTMDQLRGSQTGVFIGTSNILSHQSLNENAVRDLASLDGYTVTGSAAATMSGRISYLLGLQGPAMTVDTACSSSLVATHLACNSLRLRECDVALVGGVSLMLNPGLHVEFERLQGISPDGRCRSFSDDTQGTGWSEGSVTILLKRLSDARRDGDRIHGVIRGSAVNHDGRSASLTAPSGHAQQRLLRRALSAARLHPNNIDYIEAHGTATKLGDPIEANAIAEVFRPDRDGRKPLLVGSAKSNLGHTQAAAGLVGMLKVMLAMEHAVLPESIHITTPTTAVDWHASNMMPVLKRQSWTVSEATPRRAGVSAFGIGGTNAHCILEEGVPRQHDNRRDDVLTDALPFLLSGDTDAAVRAQAQKLLVHLRDETRPRRLKDMAFSLATQRSHFRKRSVLWALDRTELFQSLETMSRDSGLLNGLLGDNGNPPVGPAKLAMLFTGQGSQWIGMGRDLYDIYPVFRASLDEIAAILNTALEIPLLNVMWAQPGSPNASLLFTTEYGQPAIFALEASLWRLWQDWGVTPDFVLGHSLGELGAAYAAGVIGLPDACRMVAARGRLMQAQAGEYRMAAVEATAEEVSDAIAHSAMKDAVEVALYNAPTQIVLSGRTADVDFVTSVFEVKGRKISVVVEGHAFHSRYMDNMLLQYAQVVESVQFHTPREIKVVSSVKARLLRPQEISDPLYWIRQAREPVRFCESAKALAAHGANVLLEVGPDQVLLGIAAASMGDTEVGHSVWLFSMKRDDPKGTVTRLLQNASSLHLRNVSINWEAVFSPYCCEPVTLPTYAFQRNYMAPKAMRDLDGSLLVDAPGSNDNAHSKNTHDRFSFQVSWTPAKRRDPQSETGTWGLLVLAKDSQWVTAVTAAAAEAGFKLVKVEDFGLAQTLEGIVCLWDSAPGEEAQDSRSTATALSQLQMVANTQSRTPLVWITRQAVGTGAESEDRTTLLGIGPLLWGLMRTARAEHPHLDLRLIDVGHNATGSAIRSAMMLKDEPESAVRGDLVLVPRLDRAGPEEHPLVADRLLRTDGAVLITGGLGHLGACVAEWLVSQHGIRDIVLASRRGTEADDAALQMDRLVSLGAKVAVVACDVANDADVQRLLADFDPRRPLRGIIHAAGIVDSGVLTSLTPNRFERVVAPKAHGAWHLHDATRHLDLDMFVLFSSISGVLGMPGLANYAAANTYLDALAHLRRAQGLPATSVAYGPLGNRGGMATRLARNTRSHLSRYGLSTLSEEQGLDLLSAAVHSRRALTIAAALDLSQLQHHLEEQNDPVPPMISSLINPNRRSREPKMPSDKTLQDTVTEALATKRLDIVLGAVRKMVAMTLGFQSPVEVDMDRSLKDVGIDSLTAVQLRNKLAAATGLPLSANMAFVYPNLQAMSRALCDQMQANESSAPSPSPPTLPTRTLNMTAIRAGCLDETFLFDSHACNERPRSVFLTGATGFVGAFILQALVKRGIVVHCLVRASSAAEATRRLFGALRHYGFDDAVEEALIRPFVGDLSQPLLGLSSQDFDFLSTHVDAICHSGGLVDWARPLEEYIGPNIVSTHEVLRLASQGRPKAIHLISTISTLPQHTGHHVTEAELEHGYGTSKFLAERMVAAARWRGASATIYRLPYVTASSATGHFRRDQGDFLHNLVAACRRLRSFPHIGADLRSVLPVDYVADTVVSLIASDRSRQGQDYDFLNASAPSCDAFFTAMIALDGNAATLLPFEEWKRLALAAAEECPGGPLARISVVIDGYTADTAHTMFKGQELGSNVLGGDDYPTPLLDEQFVARYMSQIDSSE

SEQ ID NO: 1694 - protein, 1200 aa, Unknown
  Kingdom: Fungi, Phylum: Ascomycota
MDDNDASLYSSLRVESYDTALCLVPPQEIWGPIDRFRALNDKGYGKWPPHINLIYPFVPVNVLDKAAQLLSALNYDDVLPLRLSLTEADSFRHKHDNTIHIRPSGDACPPALATLITRLSDALGRTERKPYRPHMTVAQSFDSNSDAHDFLLDKARLLTPFTWEASSLAILVRQKHGDGEDGARIMRLWGTIPSSTGDFSPERSHTEYYMRSLGREAHVTTALVRPQAAFGFSKGIGSWVQLCRTSQEPAAFPEGLPESVSRVIIASYNVLAEFEWPPVSTRYPHLVRNICSNRALADILVLQEVTDPFLDHLLGDPTVQEHYPFATHGRPSDERVGPLPSLLNVVVLSKYPMQWEYLEHSRKHKGSAIVIFPTIRVRQADGTESAPLVLAACHLSQGLTDGSVSAKKQEVQDLVKHLSQFYHRHPLAIAGDFNLTTSSFTIGMARKKGALSSHALQNLRDIDSLLLDHGFRDVWLDTRLESGESSGVRFAQENLGQLHEGEQGATFDPQINTLAAKQTGFGLNTRPQRYDRIFVGESTALRPSGFNMFGQETARTSEGGLSQHASDHWGVRCLLQAEASKSNLGSDSAPTKPVELWRASPSLGGLEDLITCLSKRDMVPTPEDETLRAGAIEVLRRLLIDEMVNQSQADSQFKPSLVLVPVGSTALGIWTPSSDVDCLCVGGISSKTFFTLALKRLRKAAAEGISVVRKVQANSGTMLELLVRGIRFDLQYCPAISIAEQYPEVLNRPSTDEAFSLPMQTLLKLKPARDLSYLRRSIPDMTQYRAAHLLIKAWAISRGIYAAKFGFIGGIHLSVLLVPICKSLARAGHNPNVSDIVTTFFHHYATFDWDKHMVFDPFFHKQTKYHRSFREPLCLLGWHTPSLNTAAAASVPTVRTLAAELIRADQLLSNTDLSWDEFLGEVDGEVDFLSRYQRYVQINIHYWGQSPSKGNRLVGWVESRCAMLLVDLDRRVPNLSPRIWPERFISKAKQDSSQVTECQGCYLIGVERADPPAGASNLDAEAVEGTLIAVLHDFEAKLKADETYYDPQYCWLNLTLQRQDQWTDGFDSEDEELSDEEQETNDSEQSVVSVTPRPKNRVSAGGSKAAKHSFSGLGKFRTATDVLNRLRWDPAMDSGDFIVGYEDRFTGAQEKVLDKWKSDLTHEEFIPQHRILYFKRRSDGIKVWERSTRTDKVFGSGVRS

SEQ ID NO: 1695 - protein, 648 aa, Unknown
  Kingdom: Fungi, Phylum: Ascomycota
MRVTIIGAGPSGLVQLKTMLEAHKRFPSRLPHLEVRLFESHDRVGGVFLHHSYEDGELVSSKYLTTFSDFRPRSDDPDFFSSQRYREYLEEYATHFGLWEHIHFGTKVESVRRGDTGVGHVVKYVTKEGVEEEWECDAIAVCSGVHHTPNYPDIPGIEHVPVVMHSEKFKERKQLGENTTVMILGSGETGADLAYLAITSPTKRAILCHKDGWIGAPKKLPNQHWLSPIFGLNTSSKPGLPLDVSQVTLFDTMYVHPMVRDSMAVWNFYHFLAIPFGCWLTTGTPRGMDQWVGQVPDSRFHASKVFFNKAWQRIQAAVSEPYRPKKLPLTSRIRRFFLHTDFPPPSRILDVAPFPSHITPDGVAHFPYNPSRPESARINEQGPVKPDVIVFATGYIPSFPFLQHADNEGRRPYPIAHDADVRQVWKRDDPTIGFIGFIRPGFGAIPPLAEMQSLLFTSNLLGLLPEDKRLDPEDEWHYRLIHRPDARVTYGVEHDSYAYQLAKDMNIAPTFTEILRLSLSTPRGWRLPYIWGAGACLNTKFRLVGPWKWDGAGEVMTGELWETVTRRTGAWGNLPLSGTPLLYLGTMNLYYWMYSGFWNGLARLGLSKPLKRVIAPKLMMEEMARTEQMKKVSGKDMDWENVSANGTA

SEQ ID NO: 1696 - protein, 389 aa, Unknown
  Kingdom: Fungi, Phylum: Ascomycota
MPLFNAVPPPPELASTPKKLITATATSPLPTATPPPAGYVFPSPARSTPIDIDAWTLHALESLSVSPLARGTRSPLSINIDEQRERKKKVEDGRERVARIYVEEEEEEGRGEPIRRPPSRRDSQRKREMLLKGKEGSRQRRRWENDRLMHVPNVQPPQPSDWEPHPTHPIHHIPYALASYWDQTQTHRITAASSSSKPSLQKIQLDRTMAHQAASKHAQLARGTATGLGAGEVPRDLREAAKRSHVVKGWVRDLEAPIRDWVRRERQTDDEEVGSDEEEIMFRGRGRGEEVREEKVRDTRSEESGIVMDSFGDVENASFKYVLLLPSSGEILRRWLTHSISAYYGLQSRSIILQDPTRKVVCIALKQTRRGRKTVMISHLPRPLWEICC

SEQ ID NO: 1697 - protein, 170 aa, Unknown
  Kingdom: Fungi, Phylum: Ascomycota
MSEYYYAASAPAGLTSGRHFKRSRSIKSDDPLNLRGPLEVVGSLKSGRSISLEGDFVVRGKLDAYGDITMNGSVTCEGDIKAYGNISVTGYLSASNGIKGYGKLKIEGTLEGTEVEVYGNLSITGYLKCRKLVVYGSLTLIGPSSTYVVEESEEVVGAKLMREQEADWEF

SEQ ID NO: 1698 - protein, 558 aa, Unknown
  Kingdom: Fungi, Phylum: Ascomycota
MSAPTFTVLQTKPVPRGTDEFEVKRAAILKEFADKVPTEYYIPKSILDSVELDVSGIPAKCSILSPEELRITEDYDASGLAEAIASRKLTAVAVAKAFCKRAIIAHQLTCCLTQWFMDEAIQQAQKLDEYLVTHGKTVGPLHGVPISIKDHMGIAGTYTSGASLYSIVKATEDVHFIRVLREAGAVFYCKTNQPQSLMHLESDSLWGRVLNPYNINLSAGGSTGGEAALIAMKGSVLGIGSDIGGSIRGPSAFCGIYGFKPTSYVLPFDGMLLEPFPGELNILCAPGPMGRSVRDLNLVTKTVLATKPHLIDPRLIPIPWTGTETPIKGPLRIGLIEHDGFVDPQPPVKRAIAWAREVLSDPKYAGLVEVKDFKVYGAAEAMHKIRKMYFPDGGASTCEAITSTGEPIHHLTTDILKDAAEDGMCTAVDLGNMRADRDDFRMKFLRSWQDQEVDVVLGPAFVGPASAHDTAYTWTYTSLYNFVDYPGVVIPTPVVAKAGEKYDASYKPLSPECERVNKLWGETNFEGAPINLQLVARKYHDNQLFGALEVLKDILQLS

SEQ ID NO: 1699 - protein, 395 aa, Unknown
  Kingdom: Fungi, Phylum: Ascomycota
MSSSLLSSPNAIPPRTSSSSAAHARNTSDGTQSSPPPKSVLRPVAEGDWLSQKQAQRSNKHGVASGPFTITGMLPPNEPPNPQRYAHDDFDFVAKKSWTLDKEKVVRGPFEYVISHPGKDFRSQLIAAFNAWLEVPADSLEIITRVVGMLHESSLLVDDVQDSSELRRGFPVAHNIFGVAQTINSANYIYFVALQELQKLNNPLAVSMFAEELVNLHRGQGMDLFWRDTLTCPSEDDYLEMVGNKTGGLFRLGIKLMQAESKTSYNCVPLINLFGLIFQIRDDYMNLSSSEYSNNKGMCEDLTEGKFSFPVIHSIRTNPSNLQLVNILKQKTTDVQVKRYAVAYMESTGSFEYSRNVLAVLIERARKLADEIDEGRGAAKAFKKILDKMVVTSEG

SEQ ID NO: 1700 - protein, 304 aa, Unknown
  Kingdom: Fungi, Phylum: Ascomycota
MRFCARSARLQPCTRQSTRAFGSTRSLAVANDSTSSSQQQRSTHFGYETIPEHEKEGRVAGVFTNVAESYDKMNDFMSLGIHRLWKDHFVSSLNPGATTPQGQPQKILDVAGGTGDIAFRMLQHSHTQNLNPNIHVTISDINPAMLSVGRDRSLSLPASHQACLSFLEANAEVLPPSVEDNSLDLYTVAFGIRNFTNIPAALKEAHRVLKPGGVFACLEFSKVDKYPLFNAIYKQWSFSAIPLIGQLVAGDRDSYQYLVESIERFPSQEEFRGMIEDAGFKVAGKGYEDLTGGIAAIHRGIKPL

SEQ ID NO: 1701 - protein, 1221 aa, Unknown
  Kingdom: Fungi, Phylum: Ascomycota
MASDKAASAAQTPARDTKAASSGTASASAKQRTIMSFFQKSSPGGPGAPASSPLAKVSPRTQASPSSCLQETTKANALPKTRKPSKMSTPVPSSDAVEPLSSQENHGTAALESDEAPTPKPKPLTSTRNQPKSSLAGSPGRKAKKVVNYAESSDEEEPFTFASAKQRRQTKSRPVVKDEDEDEFDLGDDDAENGGEDDLMEDFVVSDDSEESDSRAKKRKRASKPQASRKRSNIMPESEPEELMIQDEDSALYDIPPTSTGQWSYDPESTDKRPVTTPAERAPKDPKIKEKAHTKEPEQRYAWLAKIQDKERRSPGDPEYDPRTIFIPPMAWDKFSPFEKQYWAIKQNLWDTIVFFKKGKFYELYEKDATIGHQEFDFKMTDRVNMRMVGVPESSLDHWVNQFIAKQYKVARVDQMETNLGKEMRERQDKGSKKDKVITRELACVLTGGTLVDGGMLQDDMAAYCVAIKEQIVDNCPAFGVAFVDTATGRFHLSSFVDDVDYTKFETIIAQTGPRELVLEKSQLSTKALRVLKNNTSPTTIWTHLKPGAEFWNADMTRHELDSGKYFVNENAEEEEEEVWPEALQQFKNDDLVFSALGGLVSYLKFLKLERPLLSQGSFEAYSPIQKNGTLVLDGQTLTNLELFSNSVNGGSDGTLFSLLNRCITPFGKRLFRQWVAHPLCDIGRINDRLDAVEMLNQDPTIREQFASQLVKMPDLERLISRIHAGACKPEDFVRVLEGFEQIEYTMSLLEPYKGGNGIVDQLIGSMPDLDEPLSYWRTAFNRQKAKQEKILIPEKGIDDEFDQSLRQMDEIKSQLNDLLAEKKAELKCRGLKYTDIGKEIYQMETPKTVKVPTSWRQMSATKDLKRWYFPELTNLVRELQEAEETHSQLVREVASRFFRKFDVDYDTWIKAIRIVAQLDCLVSLAKASASLGQPSCRPQFVDEERSVVEFEELRHPCMINTVGDFIPNDIKLGGDEARLNLLTGANAAGKSTVLRMSCVAVIMAQIGCYVPALSARLTPVDRIMSRLGANDNIFAAQSTFFVELSETKKILSEATPRSLVILDELGRGTSSYDGVAVAQAVLHHVATHIGCVGYFATHYHSLATEFENHPEIRARRMQIHVDDTERKVTFLYKLEDGVAEGSFGMHCAAMCGISNRVIERAEVAARDWEHTSRLKDSLEKAKTGCYIPLGMLSDVSSLLGDGTDVGDDALEVMLKAIDKL

SEQ ID NO: 1702 - protein, 297 aa, Unknown
  Kingdom: Fungi, Phylum: Ascomycota
MSVNGEIADQGEAPEGYDIGETDGQTKMYSCPHHGCDGMVFYTTGECKRHEEDWHNGPYICTCEDVFAARPALQRHIRAAWHREVKPETFSCVEECCPKYEEPLSTLYNLRNHNQSAVHRAAENKRAYFESIRAVISRALHERMEAFQHLICDVPNCPDFQKQWSTAASFVKHADTEMHQSYDKAFEEALTSGPEKLAKLERESWPFECRRKRCGGYGQRFRTKMEYHGHCSSTSHTEATTDVPPRPQTPKLQMFDHDVQMTGLLSPPGSETPRPLTKIVIDLPITPKSATRGYQWI

SEQ ID NO: 1703 - protein, 808 aa, Unknown
  Kingdom: Fungi, Phylum: Ascomycota
MPSSERVPQTLYDKVLSAHVVDEKLDGTILLYIGKIAHSPPPTATASDASGCRDFLLTFATTDRHLVHEVTSPQAFEGLRNAGRKVRRPDCTLATTDHNVPTTSRKALKDIASFIEEDDSRTQCVTLEENVKDFGLTYFGLGDKRQGIVHVIGPEQGFTLPGTTVVCGDSHTSTHGAFGALAFGIGTSEVEHVLATQCLITKRSKNMRIQVDGELAPGVSSKDVVLHAIGQIGTAGGTGAVIEFCGSVIRSLSMEARMSICNMSIEGGARAGMVAPDEITFNYLKGRPLAPKFGSDEWNRATAYWTSLQSDPDAKYDIDVFIDAKDIVPTVTWGTSPEDVIPITGSVPDPETFSTEAKKATGRRMLEYMGLTAGTPMEDITVDKVFIGSCTNSRIEDIRAAANVVKGKKIAANIKRAMVVPGSGLVKTQAENEGLDQIFIDAGFEWREAGCSMCLGMNPDILAPKERCASTSNRNFEGRQGAGGRTHLMSPVMAAAAAIVGKLADVRKLSQYTASPHVEAQITPAGKAHVDERVEESAEEREAIADQPEDSEPHTNTSAAASATSSGGAGLPKFLSLKGIAAPLDKSNVDTDAIIPKQFLKTIKRTGLGSAAFHAWRYNEDGSENPSFVLNQEPYRHASIMVCTGPNFGCGSSREHAPWALLDFGIKCVIAPSFADIFFNNTFKNGMLPLKIENKNDLDAIAAEARAGREIEVDLPNQLVKNAAGDKICSFEVEEFRKHCLVNGLDDIGLTMQMEDKIAEFEKQMSVKTPWLDGTGYLRRGKDGRLAAKAVPVPKTNRGEEKKEPLEW

SEQ ID NO: 1704 - protein, 863 aa, Unknown
  Kingdom: Fungi, Phylum: Ascomycota
MAPNKDTPFRSADMSMVQLYVSNEIGREVVTALGELGLCQFRDLNEDVSAFQRTYTQEIRRLDNVERQLRYFYAQMEKTGIPLRKLDLDNERLASPSTSEIDELAERSQKLEQRVSDLNDSYETLKKREGDLTEWRWVLREAGSFFDRAHGNVDEIRASTDNDDAPLLSDIEQHHQAPEVERSFSGMNIGFVAGVIARDRVAAFERILWRTLRGNLYMNQSEIPEPLIDPTNNEAVNKNVFVIFAHGKEILAKIRKISESMGAEVYNVDENSDLRRDQIHEVNGRLDDVQNVLRNTQATLEAELNQISQSLSAWMVLIAKEKAVYSTLNLFSYDRARRTLIAEAWCPTNDMPLIRSTLQDVTNRAGLSVPSIINEIRTNKTPPTYLKTNKFTEGFQTIVNAYGTATYQEVNPALPVFVTFPFLFAVMFGDLGHALIMLSAALAMIYWEKPLKKVTFELFAMIYYGRYIALVMAVFSIFTGLMYNDIFSKSMTLFPSAWSYVKPDGWKEGDTVSGVLNTDGYRYPFGIDWAWHGTDNDLLFSNSYKMKMSIILGWAHMTYSLCFAYINARHFKKPIDIWGNFIPGMIFFQSIFGYLVVCIIYKWSVKWIDFEDGTNNVQPPGLLNMLIYMFLQPGTLDMELYKGQKVVQVILLLLAFVQVPILLFLKPFYLRWEHNRARAKGYRGIGETSRVSALDGDEENEGLVNGHGNSFDDDGEGVAMISQNIDDEHEEFEFSEAMIHQVIHTIEFCLNCVSHTASYLRLWALSLAHQQLSVVLWNMTLGPALARPGVVGVIMIVACFYLWFFLTIAILVCMEGTSAMLHSLRLAWVESFSKFAEFGGWPFVPFSFNALLEESEDLKDYLG

SEQ ID NO: 1705 - protein, 79 aa, Unknown
  Kingdom: Fungi, Phylum: Ascomycota
MDSSLHEVWQGAAGTPFLPTIGKHSQFFVGFTLLVIGILLTGVFALNRSLVNVGVLGVPASLAIAFGTVYMFCGVGVYV

SEQ ID NO: 1706 - protein, 560 aa, Unknown
  Kingdom: Fungi, Phylum: Ascomycota
MSASQFPEKGPPAESSASRTNSHQDGDFVEINGQPDVTAGSQALHRKLRGKEVQLFAIGGAIGTSLYVQMGSALPKGGPAGLFIAFIIWGTVMWCVNECFAEMVTYVPVPSPFIRFGGEWVDQALGFAMAWNFFLNMAFLVPFEIVALNIMMTFWTDKVPVEAIIVAMIVLYTLLNIVTVRHFGISEFYLSIFKVLLMLGLFAYTFITMVGGNPLGDRYGFRYWKEPGAFVSHLAPGDLGRFLGIISCMYQASFSVCGPEYISMVAAETERPRSVLPPAYRAFVWRILVFFVGSALCMGIVIPYDDPTLNAILGGEKSGSGTGAASPYIISMQRLQIGVLPDIVNALIMTSIISAGNGLLFAATRTLHGMSLQGHAPKVFSKCTNAGVPIYALLFSLLFTLLAFLQSDRSSVEVMNYLVYLVTCCQLINYLCTAITYRHFFAALKKRGISRDTLPYKGRLQPYTSYVAMFGTSFMMLASGYTLFMDGGWSVMWFFFDYGMIGFFIVTFVFWKVFRKSTYVRPGNADISLGGLKEEIDNYELLFVPRPKGKIAKMFDKLFE

SEQ ID NO: 1707 - protein, 1286 aa, Unknown
  Kingdom: Fungi, Phylum: Ascomycota
MLGTTISRTLPLFMVNATGHPLMNLSRSEQHTESATMDATEADQDVKLQKISKDLLSELGDGLTTFLRKPDGRGGTTPRSRVRSRELFRLTSHVLDPFQELPQLLDPYLPKWIPFLSETYLELLLHARPESAGQRAGPSKHLVSADYAICKLLYTFCKIRGEKVIVRFLNVEARYLELLTSAIENAEETAKGPGESDNSWAWEQRYIVLLWISHLLLAPFDLSTISSVDPEDMSIPSIPHLAWPKGLPGIALRVLPLGVKYLASPGRERDAAKALMVRISMRRDMQQLGLLDCLVAWALDSLKPRQDDAETAPYFYLGVLSFLAGALRSSSDTSDMDKHLQVVFHTVHSVSVDDSTSSKSIVSLALARKMILKVMRAVVVSLLRQPEQTDASTELTETAIGHLLESVADNDTPVRLLASKSLSIITLKLDPFMASQVVEAVLDSLNRNVLWSKPSAASGAKPTRDLSAVDSLEWHGLMLTLSHLLYRRSPPAAQLSDIVHALLLGLSFEQRSTSGGSVGSNVRDAACFGIWAVARRYTTEELLAVSTKSVFAARAHNPTSSVLQVLATELVTAACLDPAGNIRRGASAALQELIGRHPNTIDEGIGVVQAVDYHAVARRSRALAEVAHGAAELSAQYGEAVVDGILGWRGVGDVDAGSRRDAARGYGKLVAELAVGSEDSTSRVKRAIRDVDDRLKLLARRQVEERHGLLLCYAAVIDQIPPLMKGNCTNELLDEREVSKIIESVTGILRECGEVTYRKPDLIAEGVSRLVVSLVPLLTAVAFNDYCQEMPKLSLYLTEQAGVYADLIAAVDRKHQEGSDSLLAAFTSALRKAIPAWLARDEQVLLEPVSEAAVTLLVFSASDQRDLTIREWTDAIRRKPTSRNSGIGDGYMHALALAEFLLFDQQSIGDAFLQRWADDNDVETRVAILQSLTRSRLLRNDMVKLLPLLYDGLNDYTTNARGDIGSHVRVQALRLVQSLWADRELDEAWTGSTLSLLFGNVLRLAAEKLDRVRPEAQAALALTLKEEHQAAFQELTFSSELYLRTLLSFLESNEKFHPKIQQRVHSDLGMLAAHLLAGYVTSADTGNEDLVIASRAALCHFISSAADPAHSSFLVGTALLHNLRTNQGNDRVIIPTLEIIAFLFRVGLLNQGSNVSEKGNNTSEQQQQQRSPEQLDLKAICVQTQKAGYKSGSVRKIEACVRVYGGIAAAGQEIASREARKRLGALLFHPWPKVRSMVVDEVWGLLGEGDLESEGGGNGGEGLLGVDWGRASKTQIRGIVEELGLV

SEQ ID NO: 1708 - protein, 608 aa, Unknown
  Kingdom: Fungi, Phylum: Ascomycota
MPEDAYGVKRRDTTKGPPLRVLSLDGGGVRGYSAMIIIQELMHRTFVEIEGRAPRRHEIPKPCDHFDLIVGTGTGGLIALMLGRLRLDLETCKELYVQMTRRVFQTDKTIAGIPYRSTLFKASKLEEAIKEAVRANTGANADIAASEGDLMNPLSADRQSTGHPRRNLSNASTVSFSARSPAAQMARPMFNSRGGDPNAKLYDPRENRTKTAVTAVYKGSPKGSPPALLRSYDSRHEPPPEFDCTIWQAGRATSAVGLAFKPIQIGQSVFHDDGAGTFNPAPEALDEAVVNEWPGREVGVFVSVGTGKRPKSSDSNQHLWYEGFLGEFAEARKRLIAKIENCETIHEFMMRDYLAQRGVLADNYYRLNVEIGVGEFGMNEWNRLGEISTSTRRYMARHDEQKMVRGISTKLAKIHKSKTRFERAARSGVPEIVKSTSSTTMENPFAVELPGDMPPSPSYAQSPSRPSFDSGASDSLNVAHPHRPGSPHSLRSQEHLHPPNGASPLSSGTPTPGDDPDRLLGHAPTPSQYRVASGNDKISIMSPDEHPRPPPVPKQASLPPTRIEPPPLPPKTPLPERQHDLRTATPPYPIDEAPPPVNMARKPDLRGR

SEQ ID NO: 1709 - protein, 844 aa, Unknown
  Kingdom: Fungi, Phylum: Ascomycota
MGASDSKLVFKQGIFKLSEERHIAADDPYWTSFWELPESSEDVFSLFAPNDIRRTRDKALENLETLILAVTSRLFILRHHPSFPDPEIAPEKDALNCVRVLTRVLPFLYEKDGLKAWEEQFFWGARRKKTRKASIANEVLFDEAHPDKTQLESGEAEYEDAKPLAEELIDTLVDLLFFSGLTLPEQPQGRAKVTYAIWQSGVGCNTAVATTKEYESNRAEILRLLLTLAGQSLYMAPGVLPQQGTLKYNPATWRVPYNTLVFKDAKQVLVTYSLQLLLAVLVYPIPESSETQKNYYRHYLGRLHRPQDFQFIVDGMSRILNQPLQEKSSYLPGSQSSAVFAPEMLMLFWEVTQCNKRFRSFIIDTDRAHDFMVLILFYALEYKSEATKQGLVRMCAFMLQTLSVETNFGISLNKTFEGQESLPASIRIQNFRGSYADFLIQSIYHLITTSQGKLKAVYPALLAVINNIAPHTENLSPSTSSELLQLLSSMASPSFLLANEANHTLLFALLEAISSIVEHKYPKNPHLLVAIIKNRKKIESLRTFTLESGQEEIERRNRRRKDSGLPLDSLDEGSIRSSVDSARSPATTPTRSQTLPGVPEDGTFAIGDDEDEDSDEEPMPTPAQSTTSENPSQASSATDDAVPVQLRGMSEKARGKMPAGARSFSRQNSTTSLGAHSISGQPHTGSFEPTAQWIDSWLPELPLHTLLIVIQQLSSLLPRQMSARDVVSQDALRRIQKTELVGIDPSDARVHSFEWSQLALGWYESLLWGVIFTSELQLAKGSMGTWTGTGIKLFRVQETAPTGPSLTSPRGAVDAVGSNLVSRIGQINLRGATGGQPPAQRTSP

SEQ ID NO: 1710 - protein, 446 aa, Unknown
  Kingdom: Fungi, Phylum: Ascomycota
  misc_feature (35)..(40): Xaa can be any naturally occurring amino acid
MQIKAALIALVVRWRPRPRRQQQQQWWQQQQQQQXXXXXXGNNNNGGGNGATLLADNIQAASNSDGGADVEAGQSPSKTDPDNFINFCSGQTKTNGEQVEAGSCNGIVMGKIPAIGKMVSSVIVNPLNGANLQADQDFTIEVKMNNFAPGTFTNPANTYYAAPQDLDGGGNIIGHTHVTVQDTGANTNPTEPLDATQFVFFKGINSPANGQGLLTADVTGGLPAGNYRLCTMASSANHQPVLMPVAQRGGQDDCVRFTVGGNGGGGNNNNGGNNNNNNNGGNNGNNGGNQGGNSENPSDKSGGNNADGGNQTGGSSKDSGAAAGAGAATKGGNGGATNGALGGIAAPAVADSGNGDRPFSVNGNTFVNKAAAVQRACDIQNNACSDAVNRGQLKGVTLADCNGQVAKSYLKQSGIHQILRETFIDQDSVPFWVRYAAFLPVHFLSC

SEQ ID NO: 1711 - protein, 573 aa, Unknown
  Kingdom: Fungi, Phylum: Ascomycota
  misc_feature (73)..(78): Xaa can be any naturally occurring amino acid
MRADDENPSGETHPVADDQGDAYLSDGSLSATSLSSVSSVETLDYHDGHRPSLREIRSSVSYRSRRGSRSVSXXXXXXRMSTIGRLRSRAPTVFTHPLAHVPTAAGSLVDFEGPDDPYRPINWPTHKKVTTTLLYGLVTMSATWASSAYSAGTSQVAAEFKVGRQVAVLGTTLYLFGFGLGPLLWAPLSEVFGRRLAVMVPMFVSICFSFGSATAKDLQTLMITRFFGAFFGSAPVTNTGGVLGDLFSPAYRGIAMAGYAMAVVAGPALGPIVSAAVVVQPSLGWRWTEYLTGIIQALMLCIAVIFIDESYPPKLLVYKASRLRHETGNWSLHAEFEEWDVSLVELGRKFLIRPVQLLFTPICFLVALYASFCYGILYMQLGGIPFIFGELRGWKPLVATLPFLSILVGAIVGAAANVYNQLLYNKAYRAAGNRAVPEKRLPPMMLGSLLFSGGQFLTGWTADPSTHWIAPCIGLVMLGSGFFMIFQAALNYLVDTFTAYAASAVAANTFLRSCFAGGFPLAVTPMYRNIGVGPGSSITGGFAALLIPVPFVFYVFGKRIRASSKWSKASVYD

SEQ ID NO: 1712 - protein, 109 aa, Unknown
  Kingdom: Fungi, Phylum: Ascomycota
MPGKITPESGHAVATVNGQTLASAASWLRCEGNVYFPPDTLKGKDEGVFSNTELMTYCPWKGHAGYYTVDVGGEKVENAGWYYADPMDAALPIKDHVAFDRSKVTVKVD

SEQ ID NO: 1713 - protein, 404 aa, Unknown
  Kingdom: Fungi, Phylum: Ascomycota
MHFPRALVAVAITSLGYIRAAPFESARLETRQTNPVLPNIDPSIDAVDALLELQAAAEGALDSRDKSKRGAKQCTLTNARIRKNWSSLSANERKQYIKAVQCLRELPSQGPTEWSAAQNRYDDFVAQHVNLTTEAHGSGPFLTWHRAFVWSYETALIEECGYKGTQPYWNWFEDTQDLTKSPVFDGSDTSMGGDGEFVAHNGSLGGARHIYLPSGAGGGCIKSGPFKNAQANIGPFNPAMDGLGPIVETLADHNPRCVSRDLNSYAMSKWYRTEYLLNVTIGEASKTHRSFWSEIQGRYPDQFLGLHTTGHYAINGDNTDLYSSPNDPAFFLHHAMFDRLYWIHQILHPKEANKVAGTMTLQNNPPSRNATVDDPIKMGAIGTTRPIKDFFNTLGGTPLCYIYA

SEQ ID NO: 1714 - protein, 460 aa, Unknown
  Kingdom: Fungi, Phylum: Ascomycota
MPPPPVCPSRTPAALSLNTSNLHLSHKPPLPTTLARGILNRKNDAQVLVPPLVAGALVAAFARAVSEGLGNELLTHYYLTTAAEGESKVVNVDRVLDRLLAEFTRALWDELFDFYTASDRGFTRQVALLFDGPIRQVVLVLNGPETAACLLDHIGPGLSRRKPSWSKDATGIELVLALQLVCGYWHREYPELSPGGSPEEISRTLCNRLVNGQASRGLVANIRKVLLSPHYVQVHVLETAIWDRLLKRRRPPPRDGFHVAQFRFECQLAIRPGEYASPSDIDLSAREAITGTSAECHLGTVLDYVDKHWQRCGRLVLAGLNDAVKAAYQSSEQGDGFSGMAIWDGGSDDGKDVFCPGLRLLHFEIESGFIQLTACAWAHSLVDIFQQMSWICAALGSAPFGGGCAAESAVEITEGNYDGDTMFFNCSMAHQPVANGEGLPWLREIPGAVIARGFPVGAEP

SEQ ID NO: 1715 - protein, 532 aa, Unknown
  Kingdom: Fungi, Phylum: Ascomycota
MAHAAEHESHRRPREEDDDAVTHTSQRPRHNTNVPQGATGFINYLPRPDQLPLPLIQGDGDTFTDIVSLIGRYEDVLKRRDSLAANLGAKLTGPRLLKGIDNFFEGSVTIISQPHYPVTVTWSDVVLFAKSNGDEFKLTSHPDGTRRCQFPCKGCQVEICEDDWRLISSGALDGLALEQSFEEDELAELAALDIIEQRASILYKKADEVAARARILHHALGQRKNEITRRRQSQNPPPQRHSARMSAFGGAYDLHADLLQQFVSATAASSQSRSTSGAGLPLTPVGQQSPSIPMPFPRRASSFSRPQTTNTTNNTNTNSTNSNTDNTGPAASVNSPSDAFRSLITQRTDKLVKGATIHPPCDRCRRLRLSCVKHLTACQGCTKKHAKCSWKAVPDEEAARLRQEMGVTATESEAETAAEPRLPSWSGGPQIFQFSGRGQPEDGPRPESRDEGTATPTPMFNRVQNVNNGFELAPIKSRTGLPSGPESDNASLPRLNEHALGHIASLAAQSVHEGHGHHLDYQGGDASHPSSR

SEQ ID NO: 1716 - protein, 564 aa, Unknown
  Kingdom: Fungi, Phylum: Ascomycota
MPRKTGSERIRAFKNRTRSGCGACRARKVKCDENRPKCARCISRGDTCEYERIDLKWETEYLSTGRAFGREGVWSKVGPQGRLRHNSTLTSCPNSSDDSPRHHVLIGIHHFIHTRSQDIKIDSHDGMYHAPLGASDFLGPTVSLDSTSHHMSSITESDPMLLRNPSSYQSLSYNESTLLEYYLMRICLLANASEHSTSPFISLMMPVLASGSHNLATLSAMAFSARHRSLKSPQWSGMALWLKGKALAALRQTLGAGNPTPMTFSLQSPRIPLAMMFLCLYEIIDNCNNAWVLHMRASQDFLSRRKKICEPVVVESDVERSQILLAENFFAFQDAISRTACVKSSVFGLEYWQSPIRQKDAVGWLGQSTRVTESLFMTTELGRVKAKLPEDDFSAEADFLEKELASIAYDSSNVNDVLMWESAWLYQQCLLRDATPATPGIPETVDRILQYLFRSVRGSDGHSSALAFPLFIAAVELDPLKDNDMLFDSVNSSPTSRRRLVLDILHSISDACFFNNSRIGDVIRQLWAHRDLQSERKDESQRSKEALNDWNFYVRPYCTNLSLA

SEQ ID NO: 1717 - protein, 1343 aa, Unknown
  Kingdom: Fungi, Phylum: Ascomycota
MAQSSNMEDFVNWDQAGASIESSQKEDQQTMLGSHHSSTSPEAPFDDNIDLVLANVNEDDFSFHALQHFTNDFSAPLEHIDPSLRDFNALEPLDDFPALQWETPDVPCAQCALGGYSCKKIREGAYQGFCTSCVALMIDCSFGGVVPPSLNPTTVTLPPVENSISWASSGNATPIIEDGEHHVADPLQPLSSASALELFNIANASNASAGTEPSTAFATSTAPKVGARLSRESVRVLKNWLSTHNRHPYPSDEEKEVLQRNTGLSKTQITNWLANARRRGKVQPHRSTSPQVGNWSSGVEIPARRGTPALESMNPLQRWQHSPPEHEPASVTAIARAVTTSSSAISSGLNSPFSSFPYTDDGSGKSICNQSSASSIGTSQSSNGSRGSAYSHGSRNSFGSFGSGPFSNHSRRRRRRRAAPRQSPDGLKSLSNPLKTFQCTFCTETYRTKHDWQRHEKSLHLSLERWVCAPEGARILRPETGQICCAFCSEPDPDDAHIESHNHSSCQERTLEERTFYRKDHLNQHLRLVHNVKFADWSMKSWKVAAPEIRSRCGFCGIVLDTWTTRVDHLAEHFKTGKTMADWEGDWGFEAPVLAMVENSVPPYLIHHERLSPLPYIAGRVTESPRNAYELIKLELAYYAANYQQHNPDCKGPTDEEMMVEACRIIFASETLSLQGIATQVSWLRDIIMSDEELALKARFGPLRSATENRLASLKINGKDNLFEECPMEQQLHEFVKAKRLLGLTAMDNELQEEACKIVGRVEEVSTNPSERVANWLVRLATSSTKWLAPFRQRASLPRSDDIKHAIIRSTDPRLIDSTIHSYSRLERELADFLQMQRAMGVEPTDEDLQRQARIIIYEFDDGWNQTAADSAYWLDSFKSRHPPVEASPAASGVSSSFSHLRQTGSTAASAVPSVAGTQAPTTMNAKGDPAFYQIMGERLILNQSNCYRGLELELARFVRSMMSPNNPNQHIPTDAELQHQARWIIHNDDDPWNWTAADSPEWLANFKRQVGLVPGGPDSTLGAATTFNWSCPNQPKGNDGVISHNTLTQPIAPVPRTAAEMAGSVMAADAMMLEGMPDMNGDSAALQEMDFGWNRQALRGWVVLNDIDDASPDWIIAPKSAVAILKTMAEKHPFVPFGPEWRAADDGGTTGNDGEQTSSSSSSNATQSEATTTPPSVLDAPIRLLEEYHYDVNAVDVATAEYAYVADHVVEVDQGAVDVGEEMRKFAEALPQRKGEEGWFEKLMFGLRIFGEDTDKMGWYVVVCEDEVRDGGWSEEEEEEEGEEEEVEKEAKHGVGRETQDAAAVLNNETLNKEERRDDGQDGKGLKSRLKRMVPLRRRDKE

SEQ ID NO: 1718 - protein, 360 aa, Unknown
  Kingdom: Fungi, Phylum: Ascomycota
MVNYPEKFEAFQSPGLKNWTDFEKNAFTPRPFNEEDVDVEIECCGVCASDMHKINGDWGDCPYPLAVGHEVVGKVVRVGSKVTLAKVGQRVGVGAQVYSCLKCKQCQNDNETYCVHQIDTWGQEYLNTGHITQGGYSSHIRVHEYWVYPIPEKLQSAQAAPMLCAGITVYSPLKRFGAGPGKKVGIVGIGGLGHYGVIFAKAMGAEVWAISRSRSKEQDALKMGADGFIATSEKDWNVPHKMTFDLIVNTANATDGFDLNQYLSLLDVHGRWNSVGMPGGEGFNIRNQSFIENGCFIGSTHLGSRKEMLEMLQLAADKGLQSWVEELPIGQPGLKEAMDKLKNSKARYRSCMVGYDKAFA

SEQ ID NO: 1719 - protein, 643 aa, Unknown
  Kingdom: Fungi, Phylum: Ascomycota
MSAFTALNGASPKGSEPPAIVAETKANPEDRPRSSAAQSQAGTEHSAQHESWTGHGQEGSGLQTSPRTEAESSLKRKRSSSLEPRRDHPIQERTPDTATAPTHSESRDPFDTPQRDRDPWYAQQAREDRAHHDAPQSSRTSPGHMEDHIGDALRRVTQNDRSEYDQTSPEGDERSAGAYGSPHTTSHRQGSILQHDPKKRKRNFSNRTKTGCMTCRGRKKKCDETKPECINCVKGGFVCAGYPAQKGAQWQKPNDKTLTVPLESKDPTYVPPGAYGMPQPGPYASQSGKREPIPPYRGQALRIDPPQGRPLTTEDDRPTASTLPSASVASPDNKLSAISSYTAANMFPTPVSANTQPPPFGERMGKEYQRVPPLHDLARNEPETPHPGGHLPQINILHASRKNSPTQVGQQQPSANPQIAAQLALSHPGFPGRRTQKEEMLSGRSYYPFDKELCLERERCASACWRFNNLTVPSHGVSHEERGRLFLDILQPRDPVRVSPTEASPVTNVGRVGREVAVETPFTCDYGYNIIIGSHVSVGRNCHINDVCEVKIGDNCVIGPNVNIYTATLPTDPKRRMGGQGPQTGKPVVIEQDCWIGGGAIILPGKIIGKGATVGAGSVVTKDVPPFTVVAGNPARVLRGIAS

SEQ ID NO: 1720 - protein, 474 aa, Unknown
  Kingdom: Fungi, Phylum: Ascomycota
MSPTPDYRNIFHWAETQKDGAIPAYATRKNDPYEYLPGFGNSFESEAVPGTIPHGQNNPRCVRFGLYTEQMTASAFNAPRHMNKNAWLYRARPAVAHQGFTDLPTVEGTESCFLPLNPRVKVSPTQLAWLPFDVVDGADFVTGLRTIAGSGDPTLREGLATHVFTATKSMEKRAFVNSDGDYLIVPQQGPLDIQTEFGSLYVQPGEICVIQRGQRFRVSVEGPTRGYILEIWGSNFELPELGPLGANGLANARDFLHPKAKYTITKDDPWEIVYKMGGRYFSSTQNHCPFDVVAWHGNYVPYKYDLTKFVNVGSISVDHIDPSIFCVLTAKSRDPNAPLADFLIFSPRWDVASHTYRPPYYHRNVASELMGLIYGEYGGRSDEFQPGSVSFECGMVPHGVAYEEFKAASAQPPPEMQISKGSIAFMFESSRQFTVADWAWNSEKKHVHEPKMWDNLVDNFSNHLDEVNEILAGK

SEQ ID NO: 1721 - protein, 374 aa, Unknown
  Kingdom: Fungi, Phylum: Ascomycota
MSFLFGRARSRATADLPRQARDHVSRLDGPNGAAKAEELARVLAQMKLVLQGTHVLCLQETDSSPEQIYQLVTGLIDEDLLHLLAVNLYRLPFESRKDTQVIFSYVFRFRPAAAAPKSDPIALSYVVCNRPQVLVELCRAYDHKESATPAGSVLRELLKNEAAAAVILYDDGDEPGSSAKGLNAIDRDRPQSGRGVFWKFFEWIDKSSFEVAADAFTTFRELLTRHKDLVPRYLSVNFDLFFDKYNKILVQSNSYVTKRQSIKLLGEILLDRSNYSVMTAYVDQGDHLKICMNLLRDDRKMVQYEGFHVFKVFVANPHKSVAVQKILLMNREKLLTFLSHFLEDRTDDEQFIDERDFLIKQIRNMPPSPIPPQR

SEQ ID NO: 1722 - protein, 384 aa, Unknown
  Kingdom: Fungi, Phylum: Ascomycota
MAVLGNSLWPAEPSTSLIVTTTAIATIGALFLGRAAGWPSRPKVLANPLKTFPKGSQRRDELGNLIYRPDTFPGARDVNTPYGSVRVYEWGPEDGPKVLLVHGISTSCITLMHISNSLVKRGCRVMLFDLFGRGFSDGVGDLPHDPRLYTTQILLVLASSHLAWTGTNGFRLIGYSLGGGIAVHFANAFPHLVEYLVLLAPAGLVRPESFGTVSRFIFSSGLVPESILTLLTRQRLQQPIVAAKVPKGTMPGDPQADIALSEAATEANEEKLIPLERHVLFYVRWMVAHHSGFVSAFMSCIRHAPLTHQHEYWADLAARKPGTTAIYFAEGDELIDSEYYAKEALPLVGGKDHVDWRVMPGKHDFVMTHTSSIMDALDEFWGKR

SEQ ID NO: 1723 - protein, 785 aa, Unknown
  Kingdom: Fungi, Phylum: Ascomycota
MTSAASAANQAGPLPAIEEPTASSPPSKRDLRSWWKNFKLQPKNQQEPPAGEQKPKGIFGVPLRQSITYANVAISLIDENGQSYIYGYVPIVVAKCGVFLKETVPGIFRLSGSEKRIKDLKTIFDSPDRYGKGLDWEGYNVHDAANVLRRYLNDLPEPVVPLDLYEKFRDPLRGATKQAVGDAEGPQFVENFDEKAAIEKYQHLITELPPLNRQLLLYILDLLAVFAAKSDENLMTSHNLAAIFQPGMLSHPVHAMAPEEYRLNQCVLIFLIENQDHFLIGMQGTAADEKTKNDIERGTPVITAPLTPTANRKSGLGRSASNASAGADSVLREGKIRRHRSVSSRNSKHEGDVTPNSPAPTATPTSGGLGRSNTVPSKRSPALIGGKFKNASPGHHSPSYLEPVAQDLLEEVATPPEQLSPVPAASVSALSVANNPSSNARSHERLLDIPQDGFLTPTKERVNLAGIFQRSPTESSEKRQPRKLQKKKLPGSLNASAQSSTASLGQQYPAVSPAHELAISPLDQVQPVATIPEQPYNNEEQLTSQQVQAYSPHTIDQSAELTPRASHVPSNNSLRPEAVLRGKKSPPPSLHSSFNDGSDLEHTMDETVDLTGGEPEEKERKRRWRISRRKGDGGSPEVRPSGEIGLNQAADISSTSIGSSANKPGKSFTNESSDHTLSGTEGPEGSKDGRDESRGIFGRIRDKYREAKERTKSPPANDGHGSGFLHGGKSLETKRDPAEEPQHATSSPPQPAVAQETGPATTTAQAPTTSDQPVATVDEVEKPRQ

SEQ ID NO: 1724 - protein, 524 aa, Unknown
  Kingdom: Fungi, Phylum: Ascomycota
MEKFPDLDAPLPRSNDPSPTRSNGSASRGMRRDASQGRGVRWLAASRSGPGAGSRHTRQKSLGDAFRTIRSRNGSVSQNAHEIADALRAPLSPKLIILCVAWYTSSALTNTTSKSILNAFDKPATLTLIQFAFVSSLCVLMAWLATVFPILRSKISALKYPIRTPTRDVIMTTLPLAAFQIGGHLLSSTATAKIPVSLVHTIKGLSPLFTVSAYRFIYDIRYPRATYYSLIPLTAGVMLACSGKSGVGGQLLGVIEAFLATIIFVTQNIFSKKLFNEAAKAEADHAMGGAQSKKLDKLNLLCYSSGMAFVLTLPIWFWSEGIGLMTEFFQDGFVDLSNKPNAMDHGRLTVEFIFNGVCHFGQNILAFILLSMVSPVTYSVASLIKRVFVIVMAIIWFRNPTTKLQAVGIALTFLGLYLYDRTSESNKADRKARMMAQTPGAVPLLPVSSEHGGRSTVTTPLGPSPAGRPYTEGYFSSANGTYDSKKTDESTLMGNRGPSGDTKWYPPGTKQEDTWRANGHPSSS

SEQ ID NO: 1725 - protein, 1108 aa, Unknown
  Kingdom: Fungi, Phylum: Ascomycota
MAEGNEETAQPADPKIGERIRWGNDEESGRIPHRLEGRRSRSRSRSADSLAIQRVRTRSRSRSRANPSHVLPTAYRTVSFNIEESKGKEQAERVKAKDAATKELIDLEWHTISVADVEQRLTTSTRDGLSAQQSERRLKEYGRNAPSPPKTHWFRTIFLYFFGGFGGILLIGSILVFVSWKPLGQPPAVANLALAIVLLCVFFIQALFNMFQDWSTSRTMSSIKNMLPEEGNVIRDGQLVHLNAAEIVPGDVVEIRAGNRLPADIRLIQASSDVKFDRSVLTGESKPIAGTVDHTDTNYLETHNIGLQGTHCILGSCKGIVVATGDKTVFGRIATLTNEPKVKMTTLEKEVFNFVIVIASIMLVMIVAVCAIWAGFLKKDHPDYINVPTLIVNCVSVAIAFIPEGLPIAITAGLTITANLMKKNQVLCKSLKTVETLGAVSVICSDKTGTLTTGIMTVSGCVIANSKMSSEDACKKFTQAAGATHPMAQLRAMAALCNASEFDVATADAPLAQKRIFGDATDQAILRFAELVDTGSVSYLRACWRKTYELAFNSKNKFMVRCFSISKPEAIPTVLSKGSLFEPTDILMTVKGAPDVLLGKCSHYLAEHDEVMPLNASMRATIEQHKDAYSSEGKRCLVLARKIIKGANVPNGTETPEFEAAMAKEHRDGLTLVGLVAIADPLREEIPDVVGTLRGAHIRIAMVTGDFALTALAIAREARIVTAAVVDDVKALDRDFNDEDSKGHVTEKVQAMAQSKALVISGPELLTLNDNQWQQLTTYEEIVFARTTPEQKLRIVREFQRNDVVAMTGDGVNDAPSLKAADVGISMGSGSDVAMEAADMVLLDSFSSIVVAVQYGRTVFDNLKKVIAYLLPAGSFSEFWPVMAFVAFGLPQALSSFLMIIICCFTDCAAATMLTYEKPEADVLTRPPRNVKKDRLVNWQLIFQSYGIVGMLQTTASFAMAFWYLERQGIPFSQLWFSFGKIPDGIDADYFLQKTNEASSVYFVNLVVMQWFNLMATRTRYLSIFQHPPLFNRETQNWYLFPAIVFSLVMAIFWLYIPPLQPVLGTTSVPVEHWFLPMAFGAAQLLLDEGRKYCVRRWPKGLLARMAW

SEQ ID NO: 1726 - protein, 252 aa, Unknown
  Kingdom: Fungi, Phylum: Ascomycota
MAIPMHRTGGRAFRRGDDDDVEREYDRLRDLARAEAQKRNSCFERSQEAYKSGDGAAAKQLSNQGKAHDAKMDDYNRQASEYIFRENNAPGRLDEDEIDLHGQFVEEAERILEQRIRADQSRGVTYLYAIVGKGHHSTGGVQKIKPKVEELCQELGLRYHTDEENEGRIYINLQGGEPPQAKPSHGGYQQHQGGYQQGHHQQQGQHGYQGGQQQHQEQQQQQQQGNDELADAVKQNLPRILRFMEKHCCVVM

SEQ ID NO: 1727 - protein, 192 aa, Unknown
  Kingdom: Fungi, Phylum: Ascomycota
MPVADCEVGSSQQRSPAQAPASPPRLPLQQQPRTCAGGRMIPTATEAAQTLRFARPTSGLSRLDRFRAIKIPGTAVAMADVEMSDAPVSAKKAEGKKKFEVKKVGLHTPAWNAVALWAWDIVVDNCAICRNHIMDLCIECQANQASATSEECTVAWGICNHAFHFHCISRWLKARSVCPLDNRDWEFQKYGR

SEQ ID NO: 1728 - protein, 239 aa, Unknown
  Kingdom: Fungi, Phylum: Ascomycota
MSTPFYTSFSPPPTSSRPQPSTSKPPPRSSSSAPAMSFEAVMPPYNASDPAATFLASSCLDFLLIELVPLAKRVTAERDSEALLAEKDGAGAGAGEVGGTVDDEEADAVHHRLEMQGYRVGQGLVERFSRDRPRFNDTLDVIKFLCKDLWSLVFGKNIDNLKTNHRGVYVLTDNHFRPFARMSTEAGGQAIVRAQPFLSFPCGIVRGALAALGIVATVQAEINELPGAVFQIKTVPVKS

SEQ ID NO: 1729 - protein, 339 aa, Unknown
  Kingdom: Fungi, Phylum: Ascomycota
IHVSPCPPLRAPELLSVLYANTGRRRNIYVWEKSVMLHVRYHKSQEMTEQPADNIRFLPRAVGDLLLTYLAVVQPLRQTFLRQSKPGALLSPYLWATLGGEVWSDRRVTACLKRACARAETRRLTVAWWRQAAASITKAKLSASQRANFNIHDMEGPEEIEEEVDVVSLAVASNHSVGTFNTAYGGTTTLVMNMPLNRAYRASEIWRNVLGVDQALRGKRPRVPAGDDDPYARGGILNACKKVQLRKRPALKRGGLVAVARRLYNDPALQLRRPGQEKAMLAVLAPRPAEQVVVVLGTGSGKSLLFMVAAAMDGAGTTVLVLPAVALRTNMLDRLDKAG

SEQ ID NO: 1730 - protein, 638 aa, Unknown
  Kingdom: Fungi, Phylum: Ascomycota
MEDQQTATASTGSDAASKGDEASLEKIKTLLKAKDDTQRFVGLALLKSVLDNTSSLREEHNGVIQELWASIPVKFLDRLLRTGSNPSNPNAKDMLDLSISVLHTFAALLPDEARSRTRLTERIPLLVSSALHTSPESTELLLQLLQTLVSSQAGANVFVGLEDISPLTEIAPSYAAAMDVLHFAWLNAMGNQEVRTSLRAQIDTGVQSLASSFRSTDATTFLSFVGLFFRQAAPEILPSNPKWLSSAVSFIQNLVVSRPNAKARAAYTNAAAALLQSYPDQVPKLLFTDDRTEEKPFGYLFVNLLLIDIRSSAPTLLQQLNQPEYAQLSRRLASSFDTISIFVGFLVRSLEDESLETMVMAPDSLLKLRKGISETMSVTVEYLRDRWDASVAGAMGLHPDARTGTAETFAGSHFTLAWDSMKDNADEDPLIQSAVRALALWLREDDNEMLRKEATGLTDMFLDLYRSHESHKLDFRSPVLVAFEALMSLNKGRTLFLQQGGWAVLAKDLGAILQAATTGNDEAEASRGLEIVRVLLAALENADTANTTDEQLDLITTVSAWSYENKEQPPIVKEFEVAVMMLCCTILAGAAPGVRKRYVHSIHALRGIATELRQMVTYDQALVEDVADVLSTLKTLTS

SEQ ID NO: 1731 - protein, 154 aa, Unknown
  Kingdom: Fungi, Phylum: Ascomycota
  misc_feature (84)..(85): Xaa can be any naturally occurring amino acid
  misc_feature (104)..(104): Xaa can be any naturally occurring amino acid
MAPRASIPLLYRLSLLYFEPVFALSGAFILYFCPATFFTTMTPSPPPTGSLGSVRVLTDQLAAMQILLAFNTGIVLRFAVAGDXXRRRETRLWRVCCAGMLICXCSTHHGDCKGVGVGGFGRAGEMEGRGLGEFRNPGVDGGSEAGGGARDWDG

SEQ ID NO: 1732 - protein, 945 aa, Unknown
  Kingdom: Fungi, Phylum: Ascomycota
  misc_feature (49)..(52): Xaa can be any naturally occurring amino acid
MASKYKDKDGGIVLSFNAQWVSWAHTIIAYTAFLSALVVGISLHYHKIXXXXIGDRFPERSFFMIFIAITSGPRFALVGLWYVLTRKPGQKLPGFVASMGILRTLTCGGWTYITSTDNHDWHDILMISYIVATLPWTLGCIALSPPNPQAIKYRKLLAGLFFGTLVPLIYFFIQHKVHRVAGAYTTYAFFEWALILFDVGFDAVTTFDFDTFEVMVKDVKGTSKGANWSSTPSAVLEKEKRKATGGVASLRFTWSEALDTAADVYQGFVFWSMLTSLGLVVWYFPLWFMGISGFEAFIMCTVTPFLLGIGPLRSLVVNHLRVVHLLSLVGVASYQLTSMIPRLCAVGFGLGMACLGWAATLSSSRSQDVRFESKVLGLMLGLILSSTAKFAWKTNNPIWPIMHAENGGWNGTGLIIGVLAALRFTRLAPLTGGSLSTEKQSGSAALAACGLGGLFFGLHSLLSDSSTMILWVWEGYPIRGPYSSTHGWMTIAAMTAGVFVGLWRPNLAGSWPLFVMGSVGAMVVTFFSHWFGYYGALAIAFYLCAASTPLLANATKKSPAVTFGLGFLMYNLMVLFHVWVVAYAFVPGGPLVREHTDWVMITMMLLLGAGVFDLNASKPRREAPRRQSNSQHRKYFAVSALVINVLFLCSAFMRFPTNDYQPYHPEDRVLTAGIWTIHFSLDNDMWSSEYRMRDLIKEMELDVVGLLESDQQRIIMGNRDSTQLLAEELGMYVDYGPGPNKHTWGAALLSKFPIMNSTHHLLPSPVGELAPAIHATLDVYGQLVDVFVFHSGQEEDPEDRRLQSLYLSELMGSTDRPAFLLSYLVTKPLQGNYNTYVSAKSGMHDVDPTDWDRWCEYILFKNIKRVGYARVSRSTITDTELQVAKFVVPKTPTEAQQMEAISNDDRYRRVEESAVPEGWRFPAMFRGEGVRGHRYHVFDEPRYFN

SEQ ID NO: 1733 - protein, 1044 aa, Unknown
  Kingdom: Fungi, Phylum: Ascomycota
MFGTSATPEKAVSPSGNEILSRAAHALAAQDVVRELGSDEKSGLTEEEAAERLSKFGPNEFGEEKAIQPLKILIGQLFNAMTVVLALALAASFAIRAWVEGGVLAALILIDIVIGFFQDLQAARIVASLESLHSPTAHIRRSGLYETREATTIVPGDIIEFKTGDKIPADARLVDSVVLETDEALLTGESLPVPKNHSAILNDPNISPGDRMNVVFSSTVVTKGRGRAVVFATGCFTEIGLIAAALRMNQVESHEDELRPGYGNKAHLFVHAKRSLFKVWRAIGKFLGLTVGTPLQRQLSKLFLYVFAFAIICAIIVLAANKFDGRSDVIIYAIAVAVGTLPATLVLVLTVTMAVGTRVMMQRHVAVRNMRSLEALGGVTNICSDKTGTLTQGRMVTKSAWLPGHGTYFVDSGDQPYNPDLGQLKLAAGQPSDHNDTADFCLTEKLQSGGLCHFLNIAALANNASLEQSDEDTIESWKAKGDPTEIAILVFAFRFGHRNNSALPMLEWEKIAEFPFDSTVKLMSVVCKYRESGELQLFTKGATERVVERCSTISGDDDRTEDMNGKTKLAIKSNAKALAQQGLRVLALASKPVPSWSQDDPEKPALPRDRVECGLIFRGLIGIYDPPRPESKPSVVKCHRAGIQVHMLTGDHIDTASAIATEVGILPHRLDVLSADAARTTVMAAQDFDKLSDENVDKLAELPLVVARCTPKTKVRMVDALHRRGRYVAMTGDGVNDSPSLQRSDIGIAMGLNGSDVAKSASDIILMDDNFASILNAVEEGRRIFDNVQKFMLHVLAANVGLVITLLVGLAFRDGDDLSVFPLSPVEILFMMLVAGAFTENGLGFEAASPDILRRPPQNLKHGMLPPEFLADLAVYGLVMAVCLLGSFVIVLYGLYGGQLGDDCNIEYSQQCDAAFRARSTCYVIMMWIFLFFAWELIDTRRSFFYGVVKDNKAWRQRLTNNKPLFWSVVIGFIVVFPTIYIPGLNHDAFLHGAIDKEWGIVFALLFFFLCSCEVWKWQKRAFLRRRHLLAKTEEEVADRDVEQ

SEQ ID NO: 1734 - protein, 534 aa, Unknown
  Kingdom: Fungi, Phylum: Ascomycota
MAGLPSYEEATARPDWLVLVAPHFWRTFAPRLWENPLKAVRLAGLDPSDDINWWFEFVFNKLSTVRPGVRSLVRVLDATHFAKQSYNFASDRHDQNMQLSFAKALKLLPNSECILLDGHTDLDLRFLIGERSADSQYSPLLLSIPDCPFELPGNFFASPLLSRLVYLDLSAIPGSVRSILRSGLLPDLRILKLRNRELDDASFTSLVQLYGMRLWSLDISSNRVTDQVVHVVRDTCFAKTTLRNGGYFYTEGKLVDLEGGTDGFGPFVEVQESQWSQSYNHPERYFIDPPAYLADEQSGVQEYHVFRADGKERAREDSAGDIVEWLSRQEYHLSLAPTLLKGLRHLRLEFEPDPMEEGLSVTGNFDAESLLNSGDQGFSFFQGEQYEKSPVLVRHGEGSRQVENDDLKAVDATEDETIPGREFIPYEVRIHRVREGVGPASPSQIRAGAPTGSYIFHTAWMLAIMPLDLKTPPKRELEAMTDVLDTLKKYRLEARARFDSLKRSATRTTSSQQVKLGEPHFFWTGKLEVSTQQS

SEQ ID NO: 1735 - protein, 223 aa, Unknown
  Kingdom: Fungi, Phylum: Ascomycota
MDFAMQALCAPEDIYDERGESFGSSQRTGSWSSGFSTIAGDRRSISDASNLSHMTSSANSIASEAVTPSPSIPVGEEPPTVTKPKRRRENRYKNAPPAVISRRRAQNRASQRAYRERKDQRIRDLEELLEEAHQKEETLNQAFLTLQAEYDRLVAKSQSQGHAVLLDDSIGGYTEQGSMFASPDLSVHEGPMSGFEFLDGVQNSDMLAGLYLQHDRPTYPPIL

SEQ ID NO: 1736 - protein, 646 aa, Unknown
  Kingdom: Fungi, Phylum: Ascomycota
  misc_feature (12)..(13): Xaa can be any naturally occurring amino acid
MDRISTWFQGSXXVGPGLGASTHAAAFGAGAGTGSGSTSPGSLNSSSLTESPSPQPATPREGQDSMTAAVSDLTTSRPPSSLPIDTTNTTKSDPLPLFTDLPDPNFNLDQRRSAALRSASHIPDSDLNNLAHFDTDFEMTTGASLDAGGAGRGRQDSFVSTGAKPISMNNPNRDNVNRNRRESLAGSLMGGRSWGGLSFGSFVRDDIAMQGTSPFGGVAQSPSFHSSSYLPKLEANFMRDFTCCGQILPNLHDLLQHYEEAHTQASPNTSRTNNSFNQFSQFGMPGPSSMGASRGASAAPGQMPGQPTGGQFGRQHNPSASGMQMLGMAQNLNGGVGQMSAGLGPGPHDEMDAVGDMELDDPVGTMELDDSQKMHQTRQLFGQQQRPQLNMNTSGLTQGLRTSQPTTPGAASFGLQNNPTVSSVNTPTLTTHPDDNDMEADFGGMEMGDGTDLSTMNMGNNGDVSNNGLFIDEPGKHLLSTNGGTFTPTNKTIQQQLAQLGLAPGQNQVTDPEAQKELLARLHSMMMPEEHKPFKCPVIGCEKAYKNQNGLKYHKAHGHQTQQLHENGDGTFSIVNPETSAPYPGTLGMEKEKPFNCETCGKRYKNLNGLKYHKTHSLPCNPDFKRQAIAAGLKLPGIGEDQQMVG

SEQ ID NO: 1737 - protein, 531 aa, Unknown
  Kingdom: Fungi, Phylum: Ascomycota
MDYWIPTTPSVCILLLGGLLISSTYTVRAQEAKRSFPGPTQLPLIGRVHDLPRKATWLKFYEWAAKYGPIYQTSMMGQKFVIVSDEEIARDLLHKRAHQTSGRAQIRALLNHRQDPTYFALQDRQEIWRTQRKWVHAALTTSYQQHFDGHLQDEIRRWLMTLLVDPANFHSNTRELTGRAMARLTWDDATQGRQHADEALETLTNMSIHGSLANTAPFLWHLGDFIGYNPWKKYETEREGKLKEHWLRNFRTARRGYLDGNLADSTWSHRYFDQLSKAGNVTLEQSEKEEEVAACMLGFQCMVGIITVATPLMYLMMALTLHPEWQDKVQEEIEQVCGQRLPGLQDYAQLPTLRACIKEALRWRSSVPLGVPHRCEETMEYEGVLIEKDTIVMSCEWNLNRDPKNFPEPESYLPSRWLSPDFPTYLSPLTRHPNLREGKAMHTFGWGRRVCLGQQLADDELFLAAGAVCWGFRMQPKRNPSTGEEVEIDTMATNSNVILEPLPWQMEFLPRGGRVDAMVKEGDDVREKLGV

SEQ ID NO: 1738 - protein, 323 aa, Unknown
  Kingdom: Fungi, Phylum: Ascomycota
MPQDPNLYGQRPVKKQKRAAALSSSLDFSAQLTSLMSNAGDSGSTSGRPRPSKEPKGDVFRAGKGKRTGAGKDASDSKLVLKDVAGTEEETQELARARRKMEDKARLYAAMKRGDYVPKENEAAPLVDFDRKWAESTEGKDLSDQSSSEEEDYDNGELVEYEDEFGRLRKGTKAEIERMKRRQKRGLLGAEELERMSARPSEPSKLIYGDTVQSLAFAAEDPDKMEELARKRDRSATPPEQKHYDADWEIRTKGTGFFKFSKDEETRTREMEQLAEERKKTEEARKTKETEKEKRRREIEERRKEMAARRAKKQADSFLEGME

SEQ ID NO: 1739 - protein, 577 aa, Unknown
  Kingdom: Fungi, Phylum: Ascomycota
MGQPEAHAPANDAASFGVRQGQDAETASRSDSSGIADHRDPVVEEIQAQRIASYVSGPDDLEAQPTMTNVTSYREPGDEVYGRLSGRRKAIIVAVLSFCAFLSPISSTSILAATPEVAAEYNTTGSIINLSNAGYLAFMALSPLIWGPISQVFGRRPTNLVTAVSFFLLSLATALAPDLGSFFVFRASSALVGASFILVGSACIGDIYKPVERGTAIGWFLSGTLIGPAFGPFIGGIIVTFSDWRTIFWLQTALTGAGLLMTFFLVPETIHHRKIEDLAHCSRQEKTWAIMRMLNPLRVLFLFQNPSLIMAAGASSALVWNMYSLLTPIRYVLNPRFKLETPMLGGLFYLAPGLGYLLGTFGGGRWADRTVKRWIKKRDGIRVPEDRLRSCLPFLGIAMPGCVLVYGWSVDQAVGGIPLPVIAMFLQGVAQLFCFPSINTYCLDVMPGKGAEVAAANFFVRYLAGVLGTAVVLPAIEGVGVGWFSTLSAGLLALSAVGLLGAIRYGQGWQKKVKDKERAKRAAKRTVETRVEGNQATGAQPKESKEAIPKDATAREMSESQANDTGIGGSKASKRRS

SEQ ID NO: 1740 - protein, 418 aa, Unknown
  Kingdom: Fungi, Phylum: Ascomycota
MPTSATLTPLNPFNPDLRERAWCSSPHPTLPLLATAHAKSVTVFSLSSLSIHSTLTGGHSRSVRSVAWKPGLPSGKLCLVTGSFDSTAGIWRYEGEDPEVEGGKGMEVEITAKGVKGGDEDGSDAGDKDWEFTLVLEGHDSEIKSCAFSPAGSHLATCSRDKSLWIWEDIGATEADDEWETIAVLSEHDGDVKSVAWCPDVPGRNQRRSYGSDVLASASYDDTVRIWREDSDGEWVCVAVLEGHGATVWGAQWEGKPRPGDRFPRLMTFSADGTIRVWELKEAEKEEGASMQFGGIPNTMRTSLKEEWNCVATLPKVHEKDIYSVTWSAETGMVASTGSDGTIALYSEGADGEGDRAMENGGWRLLTKMENAHGPYEVNHVTWCKRFDAGAGDRKGLEEMLVSTGDDGVVRPWAVATA

SEQ ID NO: 1741 - protein, 1020 aa, Unknown
  Kingdom: Fungi, Phylum: Ascomycota
  misc_feature (394)..(401): Xaa can be any naturally occurring amino acid
  misc_feature (778)..(782): Xaa can be any naturally occurring amino acid
MAVMSTSANGSQVQHPIHLLEQRARTGHVRPFAVIPKSKNLSEGFTDVTYELLANAVNRACWWLEDLTGGPKPGTRFSWSGPNDLRYILLLLAAMKCRYQAGCPQRSRPTDRSGTNRKSQILLPSPRNSEEYQRAIFDAAGVKFALGTKATLARLRAPLDGLSIELVEGLSLEQLLSEESVPAYPFDFTFDQVKQETPLILHTSGSTGPPKPIPLPLEGLTTIALTDLVPGPRQRKMQALLEHNKLFCGFPPFHAAGCLTYGMYPILCDFSVVWGPSDRPLNAALAEEAIKVSGAECTLLPPSVLEDMAKTPSGLGLLSTLKFAVYGGGPLHPDIGPKIANVTRLHTLWGSTETLLVPVLIPDGDEWNYIELDPQVGYTFEHVQENLYQFNIKXXXXXXXXMVYRRSGLSPPNKAEPVFNPAPGEAVIRTSPLVSTCILVGRARPQAILLVERNAETTKDMTTQQVKDALWPVVEEMNKIMATQGQITPDHIVVAPLGTEFPRTPKGTVRRKQTEEMFERDLDEVSALKRTDDREHTRNGHGHSNGNGHVDEDQPTDIAQAVRRAVYHVCRISDIGDDEDLFEYGLDSIQAQQISAALGKISDLWPEDSTTGTGIIYSKPTIRGLIETVAPDNGQQNGDGGNDVEALIGKYTSDLPKPLAPHEPAHGMTVAITGSTGNLGCHMLNDLIRHPDVTEIICLNRAAGGKEAQDAAFSRSKLTQAPLGDTVLSHFKVDLSDNFLGLTPIQYATLQRKVDVLIHNAWQLDFLRTVKAFEKTHXXXXXIVFISSIGTIGGTDPKVMQTVPEEILGPKVVPGGNGYSQSKYVSEKILVEAAATSKVKSAIVRVGQIAGPIGDAKGTWSTTDWFPRMMASAKVMRSVPDSLGIGNAVDWVPVNTVSQVVTDIVDATKKSEAELNVFHINNPHTIPWSELAPEVARSMGKDVRLISLKEWIAELRSAIQEKGAGVLPVEALLPWLEGISDVGETATLAVDKTVSLSPALAAPGRIQLPWIERWMQDWVL

SEQ ID NO: 1742 - protein, 188 aa, Unknown
  Kingdom: Fungi, Phylum: Ascomycota
MAATSTMSGTDYTYERRSAHVRTYNWPPFYLNLWIFTMLLASGSIMGVFSIFIQTQEQLNLGIPWYFPYFIAVSAHTILFIFGLFWLIYNRRLLPAIVMIGAFMLFVLWMVGLVATSVELWGPAGSVNGVCNMQVYSKNPTGPTEATLAWMQQKNICDSWRLVFAMALLGVVFLVWIMIMSYQVFVMS

SEQ ID NO: 1743 - protein, 327 aa, Unknown
  Kingdom: Fungi, Phylum: Ascomycota
MADLPTTFDKPVHIAIIGGTGLGQLEGFTPVAAVTPVTPWGKPASPISILSHKNTYVAFLARHGLHHEFAPHEVPNRANIAALRSLGVRCVIAFTAVGSLREEIKPMDFVVPDQVIDRTKGVRPFTFFEGGVVGHVGFADPFDSGLAEVVKKCAASLEGDGVVLHDKGTVICMELGHIVRGLRVGEQQADRRTEGPQFSTRAESHMYRSWGGSVINMSALPEAKLAREAEFAYQSICMATDYDCWHSFEDVNVEMVGRYMQANGKNARRLVAAVLDKLAEAEHSDLVMAKHWEGVTQGGVKWMTKKEGRNEEAMKRVEYLFPGFWED

SEQ ID NO: 1744 - protein, 471 aa, Unknown
  Kingdom: Fungi, Phylum: Ascomycota
MSSNRKRPRHDSEAGLHPLDDVHLDHVTTTSSEADLLESRERLFRNLYRRAPDFKTIAQLDPDFAVHVKGRDLDFNDPAAVMQLTKTLLKLDFDLGIELPDDRLCPPVPNRHNYILWLKDLLDSTVSEDQNYRAVGIDIGTGASCIYPLLGCAQRPWSFIATDIDSESLSYAQRNVHMNSLEHRIKVVARQPTDSLIPTEHLPETLDFTMTNPPFYSSPDELLTSAAKKSLAPSTACTGAPVEMVTSGGEVGFVSRIIDESLVLRERVAWYTAMVGFLSSLTTLVDRLKKEGISNYAVTEFIQGSKTRRWAVAWSFGKNRPAEKVARGVAAAAVPKSVLPPSTEIKLLESIPPDELGSFVEGLLAKITELDLSRWDWNKQALRGTGKAPDKVWGRAWRRMKKRQEEGQQQSSEVIDADYEKKSLGFKIAVRVQRDDVAIHCRWTEGQDATVFESFTGFLKATIESIRSNQK

SEQ ID NO: 1745 - protein, 627 aa, Unknown
  Kingdom: Fungi, Phylum: Ascomycota
MTTVRICVCGDESTGKSSLIAALVKDQFISSKIQPVLPQITIPPSIGTPENVTTAIVDTSARPQDRTTLRKEIRKSNVILLVYADHYSYERVALFWMPYFRSLGVNVPVVLCANKADLAGQGTTPQVVEEEMLPVMAEFREIDSCIRTSAREHRNVNEVFFLCQKAVTHPIAPLFDYKEGRLKPACVDALKRVFFLCDKDQDGYLNDEEMREFQARCFDKPLTKDDLDNIKASISKSHTGSDLDKGIDQRGFLQLNKIYAEKGRHETIWIILRKYHYTDSLSLEDKFLHPKLDVPEYCSAELSPAGYRFFVDLFLLFDKDNDGGLNDEELDALFAPTPGLPAFWVDSSFPSSTVRNEAGHVTLQGWLAQWSMTTFLEPKTTIEYLAYLGFEPPNPKDAITSAIKITKSRKRRRRPGRVERNVVLCYMLGGAGAGKSSLLDAFLNRPFEPLHRPTIKPRRAVNSVELPGGRQVYLILEELGELEPAILENQAKLDACDLICYTYDSSEPDSFSHIVDLRAKHPQLDDLPAIYTALKADKDKTNQRSELQPDEYTSSLNMSHPLHVSVTWNSISELFVALAEAATNPSTAFPKSEEDAPDRTGLYMALGATACAAVAAIMIWRRSTSSP

SEQ ID NO: 1746 - protein, 179 aa, Unknown
  Kingdom: Fungi, Phylum: Ascomycota
MIMLSTQDLEHLRSCVALAREAVSTGDAPFGSVLVNTSTNTILARDRNRTVSGSSPLLHGSPPGPDPTLHPEFTIARWAGLNLSPEERAVCTVYTSGEHCAMCSAAHAYVGLGRIVFASSTVQLGQWMEELGENKKRALRPLSINDVAPGVEVQGPVEEFADEIRDLHRQHRDSREKAS

SEQ ID NO: 1747 - protein, 360 aa, Unknown
  Kingdom: Fungi, Phylum: Ascomycota
MVKSKRARDAAESVAEPTHTEQANGSSATQDNKVKKRKRDVQEDPTEEDPVAGETKRSKKEKKDKKDKKDKKSKKHDKESRKEKKEKRKDLQDLPEEVVEDAADEDEAPLKAEAKVSNGTDGDAEAKRKEEKRARKQAKREEKKQRQQQAEQSTVDSTQKSNDKSAASATASSSTGQAGDNDKSEEDPIDLNDSSANGKKDRHIVFVGNLPFSATAASISAHFASLSPVAVRCLRNRDDPNPCRGIAFVEFSKVWHQRTCLDKFHHSTFDDGVSPPRKINVELTHSSALQDDTAGGGGKTRQRQEKIKEKNKKLDENRAKRIEREKVAKQEGSGADTNKGSHQEDSIHPSRRGRVPGTGW

SEQ ID NO: 1748 - protein, 188 aa, Unknown
  Kingdom: Fungi, Phylum: Ascomycota
MIASRVGVAALARGAARPSMMLNQNIARALTAGIQTSSSARQVATTKVGQEEGHQILVNQRLNRPVSPHLGIYKLSQSWFSASAWTRITGCFLSGGAYLYFTGYLAAPLLGWHLESASLASAFAAMPWVVNGGVKFLLSFPFVFHFINGVKHLVYDAGIGFKKASILAGEKLLWVSSVLGSLYLAFGL

SEQ ID NO: 1749 - protein, 236 aa, Unknown
  Kingdom: Fungi, Phylum: Ascomycota
MNEKNSTAETAVLATTSVPPVSRDCDDASDALPQIDADTIVSQRLKPSRNWTAHQIFYVFILDGLGGMILSAGVNFALAYVMYTARAAPRTPVKLFALPNTLAGDAAVTIIVQCILTWFVELGLVRFDLRNRSVQPIGFVPRPKTPWLRWLFFLPAHDGEQSLPPRTMQLKAVLPEALRGFMLAFLGFMFLWPIGVGALTALGTKQEGSLDYLYDDKVVHYTVDGFVLVGQSRMGG

SEQ ID NO: 1750 - protein, 833 aa, Unknown
  Kingdom: Fungi, Phylum: Ascomycota
MASAANMLSLPFRRSNQISLASTIRQYINSKYDQHPDMFRQDLDVIDALRRDAVNVREPHPTGVAKLQTYAGQLVWIGGKFPIDVGLPIGAEFSWYPVLGYSTERPLVRNNLKFELMNVLYNLAALYSQLAINTPTGSTDGLKTAANFFSLAAGVLAHIKTSILPELRMSDPPEDMDAETLESLTQLMLAQSQECFWQKAVMDGYKDASIAKLAARVSDLYNSAGEAAVKSDAISTAQYRAACDCLEKRKYGEEVARLKDAVACVTEGLRETRSGYLSKTVADDLNFLKKKVEEDLKRAEKDNDMIYLNTVPPKSELKILDRANMAVARTPPQVANPYDFFGDQAEFGPALFSRLVPFSVHVATTIYEGRRDQLVNRSIIPGLETLNEQMHSLLSSLDLPGSLQALEKPMGIPPSLQQHAEELRQADAVARVHKTFADIEKLRAADMAIFEEGKSMLLSEEEEDQRLRAKYGTDRWLRPESRNDSEGSSLWGLVSQFETWFAQSVTSDANVRKKFAAIEDVLEILCGPTRGLTEYIPSSSSREMAEELKPVVGRLRSAYSDVLRLESRRRKKVEALRETARRDDIKPDILKEAARLERTFPNTALDAAHFEEFFDKRLDRLYEPEQEALDKEAEDQDKLLSEVERVNKEFESQKQRLGNRSNRAREQALQKLDDAYFKYKETVNNLEEGRNFYNQLNQHVGQQFRDVVKGWVAKRRMEARTISEELDMPSLGNLALSHQQSRTPPITNYAGQPPNAAVHRPAVHSPAEASIRSWADGGDAVQQPQPMLPPANPMGGVWDPSMGIKFGGGGPATGGSVAQAPGTWKPGSGIKFG

SEQ ID NO: 1751 - protein, 146 aa, Unknown
  Kingdom: Fungi, Phylum: Ascomycota
MSGLDAEEISKAYDAVRSDKDETNWLLISYAAATGNKLTLSQTGTGGISELAAALDDTQVQYGYVRVEYANDKESTRVKFVLVVWLGESAKVMRKARVSVESGDVKRVLSHHSIAVTVGDKSELDEDDIVKKLRKAGGADYNGGRG

SEQ ID NO: 1752 - protein, 526 aa, Unknown
  Kingdom: Fungi, Phylum: Ascomycota
MTKTQAAAPSVGIHGHLTPEGWTSWLSNKGIVKLNAILCLSLISSYATGYDGSMMNGLQSLDQWKLSFNNPDANTLAILNAIQNIGQLAALPFCAIFCDKFGRRPALIVSAAIMLLGVGLQGGARDTGMFIAARGVLGFGLALNITAAPLLIMELAYPTQRAPMVSIYNTLWGLGALTAAWITYGTFRIPSTWAWRIPSILQALSSFLQICLCWLIDESPRWLIANERDAEAEALLIKYHANGDASDPLVLVEMEEIRTAIRMENEAMKTTSYLSFFKTAGNRRRFFIILAVGFFSQWSGNGLISYYLTLILNSIGYRSEATQTLINALLTLWSMIWGLVFSVVVNRIPRRTMFLASTIGSLICYIVWTALEATYEKSTNLNDDGTGGPKGVAKGVLAMIFLFNLFFTAGWGVLQVTYVVEILPFNLRARGLVLYNLFVACALIFNQYANPIGVTNSGWKYYITYDVWLAFEAVVVYFLFVETGNLSLEETALVLDGHEAGDQLVGEVMRNTDKVIEVPVHQKGDA

SEQ ID NO: 1753 - protein, 293 aa, Unknown
  Kingdom: Fungi, Phylum: Ascomycota
MVPSPGLDSWWWRFIENYVYRVPEPPPRTRTTPMQVICVGPPRSGTESLQQALLALGYDYTYHGWDIMFETPHRMPTWARLCRKKWYGAADGEADLTAVDFDAVLGHAAAVTDAAASVFAAELIAAYPEAKVVLNTRADLDEWYRSVDKTIVGVNDSWVFWLTGLFNREAFWAWHVAERLMWALLFRAPDGNMATAIRRNGKWIYREHCNMIRGLVPKDRLLEWNVGDGWEPLCKFLDKPVPDMDFPHANAMGTGWKQREDQVTKLWVGKAFRNMAVIFGTIVGIGAVCYKYL

SEQ ID NO: 1754 - protein, 1051 aa, Unknown
  Kingdom: Fungi, Phylum: Ascomycota
  misc_feature (889)..(899): Xaa can be any naturally occurring amino acid
MASSSTGIGFPSWRRRASSLDIRREDESIDGASGSSPAAASEMPVSSSRRLSSSFTSAPTHREPIRSFIHGSVRDQLVPVDSEANAQSVREDTAELASYLLADQQDRRNSFFLHKSRNSVQDALSSDGEGDDSTGYEQPSSTTEAILEVSEPPSPEPLAGDGEDGPSVIANLLRKSPPESAAEDSAVESGDDDGDIETVRVDSRRRKHSVTSERHSVSENTPLLYRTASHPEGRDLEEQKPKARRAWLQAMVQGTHDVKDRVAQTVVVAVDPRRWDRKLIWQRAVLTPASCLPSVAVGLLLNILDALSYGMILFPLGKPIFQNLGSAGISIFYVSTIVSQLTFSSGSIFKGAVGSELIEVVPFFHNMAERITDAVGAENPDAVIATTIVSYAISSMITGAVFYLMGRFKFGYMVGFIPRHILIGCIGGVGWFLVATGFEVSARLEGSLKYDLDTLHKLAQPDTVPLWIVPLVLAILLFWGQAKVASKYFLPLYILAIPMIFYFLVLCIDALHVDTLRDNGWIFEGPPAGEPWWYFYTLYKFKLVRWDAVAECIPAMLALTFFGILHVPINVPALALNCGEDNADLDKELRLHGYSNFLSGCLGSIQNYLVYANTVFFMRSGGDSRLAGYMLAALTFGVMCVGPSLIGFIPVMMVATLIYDLGFELLLEAVWLPRKKLKLAEYLTVIVIVLVMGIHDFVIGIGVGILLAFISLIVQTSRISAIRGTFSGDIVTSTVRRNPSQHHYLQNVGQQIFIIKLTGYLFFGTIVSVEEKIRALLEDNAFTKKPIKFLILDLWRVSDLDYSAGEAFNTISRLLDNKGVVFVLSGVEPGSQLGRNLRAVGLGNNGIEVMMLPDLNSALESCENELLKTLYARQEELNQNKRTATASLXXXXXXXXXXXPPQPPGRSRPRRPDQPRLSDKNEDFWFRATSYFKRREFAAGSVLFRRGERADGFYLLERGILRVEYDLPQGWLCESIVAGTTCGELPFFSETERTATAQVERDCVVWLMDTEGWAKLQKEDPEIAREMLRVSLKLTTERMSAITSYTLTMAG

SEQ ID NO: 1755 - protein, 363 aa, Unknown
  Kingdom: Fungi, Phylum: Ascomycota
MAEVLSPPTYSRERDIAELAVLRACVLTKKVLSTVDEISKSDLTPVTVADFAAQALLISAIEAAFPGHGVLGEEDATELRNDPKLREKVFGLVSSVNLPLVSNGAGPVELASPSSEDEMMDMIDRGGNGKGGREGFYWIMDPVDGTKAFLEGKQYAVSLALMKDGKEVVGVLGCPNLKLQDGRVSETTVDTDGLGVIVTAVKGHGAAIRSVTADGTLSPREVLKTMPPPKSINDLHFVGCTASKALRHDIPEALARKLGTPDPGTNIWSSHMRYASLILGGGDLQVRVPRKNVEPVAVRVWDHAGSQLIFTELGGMVTDLDGREMDFGAGRSFFNNRGMVVAKREIHGEILSLVRELMGEPKL

SEQ ID NO: 1756 - protein, 583 aa, Unknown
  Kingdom: Fungi, Phylum: Ascomycota
MSDATYRTDGALGRLLRLGHKPKQVPAIFIHAGAGFHSHQNEHVHLKACVAAAEMGMRFLKAGATATEAVEASLRVLEDKEITNAGYGSNLSIDGTVECDATIVDHLGRSGACGATPNVRNPISLAKLILDTSNQPLSLRRVPPNALVGEGARIFAEENGMATFDNEYLISKNARDRFLRWQEDLKRADARSKEDKGDLLAVQPGVNDDPCQYDTVPTPDPTRTFPRDNAAALMAGTWNEGQPDSPYAGTPAETPENVTMPGYFRPITSTLTSTSRAPIRAAVDQTVPGTMSTPSSKETPSARLRAHARHIGYSGSGLGKHIPSGRHEPRPRSAKPYEGNRDGSTSPHRSVRGSEREKDSRSPAILAGFKRRRLGHDRSDQDHTSRESMNPAPLDEDHITDTVGAIAIDNKGHIAAASSSGGIGMKHRGRLGPAALVGIGTAVVPCAPDDETGTTVAAVTSGTGEHMATTMASQRCAERVYHGTRKTSDGLDVRDEDEDAILESFVVNDFMGHPGVKNCHSTGAIGVMVVKKTNSGYYFQFAHNTDSFALASMGGREIQATCVMSRMPKGCKIAKGGRKIRLG

SEQ ID NO: 1757 - protein, 315 aa, Unknown
  Kingdom: Fungi, Phylum: Ascomycota
MHYAYPPRKVSKPPVWAKSSSHRQSFYRNRFLRFFAVIVTLALGSYFLLLAKGPGNAYHEEVPTGGPAVVIVTLTDPDSHNSAYLNSIRENREQYAALFGYETFIARVFEYDTGNAPKTWAKLMAIRHAITKYPNCGYVWFLDQNALILNPKMSLEQQILDRGKLAEVMIPETPVVPGSIIRTFGHLQADDAALLISQDKSGLVTDSMIIKNGEWAKFLLEQWLDPLYRSFNFEKAERHALEHAVQWHPTVLAKVALVPQGLLAPYSSDRNGEAVQNEAFVVLFEGCQRQGGQICAQELEKFWPRWNNALGALNQ

SEQ ID NO: 1758 - protein, 432 aa, Unknown
  Kingdom: Fungi, Phylum: Ascomycota
MLNETDRAVLANAYVSGMREDVGLTGNEYNLLVTCLSVGYIVGQVPHGLVIQKVAPRIWFPLMTLLWAGLTMVCAACNTFSQLAAVRFLQGIAEASTYSGTQYIIGSWYKGPEVGKRIGLFQASGMAGTMFAGLLMTAIWKTMNGLAGLPGWRWSFIIDGIITIPVAIFGFAFFPDLPESTKAFYLKPHERELALSRLPPKNPEGHNIGLPLLKKVLFTPNFWIFNIFWMIGGALEAFSTQTCMVLWMRASGEFTVPQNNTYPLGITAIGIVMTLCTSVAIDGTGVHSPYGFFACGAQIISCIILLCWSQVTTGAKMAAYYLAGVAYMIQPVVFTWASKVLSRDGDDAARAITLYAMNGASSVLYAFWGIALYPATDAGTGFWKGTITMVVVSVSLALWICVVWWQDKRTAKDPMVSQYLEEKTAESQIEQA

SEQ ID NO: 1759 - protein, 380 aa, Unknown
  Kingdom: Fungi, Phylum: Ascomycota
MADTLHNVAIVLDNGSGTIRAGFAGEDSPKCYFPSWVGRPKHTRVLAGALEGDYFIGQKAAQELRGLLKIKYPLEHGIVTDWDDMEKIWEHVYVEGLKTLSEEHPVLLTEPPLNPRRNRDTAAQILFETFNVPAIHTSIQAMLSLYASGRTTGIVLDSGDGVSHAVPVYEGFVMPNSIQRIDVAGRDVTEYLQQLLRKSGHVFHTSAEKEVVRQIKESLSYVAPDPRKEEKVWAGGKNIAGKMGEYVLPDGRILKIGSERFRAPEILFNPELIGLEYPGVHQIVVDAITRTDLDLRKSLYSNIVLSGGSTLTKGFGDRLLTELQRLAVKDMRIKIFAPPERKYSTWIGGSILAGLSTFRKMWVSVDDWHENPDIIHTKFA

SEQ ID NO: 1760 - protein, 87 aa, Unknown
  Kingdom: Fungi, Phylum: Ascomycota
MKPLVSAGQAWTCTVISVFAIVILSIIGAMYRKGHEEFVGGIEDPEDGKAVSGTIFTAVIVYVGFLVFCGLQGMLHVRESRRGAIAL

SEQ ID NO: 1761 - protein, 376 aa, Unknown
  Kingdom: Fungi, Phylum: Ascomycota
MHPVLGDYTLLQHTSGPLPPPQPHIAPETPHDPSGHITFHHSPPPPLDLTLPPISLSPPPPSIYLPKTTGNWVRFFLSGFGHSSFSGLLPSPSLLLSPLAVNMLLKASLLVALATQLVGAVAQDAGTTPVDAAHLDADLSATFPDSDIFGVKLVNGHPTKALITLANRESAPVTLAILAGALYSTKELPADAPTYQGILRNLTAAQYNLEVPAGETKEIPYSFSLDMQPQDVLINLMAVVTNSKGNIFSLPVFNGTAAIVEPPTSFFDPQIIFLYLFLTAAFAGILYFVYKTWIEALFPQAKRPKTPRAKSSRKSAAAADLDADAALSGNEAASPSLGASSGVASIDQSWIPEHHLNRPTAKRVKSSASQKKKVVG

SEQ ID NO: 1762 - protein, 494 aa, Unknown
  Kingdom: Fungi, Phylum: Ascomycota
MRRRHGGVRLCFEALYVQPGQDNMYRLRATSIIEDTVISLRSNYQLATAYAQIIAVEQQKLVLCFVTDEQEESQNWEDDFLKDESLAELIDTQSVALRLMAGSEEAGYLAQIFPLPKTPTVVIIKNGELKEYLTSGTSREDFISRVHGAFVKPSQASTTQQTNAATSSTSDQPSTTETEAHAQNRPPPLESHSSNVGRVLAERAARLQKQKEEAEQKAKEERGKAKEKAKADAEAGVNSDGARAHKQAELVKKRRQQELEERKRILQRIEDDREERRMRAEARGKARLEDQKVGDVAAALVNAPESKMPSTTRVGEMTAIQVRLFDGATLRSRFKTRSTVRELRQWVDENRSDGTEAYRFKQVLTPLPNKNIDETEEGKDLGELGLAPSSTLVLVPIQKSASAYADGTPGGLMGSIYGLLVGFFSWILTLLGLSGGAGPSRGDDQQTSGMSSAQDAERRRMREMQDSAVRRRNQQLYNGNSTNFEPRPDEEDES

SEQ ID NO: 1763 - protein, 414 aa, Unknown
  Kingdom: Fungi, Phylum: Ascomycota
MFFDEVQGGPPDVMYDLKVRADRDAHAEKVDLGVGIYRNGEGLYQELDCIKEAKRVLAKNDPGHDYEVTVGNAEFLDIASKVMFGDDCQRLNSKQIASVQSISGTGAVHLAALFISRCIAPCPEIYVGSPTWGNYKPAFNLVGLDIQEYSYYNRKEQAFDLSSSLDAISTAPPSSVFIFQGCCHNPTAQDPTTAQWDELILALQAGKHLPVFDIAYQGLGNGLDRDAYAIRQCAHLGLEMLVCQSFSKNFALYGERCGALHVACGDADAAARVKDRIRSLIRWEFSSSPAYGSRLVRSVLKSPDLTDAWATQLSEMRQRLGSLRQRLFMQLTEVLKTPGDWKHITDELGLFSYLQLSPEQCEELVDTHHVHMPKNGRINVSGLNERNIERVARAIDEVVRKARVGEGVVDQGSM

SEQ ID NO: 1764 - protein, 487 aa, Unknown
  Kingdom: Fungi, Phylum: Ascomycota
MASTTLTPEAILTQLFHSLSLPVPSPPFTLTPSSKPLPLPSSYNLPLLITTTTLLSSLTPALLLAHRNSLSSPPQVTLDPLHAAALYSSERLYTLNDKPSVTDRILIGGLHPTGGNGHVRIHDGFPNHRSGALKLLGLPETATREDVTAACLTYPSSLALETAAHEAGLPIYALRSPAEWASHPQSSHTSSNPIILTALPSSSTAIPPPLPPADRCLSGIRILDLSRVIAAPSAGKHLASHGADILWITSPNLPDLPVLDVEFSRGKRSISLDLTDAKDKATLFDLVKSCDVFLQSYRPGSLAAKGFSPKELVKINPNIIYATLSAFGPDGPWAENRGFDSLVQTCTGMNHSEAEASGTGQPALPLPCQALDHGAGHLLAAGICAALYHRATKGGAYKVEVSLAATQKFLESMGRIPGVQGFKVEKAEGQTSFPDEFFEERELQDELGRMRYVKAAGTIEAAEVGWERMPGKLGRDRPEWLPRPGEA

SEQ ID NO: 1765 - protein, 643 aa, Unknown
  Kingdom: Fungi, Phylum: Ascomycota
  misc_feature (409)..(417): Xaa can be any naturally occurring amino acid
MKFSSITAAGAVFGLAAATPITKRSSIFKREVPQEQSHGFILAIADEFMKLENTLNIQDAVFGLLGNAAAKEGAGDVTNLDCLKQATADQAFTNAKAAGDLRGMAGALMFQAIERNTGKVGQASVLCNETTANPEIGALISHQDPASENAGAINKAITLELARQLAGIGADPNLALLTGTFAPGDVNDNTGAGFTCDTEDRKLGCIYTEKLLVLDATEDEVASAVSGVQQTFTGTGGISATDLVNLADFNVAKVTGNFDLAKVAPGSGAAATADAGAAETPAATPAATAAETAAAETPAATTAVADECEAADSTTAADSEATEQAEATGRCSLITMTVGADQTAAIKAQYPSAVISEVNTPAETTAAETAADASATEAAQDEAAADEQKEDKQGNQNGNGNNNQKEDKXXXXXXXXXNNNNNNNNNNNQKDDNKNENAGEGAAAAGGNLQTFAGDLGGAAPPVQNNGDADRPFEVNGATFTNEAAALVRSCDIQNNQCFNAVNSGKLAGGTQQCAQQLQQCQANAGGRKARRNQILGGVNPALLGGNRAEGNRIVNGGAARLVSGGANRVVGGKNAVIGGGGINGLVLGNAQSLNLGNFLGGGNIAQLIGGGVVGGAIGGGRQIIQPSRGNQQLVAVILQQCR

SEQ ID NO: 1766 - protein, 161 aa, Unknown
  Kingdom: Fungi, Phylum: Ascomycota
MSQPILLIHDDRDKKIKSIANILPARIDHDGPVDPIESFWTPTQGEDNSRTAYFRGRKLQGKTVKLPERCRGVVLQRRDDPIDTKKPTETEENVIDLEAEEPGPDTGTMKVTAEFDEIVVWGHEAVADATGDPYVRSIEEWLQVSEKIHSYTVDNAGSDNK

SEQ ID NO: 1767 - protein, 580 aa, Unknown
  Kingdom: Fungi, Phylum: Ascomycota
MMSPSSFKYSSLPPRPSSRSSSSSFDKSVRHYTNSTSSSSTSRFYPWTNRSTTASPSTSSSPYTTSSSSGAYQPTQPRTIPTTSSHHLQRHRRAPKYEPDKLDYTEVIDTPTRSSPPSQAPAFHAVMAKRKEWREPTSLSPSSPTTTTTDLSVRPTTPTSPVQIPKASKRDHAHSTRSHGATRRRAKEAHTPNSISPSMAALLAVTDIPRPRHSSRRLRKQHPNKPLTIDDIFDERQVSEKEFSWSLGRGTMDMLLTPPDHPTEDDMSISDSNVGSALSMRTISVDSIPSLGESFATEQISSVDTPSRSSSRRRSSGPTRKALEPLSSPEQVEDHPLAFAGLDKDDFDSEFLGQPLEAVPERQPLAPFKPLRSVFKSNLTASLRALRSAAKSFSSMSFATLPSEALLTRSLLTMDPKVPYTDERMPPVTEDMPSAEVRRYLNPSTSSHHEPLPASKKVPGSFSASIQMQTYKIQRSRAPSSITHSPYPNAYLQPPASGSDRSPQQPPSPVQHPGMRQREMRENSDFIRIAVMEMAMRKCGKLDDQRPGRARWALPPRKAVLKPYGVNIDGVPERWVPISL

SEQ ID NO: 1768 - protein, 575 aa, Unknown
  Kingdom: Fungi, Phylum: Ascomycota
MQSAVMRRAGVRCLGHSARFPQKRSIAQLARFKTPQVQNEPNQHYAKGSAQREGLTAAVEKLKGKLPLQVPVVVGGKEITSSSLSQQFNPSDHATPVASYHTATPADVSAAIDAALAAKPAWESLPFADRAAVFLKAADLVSGKYRYDIMAATMLGQGKNAWQAEIDAAAELADFFRFNVAYAEELYGQQPTHNHPGLWNRVEYRPLEGFVYAVSPFNFTAIAGNLPGAPALMGNVCVWKPSDSAIASNWLVYQILLEAGLPKDVIQFVPGDPVEVTKVALSHREFAGLHYTGSTAVFRKLYGTIGQGVAEGRYRSYPRIVGETGGKNFHLVHPSADIENAAVQTVRGAFEYQGQKCSATSRIYVPKSIWPEFKEKLVAETEKLKIGVPWEHDNFIGPVIHAGSFKKLSGAIDKAKSDASLKLLTGGKYDSSKGYFIHPTIYETTDPAHPYLSTEFFGPILVAHVYDDSAPDFFSKACELVDSTSEYGLTGSIFAKDREVIRFAEEKLRNAAGNFYVNCKSTGAVVGQQPFGGARASGTDDKAGSPNLLTRFVNMRSIKEEFGPTTKVLYPSNEV

SEQ ID NO: 1769 - protein, 1171 aa, Unknown
  Kingdom: Fungi, Phylum: Ascomycota
  misc_feature (704)..(708): Xaa can be any naturally occurring amino acid
  misc_feature (732)..(740): Xaa can be any naturally occurring amino acid
MSSLLAALNHSRGPASTPSSPLPDQQPPSPFSNQTPILSTDPSSPYDAAPSPASSAALPPFLPPITRVTSTESEPQHEHGLMPDMISYSDQRPEPPSKQQSNGSGFIGGLALQNYRKGINHQTQQRPETADGSTSAGSDARATHANIQGSVSNRPEAPTRPSPVPTTQPKSASSFTTPTELHTFSVPSTGRKPIGTRLASEPVTMAASTEPQRGKKSLPFLKNSMSTLLMRRKNSHNVPDLLPLPLKKEEEPTYDPRIKGTRVHDFSAPRRKHHMPHSGAHSSRSPTRHDRRSDMKRDPSLAADSMSTLVQPTSYVSSASESASASVISQPVGHSTSASSQKTKASAELVAAADQEAPPVPPKDDADVMRAHQSRKSHVVHHDSPSHAKSIASKHSAQSRKVSLADRTHRDTISSIPKHMKSTSSRFSFDMIGAAKQEKLLEERHRQRELERQTTEPADSRDSHYDDFDEDAMYEAMMDDGGYEEEIPGVSFDYEEDDFTTPEDNMDGNPKDELNEPEPVEDDPDNDQENFEGFVFQRSNPASTLTSPQYAGTLPTPRDASGEVIGAAMTKFTPNLQIPTLSPLSPFSPDFAGVSGSRMSGLGIQCISTSPPPDANVLAPQLDVPASAMKALAQMQERDELDFGSGVMSGFENEFAEDLAADPDHDAVPFDESIFDNNDTDQYGRPVPGAFAQAQSMRHAAKQXXXXXLRSTAHTSLSADNQNLKQEQEPAXXXXXXXXXKLPHSTSSSTVEPQEESEGTAADPMAAYQAALAAAACEAAASGKFERDDSSPNKEDASLLSEDLDNERAFDPSAYEDDEDDMHMSHNGLDDYELDDEAIIAEANADMLAYDEDYYGQEFGFYSTPVTNHGSVKSRSSDDSEYSFAGGFFAPKGVDIVNRSKSGRIVSREPNLTPITERSEYSNRNSVMSFAGPPFMSGTPIQSPGLAQLAMMADRGDDQMSLTALMRLRSKAWGGSQISLSSSREGSPRSERGDLTSPLGGQSGGFFPAPNPGHLRKSSVYSTLSRDSEANSMAGSPTLTGMDFSGFSSPLAPSSQIPPIPTLHDESADVVSPLGIRAPLGSSANPIESIETPVSASSSNDWNWGKQPQAQAGARRPGFGHRHKGSADSISYIQEEEEGGGETRWVMERRRTGESGQIEVLEREIVEGGRI

SEQ ID NO: 1770 - protein, 297 aa, Unknown
  Kingdom: Fungi, Phylum: Ascomycota
MSRAILVSGATGKQGGALIQALLDHDADFRILALTRNASSASAQRLASKSKRISLVQGNLDDTEAVFSEAEKISSSIWGVFSVITVNMGGEGSLVEERQGKNLVNSALKHGVQHFVYASCARHGDQPTDVPHFASKHRVEHHLIDSTRGGPMSWTILRPVAFMENLDGGFLGTVFATSWRNTIKSRPLQLIATTDIGVVGAKAFLDREKFSNQVVDLAGDELSFADMARIYKEVTGSQVPTTFGFVVSVIFWLSSELRLMFNFFDREGFGVDMAKSKEVLPEIQHFRTWLSTQSKTA

SEQ ID NO: 1771 - protein, 878 aa, Unknown
  Kingdom: Fungi, Phylum: Ascomycota
MGLISNPLRRQEPRLPTYERVNAQTKERFSEDDFTSSEDEYDDEEDDDLLEQLPSRVSPGSSRNTSGSMSSGRLLVPKRHPQPQRNRFSTLYPYRLPNKVTRYLCIILSGTVILMIISLIRASQVENWKVQNGKVDARPKAPPVWDKFPFLERYYGGVRTVVPFNESLPEYPESDEPAPLKSESQPTDAEATAAAKRDVPQSKPWEAYQGRNVESEMEECFIDAAKTIRIPPLRFLEGRPKGFPRHVVGSYDLLKLPEDICFERFGRYGPYGFGYSIRSGGLGTGETGENEGSAAIWDETARVDYRTVDWADVQRRCFRQNSHRFEQLPPRVPTSHGFFIDDEARPKSVVSKSQPRAEPTLAESVEATPAVAPPAESSPTFVKSTQGKTKEKAPETHAPVQKKARTAVVIRCWDEYLFREDDIANVRSMITELALASGGRYDVHLLIQVKNDAAHPIWADHEAYEERIKESIPEEFRGLVTLWTETQMLSLYQGIYDNWARGPDLPVHGVYRGLTMAMQHFAYLHPEYEFFWQWEMDVRYTGHYYDFFTKLEEWAKEQPRKGLWERSARFYFPDVHGSWDDFSQRSRIETEIGVTSADNIWSKVPGMDNKASEKQGKSIWGPVRAPDDNDWFRPQDDPSPPTPYEKDSHVWGRGEEADLITLNPIFDPDGTTWGLKDDITGFNRSQPQPPRRASIITTSRLSRRLLLTMHKMTAYKKQFAFPEMWPATVALQHGFKAVYAPHPVYVDRAWPIEFMAGTFNAGSSGSSGGSRTSVFGEREHNMHGTTWFYNSGFAPNLYRRWLGLKVNNDGGEEFELTEDKSKIGKGGVGNMPGGEGRMCLPPMLLHPIKEVELPVEVPPEPAKGENGKDHSVSLDPNA

SEQ ID NO: 1772 - protein, 610 aa, Unknown
  Kingdom: Fungi, Phylum: Ascomycota
MAEENSAKKAANPDYDLERPISSTTGLRQGLTSYGDAHFSLFLRKVFIKALGYSEDALSRPIVGIVNTYSSFNPCHANIPQLIDAVKRGVQLGGGLAVDFPTISLHESFSSPTSMYLRNLMSMDTEEMVRAQPCDAVVLIGGCDKTVPAQLMGGISANKPIFHLVTGPMMPGSHRGVRLGACTDCRNNWASFRAGKIDIEDISAINEELAPTAGTCGVMGTASTMACILVGLGLMPFKGATAPAVSATRLRIAEETGKNAVLACQKLDELRPQKVLTRESFLNGLTVLQAIGGSTNAVVHMMAIIGRHPDVAGTINLDTVDEIGRKTPLLVDLKPSGDNYMTDFHNSGGMLALLHELKHLLHLDAMTITGRTLGQEMAAATLLEVPRELSVIQPFDQPLHPSSSLVVLRGNIAPGGAVMKASASKDKKLLKHTGRAVVFAGSADMAKRLDDPNLDVSPESVLVLQNIGPVGNPGMPEAGMIPIPRKLAEKGVTDMLRISDGRMSGTAGGTIVLHVSPEAADPSSVLGVIQDGDLITCDAEQRILHVDVSEEELARRMEARKAIIMGPESTAPWATRGETRGYRGLYLRSVNQAQNGTDFDFLTAAGPKGN

SEQ ID NO: 1773 - protein, 544 aa, Unknown
  Kingdom: Fungi, Phylum: Ascomycota
MAPHAEVDHHNGDGIVRLPPPERPSFSASPPRLLIIGAGNRGKAYAEAIRNSSNGILVGVVEPVALKRRQLGRKYIWGASRQPVPGEEFEDWPEFVAWELKRREQAEAGVEGLPEGVDAVFVCVQDGMHKEVVLGLAPLNLHIMCEKPLAPSLEDCVAIYQSLQPDASGTASKLFSIGHVLRYSPHNMLMRKLLLEDKVIGEIMAVNHTEPVGWYHFTHSYVRGNWRNEKAAAPSLLAKSCHDMDILYWILAAPTQTSSKPTHVPSNISSFGSLQYFRKERKPVEAGTATNCLSCAYEPSCQFSAKRIYTGPELKSQQQEHFSQIVAPEIEDCVAAGKPEEGRKALLSKLAEDYPEGTPAEVISQRNTFGRCVYECDNDVCDNQTVTLSWDEDPIAAPGETPLQALQGRGSKTATLHMVAFTEKICTRFTHFYGVNGEMYADSSSITVHDFKTCKKTVHYPHVPLGGGHGDGDEGLTRQFVLAVDRVKNHGVKVATAQREDIGCTLKDIMMSHGMVFAAEEARRGKKVVDFPAWWEREVMSKLG

SEQ ID NO: 1774 - protein, 258 aa, Unknown
  Kingdom: Fungi, Phylum: Ascomycota
MGRYELEYPKDANNTVKRHNERATYALKTIHSLVNASSLVHISYTPPDSAFPTTLPMIGQMGSFDRPSASISDPLDLYIHGYVSSRVMNVARSGKGLPVCVAVSYVDGYVLALSAFNHSYNYRSAVLFGYATIVEDQDEKLYALELITDGFLPGRWNNTRLPPLGAEMQSTSVLKVKIESGSAKFRDGQAIDDKHDLENETALNSIWTGVIPIHQTYGDPIASSYNRVDFPGYATEFIEESNKENKEHCIKAAENKGN

SEQ ID NO: 1775 - protein, 69 aa, Unknown
  Kingdom: Fungi, Phylum: Ascomycota
MPEGHQSPPPEQQSGRQLHDPPAHGQGTDDAKNKDKTLKKEIENLSSNPEGPMDSSLKDKFSKKQGNCK

SEQ ID NO: 1776 - protein, 444 aa, Unknown
  Kingdom: Fungi, Phylum: Ascomycota
MPTSFRSSAGPSRRNFQQQQEEPATIHSARRTSTSHRAGSTGRSTTSQLASATRHRSAASPTATVPVPSETSTTTAINLADAPSSASNSYTFPNHARTNLATNDLHVAAFNALSEWNSGIFGLGDYLPLPGYWDDDLDDDLDEEYEEDHDELDIHSEEDEEDEEDNEDEEDEDEDLDEDLDEQQDLDDFDSEDADLLALAEEESLFLEDDYFLGGDEDGDSLLTQGFHTNQALLDLLIGNGLSSPSAYPSLINASPPWHLGLDQSSRESRESPAATLRSARAAARPNPSVRPSSQSQITTQQTHLTNDSVVITDDEEEAGDHTPNTSFSDEMPPTTRRGSHQSVRPEPPAKRRRTSAASRLSSGAGNKIQPVKIDDDGIFSDPPVRKPTEGAVEDLPTLDLTNATEVPEELQEPYQDKRIKLAAFQCVICMDDVSNLTVTHCGT

SEQ ID NO: 1777 - protein, 208 aa, Unknown
  Kingdom: Fungi, Phylum: Ascomycota
MPPPPNIFNLLPRQSSFVPVPSSYGSASSSPHPGVVAGIVIGSVGGFLLLLFLIYSCLGFGPSVWVQPSRSEYTAASQSVLSFRTRRTSRARSARRHASRGPRVTETYEVRTRERRERPVVVEEPPVVVEATRAPPPPRVVRSEDSEDDEDEIVVLEEHSPPRRKSRRRSSDRRSEERYSRGGGSYYHDAEPGSPYRERRDRRYSRER

SEQ ID NO: 1778 - protein, 389 aa, Unknown
  Kingdom: Fungi, Phylum: Ascomycota
MSEVSIPPKATPGRRRNGRGQPKAAAPKAYASENDATAVDSPRLYDSPQTPVKNSSASAARNNAPNSQTNNKARSRTKSKPKPSTSPGPGATAQATTPQRPASMSTTKPNMAFAGATFHASPAPSALPMPSFFTKSSNESPIPRSSINHAQQPSPPATDPELPTPNRTGSAPQNNGSPLDFMFRAHREEKERERRGSTLSQKPAMNSDPSPFQSSANQPALREASSVPHTRNPIARQHSSGRIDSKELDGERGLPMGPAFSTPYQDRIRAARATQTRSNLTEPLSPPRPKELESLDDRSEALKKFLFGGGFSNDSPPNPLNVTSNNFNLPPHASPAVGSYSPISYQNMPSSQPQSSGRPNDIQAMENDLRRILKLNPASQSGAKSGGLF

SEQ ID NO: 1779 - protein, 418 aa, Unknown
  Kingdom: Fungi, Phylum: Ascomycota
MELLELVEYEPTTRPFQCDWETCNKACPQSRWHSRPALANLAQSFNRKSDLQRHYRIHTNERPYTCSTPGCGKSFIQRSALTVHIRTHTGEKPHQCQHIGCGKRFSDSSSLARHRRIHTGKRPYKCAHDGCLKRKTTMVKHQRRSHQRGLHPNELMDDCTSESDGCESPPTPTQSSVSWPGHGPMGSHPSLAQAHAMHRAASFADFGQHMSYNMAQQMPHRHSVAGEGQEYHSPAPHGQPQGIQMVHRTASMPQHYYVIEQSNPGIATMNTTSVQQAYIPRQHVERTNVEIPYSAGSVASLSSSPGSFSPASGNSPTIPETMYTHQPSQAPSYAIQTASPVDQQPPMVQYSQQIPANMPAQAPQQQAEAWYQYQAPVEVATIGQLPPFGSGVYDLYGGPKIEFDDPTMQLPSSRIETM

SEQ ID NO: 1780 - protein, 636 aa, Unknown
  Kingdom: Fungi, Phylum: Ascomycota
MQAFKAAFAAESSGWATLNFTDDPFYTTPANASGAKPGDLLRWEDVSIEQLAQNWTGIPGGMSLSRFLYMTEDINRNPIPASAFVLLPFSAQTPGCNSKVFKTLAWAHGTAGRSRQCAPSNQKDLYYGWMAPLFYAANGYAVIATDFAGQGTDIPGGFRYEAGYLHAADVAYSLVAARKRIGNILSDEWVVAGHSEGGMTAWRTNERLAMPGQEELLKAGKFLGAVAAAPALRPTKLIPKSIRLAKGGPLGAPVHVYMLQSLVEIYPELKLEDILTTRSLELLPLLNQGCLITGDALFHNLSVTDIFKSTAWLTSKEFNEWQTKINGAGPHKLAAPMMVVQGLGDTLTYPQECEQDFDLTCKAFPDSRAELYLVPELDHGPSFQAAQPYYLPYIKSLFDGLQGPPLRQNSYPRSLVTNPAKITLDQAQHRQTSTSSSELTHTRFSCRSLPPHAGASSTSSAHCIIPREEPATIVTMAIHYLILLSRQGKVRLAKWFTTLSPKDKAKIVKDVSQLVLARRTRMCNFLEYKDTKIVYRRYASLFFIAGCSSEDNELITLEIIHRYVEQMDKYYGNVCELDIIFSFTKAYYILDELLLAGELQESSKKGVLRCIGQQDSLEDMEDTKSIMRNLEDEGIL

SEQ ID NO: 1781 - protein, 245 aa, Unknown
  Kingdom: Fungi, Phylum: Ascomycota
MAAERADKKEKKEKKSSRTDDSGAVTKVKKDKKEKKEKKEKLAAAVLDQKMQEDAAATSAAPASKIDVDSDDSDAEEKREELPLERTVVSFAVPLADEKGTKKVFKTIRKSAKNNTLKRGVKEVVKTLRKSPASSPSNTSFPGIVIIAGDISPADVISHIPVLCEDHNVPFLFVSSRAELGAAAKTKRPTSVVMILETPQGGKKAKEAEKGDEEEFKEAYKALVKYAQKEYQKQAFWVQGESSKA

SEQ ID NO: 1782 - protein, 495 aa, Unknown
  Kingdom: Fungi, Phylum: Ascomycota
MSYRIAQPSEYLAITGLGIKSVKITKAAWVWPLQRCMRFSVQPRDYAMELTAMTIEKLQFSLPVVFTVGPDVNQRGANTTTSDVGDDLVHREDRGDSLMKYAMLLADADDNRRGDSAAQHVTNIIKGIIEGETRVLVSSLTMEELFTNREEFKKRIFRNIQGELDNFGLRIWNANVKELRDAPESNYFKSLSQKAHEGATNQARIDVAEAQLRGNVGEAKRRGEQEREIAAINAQTMVQKTERDIERASAEAQLHTKQTALNRDVDIAKVTAQRAIQSQDEDLKRQVEVKRAAAELERLRATDLVKATIERESKQQAADASAYEVEADARARQQAAQRRADAQAYTMRTEAEAANYAAQQTAEADAITRIKEAEGIAAMAEAYSKMSHAFGGPAGLLQYMMIEKGTYIELAKANAEGIRGLEPKISVWNTGSNSQGSSTDGTEAMRNVYQMLPPLMTTINEQTGITLPEWQFGKMNAQMNAMNEKKVNGNHVPSS

SEQ ID NO: 1783 - protein, 349 aa, Unknown
  Kingdom: Fungi, Phylum: Ascomycota
MAASRTTASLLRLAARRTAPSPSFRPVSFAGASRCLSGGPPRFDKPGSYSRTDPGVEVEYPAEDELPKSKPVHGIPGQYVKPTLASFSLDGNVGVVTGGARGLGLVIGQGMVYSGADLALVDMNKEEAERQCQLLVDAFKRENPNAERIPKVTAHYADVADPESVEACIAEILAAHGKIDNLVTSAGFTENFEAVNYPIDRMRKLWAVNVDGTYLFATSVARHLMERKAPGSMVMIGSMSGAIVNVPQPQAPYNAAKAGVRHLAASLAVEWAHAGIRVNCISPGYMLTALTEKILDDNPDLKKKWISLIPQGKMGQPQDLMGPVTFLLSNASGYVTGADIRVDGGYTVT

SEQ ID NO: 1784 - protein, 599 aa, Unknown
  Kingdom: Fungi, Phylum: Ascomycota
MNFESLQISERKIIVGIDFGTTYSGVAWAETQRHDRRATITSWPISRTTKEGESSEKVPTKLRYVDGETQWGFSIPQTAPQEEIVEWFKLDLDPQLQSMGTSSFSDHSRGSRSALQLVTDFMRLLGEHLMYTLEEKLGESIIRITPFEYVVTVPAIWSDLAKDKTKQACESALSLTEKGAPVHLISEPEAAAIYALHGLDPHGLKEKDTMIVVDAGGGTVDLISYTITSLEPVLEVQEAAPGSGALCGSTFLNMRFTKFLKSKLGKEPGFDDEVMAEALEVFEKKVKRQFAFTAAPDDTYTIPVGGLPNNKALGVSRGRFALRASDLTAIFEPVIIEVIRLVQEQISTSGVPIRAVLLVGGFGASSYLKERLRDAVDKDIQILQPPNAWQAVVQGAVMKGLANCAPEKWTTLKIRNRKARKHYGMEWRTAYDDEKHKHMTSTKHWCGMDGCWKVYSMEWFIKKVSSEHSQFLPASIRLEDSDGLLQGDPVSENKPYYTDFVWTGLVSQGRIRKIKMCIYADQTDREAPIGRDGNVKLLARVEADVSHIPEHALARRKGTDGEYYYDLSCKIEAVYLSASTTYTLLYNNQRYNTVTCEYV

SEQ ID NO: 1785 - protein, 436 aa, Unknown
  Kingdom: Fungi, Phylum: Ascomycota
MATRGSPVIIVGGGITGTVLAQALTKRSIPFVIYERDPDPLYRGKGWGITIHWALNSLLDLLPQHIIDRLPEAFVDADATKNGENGKFLFFNLRTGEALWQVPPAKRIRMGREKFRRLLMDGIPINWNHTFESFEHTADGSVNVTFNTPSGPSTVNGCMVVGCDGSQSLVRQCLFPIADDHTNHRLPVRLLGASTIYPDSLASTVRKLDPFFFQGGDPETSAAHWFSFLDSPSTSGRGDDSRDCQILVSWPFRSGFMGRAEPLEIPPRGPGRVKLMKTISSSWADPFRSIVENIPEDAEIKSIHLEDWVPPPMERWDAEAPGPHRVILVGDAAHAMTMYRGEAANHGIADVELLVSQIMPVLARGDLDEQRSREELLQACRRYTEEMIERTAPAVLNSRQACLDAHTYERINESSPLIMKRVVRVEPPTGKVSVGA

SEQ ID NO: 1786 - protein, 974 aa, Unknown
  Kingdom: Fungi, Phylum: Ascomycota
MADDREYGDFNPKRRRIDSVRSQSKFSNGSRGSTPRAQSRYAQTPAREQDTVKPTEEDSLALDRDWYGTDELGGHVFGDDSYNPFASYDTSTYDGQQQEMAKAQQMVGRFDSRQEQRNKENDAWETNRMLSSGVAQRRDMESDFDDQETTRVHLLVHDLRPPFLDGRTIFTKQLDPVPAVRDYQSDMAVFSRKGSKVVREVRQQRERQRQAQQATSMAGTALGNIMGAKDEDGDSALPMAGDEDAAKGQPKGNKFSEHIKRDGASHFSQTKSLREQREFLPAFAVREDLLRVIRENQVTIVIGETGSGKTTQLTQFLYEDGYGKTGIIGCTQPRRVAAMSVAKRVAEEMEVPLGSTVGYAIRFEDYTSEETKIKYLTDGILLRESLNEPDMDRYSCIIMDEAHERALNTDILMGLIKKILQRRRDLKLIVTSATMNAKRFSDFFGGAPDFTIPGRTFPVNVMFHRSPVEDYVDQAVQQVLAIHVSKGPGDILVFMTGQEDIEVTCELVQKRLDALNDPPKLSILPIYSQMPADLQAKIFDRAAPGVRKCIVATNIAETSLTVDGIKFVVDAGYSKMKVYNPKMGMDTLQITPISQANASQRSGRAGRTEPGEAYRLYTEKAYKEELYMQTIPEIQRTNLANTVLMLKSLGVKDLMDFDFMDPPPQDTISTSMFDLWALGALDNLGELTELGRKMSAFPMDPSLAKMLITAEQYGCSEEMVTIVSMLSVPNVFYRPKERQEEADAAREKFWVHESDHLTYLRVYDEWKLKRFSEGWCIEHFLHSKSLKRAKEIRDQLMDIVKMQKMEMVSCGTDWDIIRKCICAGYYHQAAKYKGSGEYINLRTNLGVQLHPTSALYAGHPPDYVVYHELMLTSKVYVSTVTAVDPHWLADLGGVFYSVKEKGFSIRDKRVTETEFNRKVEIEAKMAEDKRRDEEKRLAEEERTIIKKKVAGDGKKFTTQGAVKKPIVKRRGRGF

SEQ ID NO: 1787 - protein, 133 aa, Unknown
  Kingdom: Fungi, Phylum: Ascomycota
MPDTAAADDNVTTFEQARRTGGVPAQTHPAAGWRGRQGWSRSGAVASSETVDPAAKAQQARPVRGSDAASAVVNRLLGRYGHRLLILWSGGSTSLGTTKDIVDKGLLKDLTKDYTGLDQGVDLLDWRRGKNGR

SEQ ID NO: 1788 - protein, 900 aa, Unknown
  Kingdom: Fungi, Phylum: Ascomycota
MSIHEKAPGAEISPAMKREDSTHSKPESSSASAAPRQQLPSLSSLFGPSSSRPLNSPVSERPGAFPTSSPRDRPRITSADRTASASYFSQGIPTSMSQPRSTLDGKLESTDRSSLHPLQRTFSGSSSPGYRDLGSARSEPRPDAESSGKWTAQHEPSRQEYTFGSREHQFRPSQDQFKLHFPGSKEAQFPGYGDQRSGHPNPPPTPTSTVNSEGMSKDGLGPKIWTGSHFLPRFVRAADVPGEGLCYFYDDGSHCKTVIDGEAVNAHWGVTKAGKPRKRLAIACMTCREKKIKCDPDYPRCVQCEKFGRICKFKNAPRGGHNGSPTTPPAELDDMRTSGGPMRVGDYRVADSDSGSPISPRTALPNGSPEEGSHKRLKLEGSRYQSAGDPYGSASQSLNHSKAEFPVHHRPRELPRIPDNVLNRAWQTDPYVSDPQSIIAVVSHFFAQIDNTMILRFLPQDATMAWVSTSAHRKAPEDLMLLYSMLAVGVALSDGPRHIAFEYAQVAHFAQKTLQLDCLQLVQSRIILALYYVSTYRLRDATDLMAAAAAAAAPLQLHLEMEDSVEAKRLSFPLNMTRAGFAESRRRTMWSLFMLERLSGMFPQQPAILNADDICIRLPADTRSFEKQVDDTAPLFDPFESATRSLDSTGCLIEMVHLWSICQSAVFRQIRRSAWSESELNRLRSLHDRLEKWRGLLPETLTFSPTNLEGAILAGKAGALLSMHLLYRHAIIALTRYGGNPNRMTRHERMVTVHRCRDNAKIVLDILQAMSHAHRGVPSSWNPMPPTTAFLVSEAVDILSCGGSLASIDGVTQAIERARPAMEALGRVWENQRAAVTIIDERLAKLRRIKDRGSEPPSAGAGYRIIRSSPGPSCNGVIWQLDDSPRTPSRELDILFHTQH

SEQ ID NO: 1789 - protein, 522 aa, Unknown
  Kingdom: Fungi, Phylum: Ascomycota
MPDIDPAALSRPANFATPTLSSKTLSITAPGAVKISKSQAIPQRIDLEPLYTALKAAIAPEHWASYKEATTEFLIGRLNQTEFSERIDPILDGPSYEKQHLHNKLVSAIYANVTREMPDQGPAPWVSAHDKPITGASAKPVTGDAAERRLKVDVMQLPARDRRRIKDLVHNDFDANESLSNMFTDTYRRPSAVSEVPTSAAAGGINKMNFDLEIRKRFAPPLAIESGEFPDVGMITGRMLPMCYEAGLPNGHVSDAPQLLSIATEIFIKEALSQVFSRTRSNAPGDSGNAGFGPNIPTWIQTRKYKKQLRLEEAAAQRGELLRDKSGLLPVEYKAASERAPLGMADLQIALEMADVGLSQFPIIASQVLYGYREGELELWDDYTWYNHVEPTRVDLELGPVAMNGDRVHELPNGHVDAMEIDNDTWYCWSDEDAEDEEEAPAALSRSEVSLLEHKVSKDELVIKAEEDHIGVFSPEVHAMNKGTRHDSSSKHVQEYQQNPWLSGYLPGKSTSGERRAPDAVM

SEQ ID NO: 1790 - protein, 884 aa, Unknown
  Kingdom: Fungi, Phylum: Ascomycota
MSSPDVFLSSPRVARRTLRDSRASSPDLPDVQDLVQSRKPKRPPLKSGSKAVPIPENVLTGFTTARGLWQTVQAAEGPSSSILHTADPIYLSGEDDSVCVVQAPPQPAKKAIRPRRPRQQKAAKGELSPVTQSLPVDAHSPETPSKSQPWRKYRPSPKGHTSSPADATRGFDAPPSAQVPVDEPRFLKTDSVSKHFQSQRPDRNDEQKVGPAASEPVVMDPAPLRRLDWTPPAKALALGTGGGDHDSDERTPDSPGDGCQVEFKNLLRDFSCPETTTKATELEAEEATGGFGKRKLIEPVLVREQSASERSRSRSPIKKKLPKKPRTITELATAAYRKEEELEPPPASLLNYLSVNPEGDGPDKQSKGKAKGKGKPRKKTAATTSKRKAASTKATLLSPGAALKHVANQDFVFGTSSQLAQEKSPTFLRSLHAAMRQSNEIDEGDLAIPLNSDAIEPSEPKSKLWDAAARDNDGDLFDVEVIDLVDASPTLPHIGEEADPFGYVHDDEAGTIAGAKKQGEVKDSLLSLTDILTEEPSKSSKPSAPHATSRSITPIPLPKTSAKTSLSLGEDSSQIIAQDDDPGPELPILTELPQSPPLRPAYETFTDAQLAKQISKFGFKPLKRRATMIALLDNCWKSQLASGRATGMPPKRTIATSAAKSPARPRGRPKKTVTDPAITLQASETVQVKTPPKKPRGRPRKDAGSPSKAAAPRTKKKALSPARKEKAKAEAQPAHTVTKTVLEIPDSESDQDSIRLASRSASPEAMCSSPPATANLSIMMDDDTDMSLTMTPTEQQATLFEYIRKAVLSSPRSNDVENPSWYEKMLLYDPIIVEDLAVWLNSGQLTNVGYDGEVNPAEVKKWCESMSVCCLWRDTHRGKERKRY

SEQ ID NO: 1791 - protein, 502 aa, Unknown
  Kingdom: Fungi, Phylum: Ascomycota
  misc_feature (297)..(305): Xaa can be any naturally occurring amino acid
MSARPTTPASPKSVKIKSPVPGTPMFGCEHVQLLFDRGQDVMNSCIAHYKMILRGIFDNTPIVPQTSTNNDGRPVTTLTSNYLCLQCPSTVTEDDRLKHGNKKSHRFYVDSRTGALYCQICDDLVWDPTLEELRVRKIGTGSFSGRKRKHDELFTDSGKEDPRYITTNTVTAPCRANGLRGIYNAGATCYQNVVLQSFLHNPLLRNFYLSDGHQSSDCKVMNCLSCAMDDMYQEFFALENTNGYTAASILSAFWISEKKAFENLVTTKEQDAHEFFQFLAEELHERNGDGKRPESGXXXXXXXXXTTTCQKCSGQTHAVQSFLDLSLGLENLTLKRKRDPKAALMLRDCLDEEYVKSDKCEYRCNSCQASQQARRQTSIKRLPNVLSIQLKRFEFKQGRSDRAAGKVDTPVQFPLQLNMLPYTNRARSRDSRENMELERSCTYDLLSVVVHVGELDTGHYTSYCRVGDQWFKFNDHKVQMASISEVLGAQAYLLFYIIRSLA

SEQ ID NO: 1792 - protein, 308 aa, Unknown
  Kingdom: Fungi, Phylum: Ascomycota
MTTTADIPVVTDLPQNDGASQSAGSPGASPGALKRKASLERSAEDDDGTLKRPRRDSNPQATDATSTRQRSKAPSAQEEKKRNKRLFGGLLNTLSQSSTSNPAQKRRLEIERRQQERLQKQREEDERVRKEKGDRRREERARNGIIWEEEVMKNRHTRMLASARFLKTKVQPAVYYLPSKRSAEQDEKIEEQMRWTKKLVEREEGEFEERRRKHEEVHGRPKIYDKPSARRNGADDEDMKDAKKLASPLEKTSAASAEPGAKEDKDMNPVSEGHASSALKPAIKEAVHGDHDESGDEVVDAEEDMVIY

SEQ ID NO: 1793 - protein, 575 aa, Unknown
  Kingdom: Fungi, Phylum: Ascomycota
MPSFNPFSSVSGRSSVTLFDIRLENDFIVFRGNDHESSGQLLKGVIVLCLSTPLRMEDIRLRLTGTLRLNWADQRASTPGVSGQKVDKSVAILDHRWAPFVGAHGRSMTLPAGNYEYPFEYMLPGDTAESVEGIPEASITYKLKSTIGRGKLAYDLHSYKHLRIIRTLEPGALEFLHAMSVENIWPNKVDYSIVIPQKAVVFGGFITMEMRFTPLLKGLELGEVTAKLIEVRDVMVQGPAGIAMREHRTEREVSTWRFDVTREEHWSDMIEDTGQDGWALTKQLNLPRKLRQCIQDINHHGIKVRHKVKLTVALKNPDGHISELRATLPVSIFISPNMPLDEQGNIVSQNPGGGAQPSDSGAIAPPGYGEHILDQLYDEVDISGLQTPAIQSGVSSPFYAQSRSGSLENLASLNAPFPPAALSSRLADVSIDPSQRQPPSPPSAARSEPHSTVLSRTNSGEDHSGRESPEANVDMSEFADLSRVPSYQTAVRTPAARNTTGTIGLPDYHTALSAPSTPPAMELHTGHDILSPITEDMAGEHRSRSQPRYEPTRVHTTDSSDHRRLTILQARDQVY

SEQ ID NO: 1794 - protein, 697 aa, Unknown
  Kingdom: Fungi, Phylum: Ascomycota
MAPNPDWVKKLTVAAPKGSDLLTQERAQSNIDVTQLSEYLFGKEQLAMRDQILNILVNDPVFDKSQNYFQGRQDRIEASLAKAKRLRQLQVKHSWSEEQYHVANDLLSEPTPYGLHASMFLKTLRDQGTPEQHKLFLEKAEKYEILGCYAQTELGHGSNVRGLETTATWNQNDKTFTIHSPQLTSSKWWIGSLGKVANHAVVMAQLIINGKYYGPHPFVVPIRDMKTHEPLPNVQVGDIGPKFGYNTMDNGFLLFNHVKVPHVNMLAKFSRINPESGRYEKPANPAMVYGTLTWVRSNIVLQSGSVLARGVTIATRYCAVRRQFQDLDAKGGVGENQVLNYTMVQYRLLPLLAATFALHFTGRSMINMYEENQARMKSKLDVGQLSDANRRPGPEELNPGTDLLANLHATSCALKSYGSTVAGEGLEVCRRACGGHGYSSFSGIGTWFADYLPTLTWEGDNYMLTQQVCRYLLKTARAVLTGKAGDNDTARILKAFLARRDTGAAFDILSSDEDLVNAFAWRVSYLTFEALQHRDVDKQSWNSLLVDFNRLSTAFAQYMVVKSFYDALGEDSAKSSLERQTTSVLHKLFRLFALHTLEKEASEFFSSSATTVRQITLTRKAVMKLLEDVRPHAVRLVDSWSFPDWQLDSSLGRYDGNVYEDLFHRASELNPLNEVVWDPYPESNVIIKKDERVKSKL

SEQ ID NO: 1795 - protein, 642 aa, Unknown
  Kingdom: Fungi, Phylum: Ascomycota
MKLAAALALLVPFVATGSGLSTDASSVIYDGYHVYSFTSATRQEAADLERRFSRHYTQHVRNTFEVAIPPNEVRTFNDLGLNARLLSRDLGQQIREADKPSVYSRSLHKRGRLPDLNWFDSYHDYDDHLQYWDDLVEAFPGHAKKIELGQSYEGRNISAFNFWGKSSSPGKKPVVLWHATVHAREWISTMVIEYLAYKLIDGYQSGDQEVTRFLDRYDFWLVPFHNPDGFVYTQTTDRLWRKNRQPRAGSSCLGTDGNRNWDFQWDAEPPEGGSSPDPCSQTYRGLAPGDTPENQVIAALSQKLGATEGGIRSYIDFHSYGHLVLTPWGFSCDPEVLPPSLPRMVKVAKGFAGGIASVNGTEYEAGPGCEILYFSTGNSRDYHHGAQGADHSWTVELSPANAREGGPRAVRGLAGTVILAGFFWKASTPGPGASRASDKDIMAEKPATPELTPQFCFSTRTLRDFLRLSRSSIDDSITQNLNALITPSRVGFDPSSTNLRSSRPSLGSIDPQACQDFRDKVLFPSWEARSEVINYCGMVATSPDTEDPDAELREIENQKDRERVVDERLDPYSGRFFPREARTEMLATLMRQERGVENIVRARTWEVIMQRCEGGGSGTKWEDEMARWRDRKRAESIERAGK

SEQ ID NO: 1796 - protein, 715 aa, Unknown
  Kingdom: Fungi, Phylum: Ascomycota
MGRKPNPLILEYFVRGPKLNDNSNRYPHTCKQCGENFPKGRIDSLTTHITKKCPAISDSDRMRACLELHGLSTARAAAAERNSLLNGQINSAQAAVSALPQGWSALETLAEASRQVDLSENNRVPKGDAEDGTPAIATVEEQHTTDRFELQEPFTLDNPPISFEAAMKGDQSEPTLVSTTTELTPEERLQALISRDTPDPSSLSVAVAATARLNPSFLDPQLVQNESTEPKLQVEPAESTGTAVERNDVSIQETNPPITINKPTEMQPWGEMTYMTTASPLPMLTENPNPPMPMNRGGVRMDTGDLGPLGKARHSRARFTPARRKEVQEVRKIGACIRCRILRKNCGKGTPCDTCRKVLSPRVWRTGCVRTRLHEQLDLYSAGVQVVLSQNRINMLKSQLRLHNNDTVVEMSHFPEMDLNVVCPTLVALLEPLESQVAERQSEEPFHQVIMIDQDSDDVPDKVERYMRAVLPHFIEREPSKFMRTTLETATQQLQENEDELLRKALELWGLVESIDRERQWSILEKPGGNAEEARWIKEANGETEADIYTMICMQLNAAAERKANSTSRNLLSMMHRLLQDSKVKIGFNMFLTALIFLNCVEKSTWAFKAWEQDHLRPGWPLERDPGVFTQQGDTLAGLLKMLLTIRKALPQTSRSAEGKLVTEDKDPMVLNYFQSIDLDFDATQARQQGSQFSPADSRSLELMFCSQLLLPTVG

SEQ ID NO: 1797 - protein, 1218 aa, Unknown
  Kingdom: Fungi, Phylum: Ascomycota
MQSSPGMLTKFESKSSRAKGIAFHPKRPWILVSLHSSTIQLWDYRMGTLIDRFEEHDGPVRGVDFHKTQPLFVSGGDDYKIKVWSYQTRRCLFTLNGHLDYVRTVFFHHELPWILSSSDDQTIRIWNWQNRSLICTMTGHNHYTMCAQFHPKEDLVVSASLDQSVRVWDISGLRKKHSAPTSMSFEDQMARANQNQADMFGNTDAVVKFVLEGHDRGVNWVAFHPTMPLIVSAGDDRLIKLWRMSETKAWEVDTCRGHFQNASGCLFHPHQDLILSAGEDKTIRVWDLNKRTAVQSFKRENDRFWVIAAHPEINLFAAGHDNGVMVFKLERERPAAAVHQNTLFYITKEKHIKSYDFQKNVESPTLLSLKKLGSAWVAPRTLSYNPAERSVLVTSPADSGSYELISLPKDGSGIEPAESKRGAGNSAIFVARNRFAVLNTANQTIDIKDLSNNTTRSFKPPHGTSDIYFGGTGNLLIITPTQVHLYDITQKKSTAELTVSGVKYVVWSNDGLYAALLSKHNVTIVNKTLEQVSTLHETIRIKSATWDDTGVLLYSTLNHVKYTLLNGDNGIVRTLDQTVYLVRVKGRNVYCLDRSAKPRILQIDPTEYRFKLALIKRNYEEMLHIIRTSSLVGQSIISYLQKKGYPEIALQFVQDPTTRFDLAIECGNLDVAVEMAKQLDKPSFWNRLSSEALAHGNHQVVEMCYQKLKQFDKLSFLYLATGDHSKLARMAKIAEHRGDFTSRFQNALYLGEVEDRIQMFKEIDLYPLAYMTAKSHGLDEECQAILEATGATEDQLTLPKIGSPLTPPKPVVPTYKANWPTKASSQSFFEKALLGQVEGLSLEDDGAATNVMDLDEGMGEDATARNGAALEDDEEDVAGWDMGDDDVPEVDDFVNVESAEAGGAGSSEADLWARNSPLAVDHIAGGSFETAMQLLNRQVGAVNFAPLKPRFLEVFKASRTFIPATSGLPPLVNYVRRTLDETDPRKVLPIVPRDLEHLASNDLQKGYDSMKANKLEDGLKLFKGILHTILVNAVSSEGEVAEAKKLIRSAAEYALAMDIELARRRQGTPDVLAKDPEKLKKALELSAYFTIPKIEVPHRQLALLSAMQLAMKNKNYNSALSFANRIIANGGATKIVENAKKTKAQCERNPNDAIEIDFDQFAEFEVCGASFTPIYSGDSYEECAFDGSKYHSKYKGMVCKVCEVCEIGKHGSGLKLFA

SEQ ID NO: 1798 - protein, 384 aa, Unknown
  Kingdom: Fungi, Phylum: Ascomycota
MADLSTCPPLTRASVVEAHRIVAPHVHRTPVVTNRTLSELASRPRAAEELRGTRWEGRTPAAPRMRLWFKCENMQRVGAFKVRGAFHAVERLMREEGWLEGGGRDKGVVTHSSGNHAQALALAARENGIKARIVMPDISIPQKIAATKGYGAEVVFSGSTSPEREAAAARVIAETGARLVPPYDHPDIMLGQGTMGLELQEQVEELLAAEKGDKTTNKKNKTGLDAIITPCGGGGMLSGVALSCEGTSIRVFGSEPMFQGADDGKRGYESGQRVASVSTLTVADGLRTPVGEHPFSVIHGRRLVSGMFSVTEEEILAAMRLVLERCKMVVEPSACVPLAAALFDEEFRALVEREGGEEGWELGIVLSGGNVGVDALGRMFGEAK

SEQ ID NO: 1799 - protein, 611 aa, Unknown
  Kingdom: Fungi, Phylum: Ascomycota
MDSSIPSSTLNLRGESNAAIDAAAPTGTIAPYTTALNGVNQEMNMYLKRVLWWTLGALGLFILTIRIAELLWSKLRLINAMSQPRNKQNYWRTAQWSWMPWLKKHVIYAPLWKKRHNREIRLSSVLHFGTLPSRLHFIILFVYLGCNFAYMFLLNWHNENRYAFCAELRGRSGTLALVNMVPLIIMAGRNNPLISLLQISFDTYNLLHRWMGRIVVLEVVIHTVAWAIPMIAAAGWEGIRHKIVTDLFIGSGTIGTVVMVIIAIWSISPIRHAFYETFLNAHIVLAAVAIVCTYVHCITSVHPGGLPQASWTIAIACIWFADRLARVIRMMCANWGSKGFTNAYCEAMPGDATRVTLTLPKYVDIKPGTHAYLRFWGVNSWESHPFSIAWVEHDYDDSLPVHEKDSLPVYDRAGRTSVAFIIGAQTGMTRKLFNKANVSGTITMRAAFEGPYAGHHSLDSYGHVVLFAGSTGITHQISYIRHLLDGYNNGTVATRKITLVWIIRSHEALEWVRPYMDSILRIPYRKDILRIQVYITRPRNPRDVSSASSTVTMFPGRPNIPLLLAKEVQEQIGAMCVTVCGAGALADDVRGAVRAVQGESSISFIEEAFSW

SEQ ID NO: 1800 - protein, 592 aa, Unknown
  Kingdom: Fungi, Phylum: Ascomycota
MRLSQALRRSIKGDKEKQNVNIAPKAAVAIVPPKKVIRALYDYEARSTQELSFSRGDFFHVIGRESDPDWYEACNPALPDARGLVPVAFFQALGRTERDSQQSDGGRPPTASKNPDHDSGYSDSTAQQPVQSAGAAPMRESQRSSKSAGKPSAMVYGIVMYDFAAERADELEAKAGEAIIVIAQSNPEWFVAKPIGRLGGPGLIPVSFVEIRDMASDKALPNPGDALKKANIPKVEEWKKMAAEYKNSSITLGKFEGGVNPQGALEQGMDRLSLQQGGRQNSQVSQQYGQPDGSRTVSQQAVQPQQFASESNTDLFAPVQARIPRYCFAEDKYWFVIEAMLEDGRHWELSRYYEDFYDFQIALLTEYPAEAGNTGTQKRSLPYMPGPVNYVTDAITEGRLHNLDAYVKNLLNQPPYISRCNLVKQFFAPREGDYEIDPTNNGEEYRLSQGSQGSAVSPGGGQRNYNGGGYGGQNATPRQMNSHPGMERQQSSLSQPSSQSLGAGQDGGMPAEAIKVKMYYNGDLIALRVPKDIMYDQLRERIQDRLKLPSPERMRISYKDEMSGEKPTLSSDRDLDDALNRNPKLMLYVDLA

SEQ ID NO: 1801 - protein, 300 aa, Unknown
  Kingdom: Fungi, Phylum: Ascomycota
MAPLPQPSPAFISRKQKILEQLSVPDESYTDLSPKGSVDVGIRDLIAEVNAIDGLVTTSSCAGRVSVFLEGIKREDGGRDGQIATPGGKGAGGQWLFVSHDPVKDGSEEGEDWPEVFGLNGRGDSGEGGKKRLIHFKFEPMILHVYAASPQHAQLILRCALIAGFRESGALNITSSPSESTETPTPMVGIRSMGLGFESLIGSQTSGLRKQLVSSEYLVELARIGNERFVENAVRIERFREALRKAVAGDGRIGDRGGAWEDAETRRERKRAEGLRRKAEKESEERRTDQEAKEEVSIPW

SEQ ID NO: 1802 - protein, 234 aa, Unknown
  Kingdom: Fungi, Phylum: Ascomycota
MFDTKHLLFLAPLASVALADLDLSRDDVPPPCRAICQPIVDLTQRCEVDLPGDNNDRQEDLLERQCVCTNDSFDVGRMAGLCASCFQQNFRAPDDNDDDNDTEWDDDDIREIMRDCGFSSASYSAQLSTAAQTVNVVATAPTASSQLTTTINPNNSPQPTDTNGGDSRSSDDDDNNSNASQTSNNNDRADQTSSSGTPDETDFAVPGAVPLGGFSAAAALAAFGAVAAGGAFLL

SEQ ID NO: 1803 - protein, 398 aa, Unknown
  Kingdom: Fungi, Phylum: Ascomycota
MILDTRALRHLASEDWKVLAAVEQGSKNHELVPTSLIEKLSRIRGGASGVHKSIAALAKAGLIAKMKEARYDGYRLTYGGLDYLALHTHSSRKDVYSVGSRIGVGKESDIMIVADEKGVQRVLKIHRLGRISFRSVKSNRDYLKKNQSGSWQYLSKLAAMKEFAFMQALREEGFPVPEPLGQSRHTIVMSLIDAHPLRQIASVPDPAALYADLISMILRLAQHGLIHGDFNEFNILIKETPIKTETGEDTVKVEPVLIDFPQMVSMLHQNAEMYFDRDVNCIKRFFSRKFHFKSDEPGPFFEDAKKMVGANGCKRLDATVEASGFTKKMMKDLEAAIREQEAKRNEKGEADGDLGDSSADEDGLSDEEGALDGRFDAPDGEADVRSDAGEEASTELKS

SEQ ID NO: 1804 - protein, 314 aa, Unknown
  Kingdom: Fungi, Phylum: Ascomycota
MVGSSLSWKISRILIPTAGQLGRRDLMFVVSLQIGRSCVVAMNAGRDSNHITYLRLPKDPNYFFVGPQYHALHHVDPQNYFSSMFRLLDWVLGSAVTLRGRRVAMTGSSGAFGQALSKRLELEPVKCIKPLRFGIEWTYDSYATLAPILADTDILIIAHGSKDCHQSSRANCDSVIAIIELFKRVRSVSSKPALLPEVWNVGSEAELHGAWSRQMQHYTRGKRAFVPFARAYYDDETIVYRHIVPAAFSSSMGPALVTARWAAVMALWWIHRGARYVPVTYTGIAYLNYFRFRYYVKPCKASTNHVDSEDNSIG

SEQ ID NO: 1805 - protein, 1338 aa, Unknown
  Kingdom: Fungi, Phylum: Ascomycota
  misc_feature (444)..(450): Xaa can be any naturally occurring amino acid
MSELSPRGVRFSAGEEDMRAERLKDPRLSTVALESEDSSPESNGDPNANDQDDDLGGMDRYVDASRHSGSIGSLTPSASMNSVNKSQRSNGGDDGSSFNGTWPQRPLGPTRTPSNTYNPGSSRKPAPPQSAPSFVDSMRSSSKTRPRQSESRFRAQERAYIQKLRQDYSGEYFASYEGTNGNDSDSEGETPSSEGPFDERYDEETIMFYNNETLQPTEEDLQNKENRERLEWHGMLAAVLMGNVVSQEKQRLHGSSDKEVGKTAHKTELWMGVRAKVCGRRFPVQRRMVEEARATVDRTLDEIIKFTVKGASEVGKPPYEQVKDVVSKIEKCESLYPSWKAIKAEHKAADSTAFNEAYDSILSWYNTNEMINTELAILKKWVGNDEMDFSRTKQRSPAVHGISSDETSFLDRLMKEDGLRSLYNDDEKSTQKGMLRPISTIISXXXXXXXPYLEELLTLISFPSRLIEEITRTRLAYARRVKETAQQNPLMQDQMISQFQLLLRFAIRIKAEYLAIAAPEPGWELPPLIDESFDQVVLEALKYYFKMLNWKLSGNRNTFKEAELLFEQWGFANEIGSHLLRGEVEVAEQFSSLTFKALNRLSLSFEQELKARPKESASDMSKRYKACLDSVRVRHRMLQRFSRNLSEQYEHACDFSINFPLDEMQRIYDQLLTTGHFLVNTGIFEQDGVYILASAGLRDRLDDIQTLMAVTSKETFGPEFSDQYLLILRPEEPLSWFGLSISLSLREQNIDLKRGQVRLCATGSVALPIARRIFLDAVDTHIDLIQEHRSNIHKVNTRLMETRRVAYKLSNTFMDSVETIRKQAEGKDCQELIQTCFVFATEFGQRSLQSMDTNRRQMNNIKLTKLALDWIGFIVDDCIASDRKTFRWAVQALEFAMRMTMGRHILALGEEDYALMRDKVAGCMGLLISHFDIMGARSTLAAQAEKEKLEAMVGQFKRMDHNGMLLDDAEASRNITDQRMESLDRVDDYRRGKEAERQALGRVLEANTEADRSLAYLSSSATNITMRWQQGHYVGGGTFGSVYAAMNLDSGHLMAVKEIRLQDPKLIPTVAEQIREEMGVLEVLDHPNIVSYYGIEVHRDRVYIFMEFCSGGSLASLLEHGRIEDEQVIMVYALQLLEGLAYLHESGIAHRDIKPENVLLDHNGIIKYVDFGAAKVIARQGRTLVNDLTSTKPNKSMTGTPMYMSPEVIKGENPGHAGSVDIWSLGCVILEMATGRRPWANLDNEWAIMYNIAQGNPPQLPTHDQLSPSGMDFLKKCFARDPKKRSSAVELLQHDWIKAIRSQVVEPATPTDSSGSLQSTPIATSSSSRGSAGPDGFY

SEQ ID NO: 1806 - protein, 583 aa, Unknown
  Kingdom: Fungi, Phylum: Ascomycota
MTVAAFLRHGLRLLVPLAVACTIYLYLYPLFNGCAFPLPSGDTIEAFDATKRLHWPYAASDQVAGLPSKHAPFRLLALGDPQLEGDTSIPTKQLGTLPHLKMIFERVTFKQHHPSVSDRIRMTLHDTIDFYFEDIPNLLESWRKRFDLFGNDFYLAHIYRTVHWWTQPSHVTVLGDLVGSQWIDDDEFERRGARYWNRTFKGGERVPDDVAIWPKDEYEPSGFLDGRPGEEVWRSRIMNVAGNHDIGYAGDLTEERLERFERVFGKANYELRFELPITDPEINATTRDNDPKSHKLPPEIRILVINDMNLDTPAKSGPLQDQTYDFINKAIYTSAGVEYQGHMTLILTHIPLHKPAGVCVDSPFFAFHTKEEGGGVREQYLLSADASKGFLEGIFGVSKDRSAAGKGLGRPGLVLNGHDHEGCDTYHYVNHTHGETPEDRKWESIRWEDAKAKRIPGVELLPGRREITVRSMMGDFGGNAGLLSMWFDQDTWEWQYEYATCPLGRQHFWWFTHILDFLALLGVGVYGIIIGLSAVGINIDAMLCRGWQLVRGTVMHMTLSEARQGSQGVLETKVRNAAVPKAT

SEQ ID NO: 1807 - protein, 543 aa, Unknown
  Kingdom: Fungi, Phylum: Ascomycota
MAPQTIFVNARFLDTEGAAGPSLVNEERDCMVVSGSNISHLGRASDGVVHLARESGANTIDLRGRVVAPGFIDSHVHLLMFGASAQKLDLSSCTSLAEIRETISKFCAQNEDLPRILCKGWLQSMTDGLALASMLDDLDPRPIFVDAMDLNSVWCNTAALDLLPLAKMQEACGEFVTSDANGKPTGLIAEKAVTAFVWPMLASLSTMEENHACLDEAIDQYVAAGYTGVIDMAMDSNSWTALETYRDSKGIPFHVAAHWFIPYEEDRKALLDHVDEAIEMHRRWHPSRFPEFCVIGVKLMCDGTVDGCTAALSYPYGNDPDFVKPIWPADAMELVVKRASDAGLQIAIHAIGDAAVTQAIEAIAKADAPQGRHRIEHLELASVEDAKRLGRLGITASIQPVHSDPAILKGYANLIDPSTFDAAFPYREMAKGNACVAIGTDAPTARHLPFPNLYNACTRRSALDPSLKTQTNPKSALSLGQALSGATAGAAYSRFAEKWTGSLKTGLQADFIVIDEVHAPDQLQQTRICETWARGKLVYAAKQ

SEQ ID NO: 1808 - protein, 528 aa, Unknown
  Kingdom: Fungi, Phylum: Ascomycota
MASQRLARDCPHPAAFNLLEATSLISQQRLPFTIQKRETPQVASHIPIFGSSKPESQLKSMSHITLAQQGIAAVDARRWDEAITKLSTALQTSQNPNWLIARSKALVGAKRFEEALDDANLAWHNAYSRNKRDALAEAQYRRAVAYFRLKQYANADCCCIYSMRVIKGHPAVEKQDPADKLADENRFWMQTLDDALQESKDEEKDGRTEGGIAAALGDGGSKVSKEWRMASAMRLQILSAMEKLPKDDPARKVSTSLKPPQKKLADLQSGDQPEAAKSTAGSNTTTSTAPVAPPTVPADAPMRLQDFQNDTTMSVSIFSKGNKKEELQVDILPTSVTLNPIIHPSGDAKLFRLELWGEVDVETSKYTITPSKVELSLKKKTPGKWPQLKAEETKAGQSNESSEAAEEERLKLETLKEARKKAMEAADKANTQSTTSTTKTGGPAYPTSSRSGPKDWDKLADDSDHEEDDGVNTFFKKIYKGATPEQQRAMMKSFTESNGTSLSTDWNDVKDRTVETKPPEGVEAKKWD

SEQ ID NO: 1809 - protein, 276 aa, Unknown
  Kingdom: Fungi, Phylum: Ascomycota
MPLTTRLAPRLRQLCSAIPPVSRSFTTSVNLAKEEWPQRTPLGPYYESIIRQPTPYPFEEKPEEPPNSAEPEVLPEDKKTDKPAAPLPKKKKPGRKPKNDTQNEKAAASATIATPPQPSTEASPVPSPPPTSAQEKARIVFGTRLAGPTDRAERLNALKSRSQYIAGVLVPPMPEEPDNCCMSGCVNCVWDLYREEMEEYTAKNKEAQARLQAAQSVDSDGGGSQEGLGVNVGDTKIAKDLWDEDVFKNVPVGIREFMKQEKRLKEQHEREGTSGG

SEQ ID NO: 1810 - protein, 301 aa, Unknown
  Kingdom: Fungi, Phylum: Ascomycota
MSERKVLQKYYPADFDPRDIARRRGPKQTGPRIQTVRLMAPFSMKCTTCGEFIYKGRKFNSRKETNQDDKYRGIQIFHFHIKCTRCSAPIIFRTDPKNNDYAMVKGAIRNAEPWRNKETEGETDEQRLDRLEREEAEAAGEEETNAMADLEAKNADARREMAAADALDEIRYRNARINRNEKDGMDYADTIVRSEDEERERQEREDEEAARKAFAAARASASSSTGFVNDGATNSAGKGATGLEEPGEDGFVKPALPASALAAKEHEAAVSSGTGAPPAFKRVVKKKKDHSALLGIKKKAV

SEQ ID NO: 1811 - protein, 780 aa, Unknown
  Kingdom: Fungi, Phylum: Ascomycota
MKFAHFTLGLLALVSPVAAAWSKEDREIFRIRDEIAAHEADPGATFYQILGITKSASQDDINKAYRQKTRSLHPDKVTQQLRAERTKGKKKGAKGPSQSEINAAVKQASERQARLSLIANILRGEGRERYDHYLANGFPLWKGTDYYYNRYRPGFGTVLVGVFLFIGGAIHYFVLYMSWKRQKEFIERYVKYARDTAWGGNLNIPSPEPEPSTPDDDEGPPQPMNRRERRMRDKENKKESGRPKKAKKVKSSASSREASAGPTGQKRRVVAENGKILVVDSLGDVYLEEEDKEGNVHEFLLDPNELPQPTVKDTAIVRAPLFLFDQTIGRFIPRKAEEEQLDVVDDDSLDEPQRTPSDSAGEDFEMLDKSVDSLGKAKSTGTQKGDKPSKRKGRKNLGHYYVEAKRGARSLFVASKLTPQHSCLLTTPPLPQLDHWVTALISRTESPSPTMVRKRPQTRGTLEPARPEHLNSSSKPDFSLASCQEAASSHGPNVSNAGTGVLLLTIDKIPDWYGDNPYIHTGYRPVFAAVAPCFQSWLYLHNQTANIFTHLVPGVLALVLNGALFWLFRQYYPEATFWDRLVFHVYLTACSLCFGTSAAYHTLLCHSHEFADLWVRLDYVSISVLILGSFVPGLYMGFYCEPVLLRGYLTVIFGMGIYNGYSSLQDRFGDKNWITSRLLPFVGMGLSAFIPIIHAAFLFPYEQLQRQSGLNYYYLEGVLMLIGIFFLASRFPERWLPGTFDLCGSHTIFHCFIVAGALSHFAGIWSGYDWNYTHRRCLAM

SEQ ID NO: 1812 - protein, 273 aa, Unknown
  Kingdom: Fungi, Phylum: Ascomycota
MYSERPLAKDHDPSDSLDTESLLSDEQSQEKLLHSLPSPTSKRNKRLKTYLHVAAVVFYSVLTATLYAWSVRINAKKCECENAAVYSPAKAAIKYEKQMIVHNLADNGKYRGPPRPEQDAAWEDLLRYNNLRVQKEDLDKANATSVPLNDDQGGYLATLDVFHTLHCVNKIRKSYYSDYYHDPNPLADQQEHFDHCIDLLRQVVMCHGDVSLHTYQWKEDYRWPWPSMQTEHQCRNWDKLMDWSKEHYIPSLTGPILSHPKLGTSFRGDEPHS

SEQ ID NO: 1813 - protein, 568 aa, Unknown
  Kingdom: Fungi, Phylum: Ascomycota
MASNIDFALYESPVGYALFKVVSQADTVGLKLKETQDSVNDISKFSKMVKLANFSPFRGHVEALENINLVSEGIVSDYLKNVLELNLPKTSGKKTKIVLGVSEKNLAGALKAAFPGLECETADTSDVVADVIRGIRLHAEKLLKDLKSGDVEKAGLGMGHAYSRAKVKFSVTRNDNHIIQASATIDFQDKGVNQFFMRVREWYGWHFPELIKIESDNLTYAKLVLAIGDKKTLSDEKLHDIAAVVGEDGEKAQAIIDAAKVSMGLDISAADLEIVLSFAKAVVKQAENRKTTSNYLDKKLGSVAPNLQALIGTPVAARLISHAGSLTNLSKYPASTLQILGAEKALFRALKSKSNTPKYGLIYHSSFIGKAGVRNKGRISRYLANKCSMASRIDNFTEEPSTRFGEALRQQVEDRLEFYATGKKPAKNSDVMHSVMQIIDGEGDDDEDMDDAPAPSSAKKEKKDKKEKKEKKDKKEKKEKKRKHEDVEMEDAPTPKADGKPATLLQRLSLFRSSVVKDEDEGKKDTIVKVEPAASSTESPPPSKPKTKRKQRQRAFFSAADEEWTGLD

SEQ ID NO: 1814 - protein, 407 aa, Unknown
  Kingdom: Fungi, Phylum: Ascomycota
MADEREWNDFINAAIEERRSDINSINRLVHENPELAYQEFQAHDNLVSLLTKLGFQVTPRICGVRTAFAAEFGSGGRLVVFNSEYDALPGIGHACGHNLIASAGLASFLGVADALRKSGRPGRVRLVGTPAEEGGGGKLPLIEGGMYKDAAACLMTHPGPQYLLRGRCQGVAAVKMLANIKWRIFFSGEAAHAAMEPWNGKNALDALCIGYVAVSALRQQIRPAERLHGVFTRAGDRPNVIPHVTSLDYYVRSDSLASAERLWQRVKNCWDAAALATGCTVRYEPINSYADVRSSSVICREFCDTMDAYGHEVSYDDPIDFLAGSTDMGNVTYECPGFHGSFGIDTEVGQGNHTEGFAKAAGLEKSFDRNMDWSKGMARVAWKVLTDDEFATKVREDWEEDMKRAKA

SEQ ID NO: 1815 - protein, 369 aa, Unknown
  Kingdom: Fungi, Phylum: Ascomycota
MSSTQSRLFEPVKIGTMQLQHRIAMCPMTRCRVTDGYVPSPLVKEYYKQRACVPGTLLVSEGIVASKNMVGGFPSPGIWSTEQIAAWKEVTREVHGQGSFIVAQLFGFGRAATEEGLRREGIDHVGPSAVPIDRHHPTPRAMTIAEIKQVVEDFATASRNAIEAGFDGVECHGANGYLLNQFLSENANQRDDIYGGSIENRSRIVEEVLQAMVDAVGADRVGLRLSPFSPFQGMSVRDPIPQHQDVIRKANSLGLMYLSMVEARISGSTDDDDDAKPAGNIDFSYDAWDGPILVAGGYTAGSARDLVDVKRPQSDVVVLFGRHFVSNPDLVHRVKTGLPFSEYDRATFYINSSEGYIDYPASEGFAEAR

SEQ ID NO: 1816 - protein, 283 aa, Unknown
  Kingdom: Fungi, Phylum: Ascomycota
MSQLQNFETIFRLDGKTALVTGGSRGLGLHMATALLRSGCSHVIITARKREGEQGIDQAVEKLNRLPGIKGRAVGIAANVGDSDAIVRLVEQVKDVVGGKGLNILVCNAGAAWGSRFEDAPPHSSVKILDLNVRGIFELVQKSLPLLEKAASKDDPARVITISSTAGTNVPHVGEHGTIMYSTSKAAANHLARNLAVELGRRNITSNIIAPGFFPSKLAQGLISNLGGEDELSRDNPMGRLGEPEDIAGVVVFLCSRAGGYVNGVDIAVDGAARLAAGRLSKL

SEQ ID NO: 1817 - protein, 367 aa, Unknown
  Kingdom: Fungi, Phylum: Ascomycota
MKSILICALASVGLAAAAPHRPVETRCEAGHSWAGVNSFFLHAFQKKDRLDVLDAVKAADLKVVRLFISETFSDFKRTGSVYMPDVEPKEVGVYDDTQLKAIDQLMVEAHRRGIKLTIALHDRYQLGCWGNDTYVEKYHLPAVDCALGSVKQNNVEWWYRDANAIRDFENRIKHILEHRNKLIPGQPAWKDLSSHIFAFNIQNEGQGHLNNNIAPHPSWWCDRANFMRRIMGGGNEFPNSDIPENWACPALDIVNMHSYSGVAEFRQKGRIALDHALAANKLMLFEEFGATGAKKPDDIAAHIAVFNELRVPWMPWQISKPGNGQADFEFWTDEPTYGVVQREAKRAAQLTAAQSWNVGKRGKPKAH

SEQ ID NO: 1818 - protein, 323 aa, Unknown
  Kingdom: Fungi, Phylum: Ascomycota
MNDSDTTLSIPTTTAPTDTSDPACPSAGLAFRNIVSSPRSSTHGIPHHHLPDTLPWDSGMSSDNTHDEKNIHHHQEQQEQEPQPRGAKRLCNGLFKSFRACKQRNGDSASSASGTSSIASEPCRPNRSVEEFHQRSLPHFPSSDLLFPQPALEFDFRIAVKLRPEPSRIDPRPDPRRAAAAAAQHNYSATQQQPPQPREITAVSSGSWSGSFGHGKVLAGGYDLGQARGFRPIRIVEGVFVMQTTDDTPAILEMRTRGSLSGPCDVLDALLSPIHTPKTIDPRRYGFRMFSTIKTTDKRYAEIVNCGLWVAGGVWRGDELIIE

SEQ ID NO: 1819 - protein, 886 aa, Unknown
  Kingdom: Fungi, Phylum: Ascomycota
MASSNTITVTLSQVAKMIDHPLLHPTMTDADIMEGLEISKKYGVATACIKPYATPMAKKILGGTGVGVCPVIGFPHGNSTTEIKVIEAEAAAAAGGEEIDMVINIGMALGGNWDYVANEIRRVNEAVAKHNAILKVIFENDYLQEAHIIKLCEICSEIGVAFVKTSTGYGFVKQSDGKYSYQGATVSHLKLMRKHSKPEVQIKAAGGVRTLDDLLHVMSLGVTRIGATATIAIMEEAERRGITDAPTKVTFKPIGRPLVSPPPPSTTSSTQRAGVIGVSGSTVPVSSSTSTPATHTHRHSVPGSPAPGDDSLIPHPDQRVGYLGATSFSAVFEETQESLAEFRGRHKALGREMHTNCETAARIAPDKSAEEMGVRILRSIPTKASCYHLLKIFSNPNDGWVRLAAHRSVDSLWETFGDILEGEREETRLTELSRLLSQNSATPVHEGGPHDGASGGATWLAGFTGTNMRWETLGVLFTYWSFGTISLTENDATVECKKCFRSDRRRFWQQYKEAAYRASTWRLMGETAAMATFLGLHVVPRSGPGSYSVATEVRRRNFAAMYIIDKVFGTFTGRPPLLGRRFVSSELPLDVSDETLLDEPPEQWFSHVDENGWNTEGKVYSTTVMRARATILVIRDEILELALDSPHSAVAETSYENLVRLREKAIDATKAFPSHIIFSPNDNKDPFVEAPVLYVKLLIRLEHLGNLFFIERLMIKHHPEHNTDLLDISFEMVSLTLVFWTHKDRLAGLQGDFEWIVMSCAAPAGGILCTELLKPTRTQNPSNGNKGGGKLSATRSSVIQQLSLLVGFLDWVGPTAPNGDLCSSTKNVIKHVLDVALNPAADATDLLGGAGEWDVDFSVDLNDFFNFELLDTFDWLRPEDKQAQAA

SEQ ID NO: 1820 - protein, 656 aa, Unknown
  Kingdom: Fungi, Phylum: Ascomycota
MNSLKIPDSGLRLQASGGDGLPIPPQAFFLTLEDNAIEHMIRAVQSGQELSLKLGSEPTLKYGSNTHIITPPSDSLPYDLYLTRPFESTKSAERLPCTGSLFRKPKTSTSSAKPKAIKEAEKKGSDRSKGSSSSGLESDYETLRDGLAAEEAARGRYGPQGISNVVPVKLTSSRTQIVDKALAGKRGTLKNRGLSPASLPPSPALRGVGSPSGPVPSASQQAMERSKYYRAPLVHELAVEDRTLEYLREKWDGNESEMLPALNKIADQQPDGKTWTMRRAYYKELDVYSYAYDASEEREKAIKNAVKAFDKMRLSSREPEWERLNAPEDRGKGICLSSLQAKIATKEPPPPAAPKNKGQKADDGSSKDEGSTTDSGKTSKGGESMARSSSNPLPTKAKKPNTADAQAKRLLSNKPKPATSSTVLKPSPTKGKGGKSGDGRILSQEIIEDSDVSDDEITAPAPKSKPVAVTAKPTPKEPEGKKARPVPREPTKPAPVKRQREDDDSSSSSGTPLAKRIKGRTAALPLKPKTSQTLQRAAAPAPPPRAKDTSPTKSSPLASSPPTNVSDMDDATPPPQPIKKRHNEMDKAHGIPRKKSRVITEEVITLASRFKTQYARYVKLHREIEASANPSQEDIEGLTRMRNRLATMKSKIHEAV

SEQ ID NO: 1821 - protein, 401 aa, Unknown
  Kingdom: Fungi, Phylum: Ascomycota
MPNNTQQQAAIDAASADSPFHIQTYPSAEAASQAAKSKKRKRASGSVAPAQNAFLYQKAICPLGGKFKSGQDLDMHYTVIPAQQWTEAKRYKSFRLNDTSYTSGEFVYVANPDTVENQRNLGVRIPTDEWVAKILEIRAVNEQNVFARVAWMYWPQELPKRTLDRGKYVQGRQPYHGKHELIASNHMDIIHAMSVTEHAKVDQWVETEQDSLLDALYWRQGFDTRTMELSAVALTCRCQTPTNPDELLVGCTNDACNTWLHKDCLVDDILMKTWERKGLENSTAVKEEEDANGYVKMEQGATPEKFSNGMKRETSSARSTPRRGASSTPVPPASLGRAGSVRGKGKKASTLKPYTGKYEATLRTDDGPPRFEMQDLRDGVPEAQRQWTESVHCLLCQHVLE

SEQ ID NO: 1822 - protein, 256 aa, Unknown
  Kingdom: Fungi, Phylum: Ascomycota
MDATATATSAANGQNGAGTPSSDYKLKFCTVCASNQNRSMEGHLRLSQANYPVISFGTGSLVRLPGPTITQPNVYQFNKTSYDTMYKELEAKDARLYRANGVLNMIGRNRDVKWGPERWQDWQIGVPRLDHATDKGAEGVEAGLVDVVITCEERCWDAVIDDLMNRGSPLNRPVHVINIDIKDNHEEAAVGGRGIVDLANSLNQAAVEEREAVGAAAFDAGGAASRASFDERVPEILGAWQERWPKLPATWTLAWF

SEQ ID NO: 1823 - protein, 345 aa, Unknown
  Kingdom: Fungi, Phylum: Ascomycota
MDIVLEVTDTFIGDYMWSYFLPARPAPSDYADAAYANSTAQTFSAWTYKPSTHLFSLEPSQAAYMSSFPRDDPLRQLVSLYFITWWFGLVLYFVFSSLSYYFIFDKRTLNHPKYIKNQVWLEIKQANTSMPIMSIIYAPIFLLEVRGYSKLYDLTEEGPGLWWDFLQFPAFIVFSDFCIYWIHRYLHHPRIYKHLHKPHHKWIMPTPFASYAFHPIDGTMQGLPYHIFPFLFPMKKWVSVLFFVFVNFWTILIHDGEYLSNNPVVNGAACHSLHHSRFEVNYGQFFTLFDRLGGTYRVPEAWMFEKEKSMSAKTWQAEAKTVENLIREVEGSDDRVYGDDTKKTK

SEQ ID NO: 1824 - protein, 584 aa, Unknown
  Kingdom: Fungi, Phylum: Ascomycota
MAPSARPLIAMATARPIAFAGANIASKSFCTASRVSALRPAARPSVVAPRINASARLAFRRAYADQAPKSKPKPGAIRRTFRWVWRLSYLSVGGLLGYTAWMIYEDRHPQPQYEADPTKKTLVILGTGWGSVALLKKLDTENYNVVVISPRNYFLFTPLLPSCTTGTIEHRSIMEPVRAILRHKKAAVKFYEAEATSIDPERKVIKVFDNSEIKGATSETEVPYDMLVIGVGAENATFGIPGVREHSCFLKEIGDAQRIRKKIMDCVETAAFKDQTKEEVDRLMHMVVVGGGPTGVEFAGELQDFFEEDIKKLVPDISPQFKVTLIEALPNVLPSFSKQLIDYTEDTLREEKIDIMTKTMVKRVTDTTVEAEISRPDGTKELVKIPYGLLVWATGNAVRPIVKDLMSKIPAQKDSRRGLAVNEYLVVQGTRDIWAIGDCAVAGYAPTAQVASQEGNFLARLFNNMAKTESTEARIHELSSGLNLQQGNAADAASEIESLERQLRRIKDVKPFRYSHQGSLAYIGSEKAVADVSWWNGNLATGGSMTYLFWRSAYLSMCFSTRNRVLVLVDWVKSKVFGRDVSRE

SEQ ID NO: 1825 - protein, 1307 aa, Unknown
  Kingdom: Fungi, Phylum: Ascomycota
MSASTSNRNWTLKPLPPGPATATGTSPTCAGQGRARLLQAGSSGIHHVTTEPKVSLSKHNLAAQGGQRLRQQQQQQQPDAREPHQPRSRAHATPRSRLTSSPPASPPSPHQHHHHQLGPRATPIVSFASSFLSFASALLFPPQSPLFPPESPSSSTPDQESTPANALTLRRHRRRLLASNNHHLLAPVSERGIPPNNYPLPTSGYNASASTAVGRHPFAFLQTQHPPFVATSSFLGVPGRVYLLHWSFKLSSPSFVFEAAIIPNPSAACHDITVCLRQRLSSPPPPCKTLTDLPEQQTTSSPPNRLLLDYETSSLATTSQSDDDFSRCMKEHDHVSRCQRISEQLTIITTLPQTPSAFQAMNDPPQLLRPTRQLPSHSPTRHRHTASVSDDFLLQLAPHSCVDALASPTGSLRACLDGASASERDFTMRTAVASKMIWDWVQELSEWSWPSQGGCAGFEAPDTGSRKSAVHVTGPEEENKEQVFMGSLRAEDVALYEARIETIQRDMLGLEVEDIKSHVLSDHILPLSRPSTPMSGVSRSSTLMSVSSYHKMEDLSAAITAIVIQTLPNLAKLSRLLQVWGTRLRVLQQVPRLLLAIEDAEVALLSGWNAITVPAKMAQQLAPGNVENPSLSREHYAVMKSVIEKKVTTGGWIADYMLDCLEGQADTLPDEWLDRLEKVEQDYAEWVATCERKVSETEWMQDIPLRERRSEIASDTEESDASNGNHNEKAHEQTHSHEQPVEHMNLGTLDTEPSTITTDTSITPPTRTIQQLNDLAQARETKDDLVFDSPEVADAPAPQGALGLDGANNDSYTPYLAPSLPIVAIADADTAANHHAMGTDAVMDEDSAYPDLDDDIDLPALRPDSRRNSDASQTSTVLHGPSSHFEGSDMPEISASPGIVHTQIREAEYISTSPPSSPPLPQEGELEKHKVQLADISAIGTVPEEEEMPRTPLDESFIDDDDDSFSVSEAAMGSPSKRRESSGDIHLRQQISQIIESIPAKIKLVNETPNVNLNPPDLQLPKIRKKPSIDRFKRSGSAMSTMSSRSGTPAFTLSPAKNSRPSRAQRGQQEIKVYHLSRSTGEAPIKLFIRCVGENGERVMVRVGGGWADLSEYLKEYASHHKRRSAAGDGPKVEVRDVPGVPNGRHTAIGSSPPSRPGSALDSPHTPLNVRKARRSSGAFGHEAPRLQPRTPAAVGADDSLGAIPQSEESMRSRSSSRLSWVEDDSSFLGLAGPSGKRVEMSEENKAWVESVKEKVRLASGERKIPPLGAVGSVSDDLNSNKGRFGELGKVGGTKRLFRKGEELRKK

SEQ ID NO: 1826 - protein, 454 aa, Unknown
  Kingdom: Fungi, Phylum: Ascomycota
MMAKVFRGSFIHSKTLDELEILEDAVLVVDSSGTITTLQQAGGDDIEALIPDNAESFKLGPGEFMIPGFVDTHNHAPQWPMRGLGQGLHILDWLDQVTFPIEARFADAAYARKTYENTVADFLRQGITTASYYGSRHAEATRILAEICLEKGQRAFVGKCNMDRNAPEYICEKSAQDSLQETKDCIEHIRQLPGCGDGELALVKPILTPRFAICCTPDLLQGLGDMMRADKTLTMQTHFNEAEQEIKATRELFPEKAAKSEADLYDSFGLLSSRSVLAHCTIMNDYDKDRIKELECGVAHCPIANMTVGGGFMAAPVRDFLRRGIKVGLGTDSGGGWASQMLGVIRQAMIASNAREVMSEGRDKGLQIEVAFYLATLGGAGVMSIQDQVGNFEVGKKFDAVLVSTTTDLQSAMTPREEDDSLRTVFEKFIMTGDDRNIAHVFVGGRRVAGTRSL

SEQ ID NO: 1827 - protein, 480 aa, Unknown
  Kingdom: Fungi, Phylum: Ascomycota
MPSPTDDETPFPRLDRSATFNSFGRSHLSPDDAFTSPPLRSYGAGNRSVERMDGERSRSRRRKRAWKKLMWVKQSYPDNYTDQATFLESLQRNPRLKPYDFWPLVADSIVILQHVCSVIIFLVCFVGISKDHVSPVSVVSWSSTASFVGWLLWERWVTEEDEAAELLGPGTSSVSATVMGRTGSIRRRGRAGSLYRPLPLKDAAAIMNTGPSSSLSNVVSASDSAASSSSNVDVAQEPSNSSSNLSLGSNHGSSQLHTPRASQETLPQFPPPMFAEENRTHQRLGTIKSAILIWSTLLGMSPILKSLTKSTSSDSIWAMSCWLLAINIFFFDYSGGVGAKFPASLSTNAALMASTVLASRLPSTKQVFSITLFSIEVFGLFPVFRRYVRHRSWRMHVALAVVLVLGAGFGMGMTLGEGPSHRWTWTNGIVGMVVNVFIAAIATGGCSWWLIGLQKYKNEIRGPWDPARPIIMSRTRWDEK

SEQ ID NO: 1828 - protein, 1088 aa, Unknown
  Kingdom: Fungi, Phylum: Ascomycota
MEVPSPPQSPLRRPLPAPPQNAQAQAPFSALSFRSSISSSSSSAASTNADAAAAPPQPPPPRRGSRLLQSRHGAPSAPNEGARGLDSNKLQIRVVPYSPPRLSSEGSLTSSSRPVSYAASDAAAASASASPTVRRASTRHGFEYGSPRPDVSDPDPNVLVHAQSPYHQSSEQSELPHALAASASVAFPVPPTARRLVPRLPGTGGIGSADPGSGMTPGNDPGLPVNASSASVLSPTSQPDRPSSATSSIGSRSSHRSRHKRVVNLHANNKTFSLAPLSGSLSSRTDSSTTGLSLLATPSSSYGRVSSASALYTDDRPISPLTSVGEQPASHTRSAGSPVSTLTSIPDTTTASAWDSRLVGGLRKVKDAPVDEPESEPGPSRIASNFASYSSSQESLPSLPPLAIKKSSSDRLASASLVRKSSFHSSEFSQSDLAVSERTNYKVYGQSSPVLPSSYHPAEFDTLPPSTSQSNENYHIIAQSSPPTAFRPRTPEDVGTFLPSSSHSDVNYRVIDQSSPVVAVRYRTAERNALPPSSSHSNANYQILGESSSEVNSLYESRRPQTGESDANYVVHHGGTSTSSLGTSRSRIRPEYSQESLVVPPLRPGRQTSFESLRLAAKRSRDSLRSGSFTSLSSVITQEAARALFAGPASIYIPPSIRKENSSRGTLARLGAHSGPSMIQAHPHQWSSQLSTVPSESEPSSRSLSPISEAARRSSFFSQRSARMRSISSSLVGPMDNLSRSGSHSIPESIDRPQAAHMRHGSREDSLSPRLIRDHDEDGDGLADLEDLRHKHSRARLSSILSHQTSDRNLRSSGSSRSNSLTSSLPAWARVYYGSGERRFVVTHPSSESMYSLYNETPRSGSRSGSRSGSFLRHSPSAERFMMPIRNSRRRPREQQHHSVDEAIRQDPTQEPQDEIEQAESHPVLQVARRIRKQTSSIWSPHLAHDRRAARYSIWEPPSTTWSEDAGIISRRNMQVILFIAGFVIPIGKSAHRLLFDSTVADNQLAWMIAALLPLPPMSKPELAEQLQSTSNVDLQQQMPPQYMQAIDQIRYNSARWWRNLNRIMSVVGLLIIGAIIALAVLGVQQRF

SEQ ID NO: 1829 - protein, 786 aa, Unknown
  Kingdom: Fungi, Phylum: Ascomycota
MKSTLFVCGFLAAAANAHYTFPKLIYKGETSADWEYIRKTQNYQSHGPLTDTTSSEMGCYQLASGSEGASTLTVSAGDEVGFGLDPQIQHPGPLSFWLAKAPDTVEDWDPTGDVWFKIWEDHPTITSSSITWETDPLNDNKGSSTVNVTIPTCIAPGEYLLRVQHIGLHSAQQVGGAQFYIGCAQLNIKGSGTLEPSSKVALPGAIAGNDPGVEIDIWWPIPTASGDRALASMLKFGQRPPPFEQTRVCAKRRKRCAGTPSIFLAPAISSALRLDSYVHVQGTEWGSWFLRAAEQGMRIRSSSPIHPENRLHEDKKSAVTLYEFRQWLCVMSSWGRRWSRIGTPIRLNSVSRVASLETPLVCFSFRIEDPDTQFTTCDATHATPTRAVSPVLNLNEDKRTKNTSLTSCGAPVRDRSRHLAAHTYTLFAFAMLMMVIRIGYKLFMRLDFGMDDWLLIASAVTVIAETTIAATELLPSGMGKDIWTLRADQITNFLKFWYVIAIIYFLQTCLVKLAFIAFYMRIFTTQSTRRILWATFVAVAAWGLSFIFVGIFVCNPVSYIWTLWDGQHKGKCVSDAAYVWANAGSNIGLDIWVLAIPLWEVRKLQIHWKKKFGVALMFSLGACVTVMSILRLQSLIQYQKKDNVTSEFADVFVWSSIEIGVGIICACLPTLRLLLVKVWPILAGTTIRDSHHWYHRSGKASEVSRSTRHSVYGKPLPATPTNPGLGFDRRYGVSRTISINGRNVSSKAGKPAGIAVEESFVMETHEHSDISLVSIKPEGKDGRSNV

SEQ ID NO: 1830 - protein, 1595 aa, Unknown
  Kingdom: Fungi, Phylum: Ascomycota
  misc_feature (1101)..(1102): Xaa can be any naturally occurring amino acid
MSFRGDDQRRYGHVPPVQYPVAGTQASNVGRRPSFNSGDDAAYYSQPPDRTPAFGAPQPMPGADELFLTSPTSTSSPADRGSYASPTSALSGYQHQYQDPNQAPPAPAHAAYNPQSFQSTSQAGFQRSQSTQLPYHPHPNSRYSAVSSNPYNPSSPTSYTPAAYNPAAYASAPQRQPTYHGYNSPDQGYAAQRPPSSYGQSPASTYSSNMGQHSPSLSQGYQHPQQSPGYSSGNGGYDPSHYASGGQYAQHSVNGATIGQYTMTSQAPYPVTSQMPAGPNYAAQDPNSFYSRSSRSNSQTSPLASPGIPPQTSPGLQRHPTRAPLPSRPMDDLPEDSRWISGSPGYDDDYPYDNLTQESIMQDIEAELDRVSPGPSPRPANGRRPHGEPEQLHRLDSTASSQYMSTTTSSLGHASSHSTSSRPLVSQPVYEEEDDDPEGTAGVLAMQQAELDDRRFSSNAFGFADMPALPAQLPPQPEEQTHSSDSDFGGGGMDLGMLSGGYPGNLTYGNEYGPSPGQTSSIDTNRPLPATPGEFPISSETYDRAPALRNAEIDYGGTGGLQPPTAHRLSFDDGEEQVSIHSRQSGTESPVKEDYQELFYHPGISNRPLPRVPQGAESDSSSMLSVNVGHRGYHQNSLSLGAANASSHMAADSGLQPSEYGAYNRSTSPQYPERSISMNSHSNTPQIQAPARSRTDAAEERKKFHRQQQMLSQPGSAHPDQDPATSSSMGAFDGITLPTGRKKKFVPSKLSPGDFKRCAEPWALSGIEAWVREMAEGEQDLREKKVEEALINLFVHKVPTMNVADAEALSNRVVSIMLASGTLEPDEEWVKFGSGHISGVLWQLTGSGCYAPKLHNEEINGRCYSYHCTRTLKKVDLENPDLVKSTDDWHVFYHLKKEDWESKPKKEVDRQNILHEIVTGEDNYIKQLDIFRTLYRDDLRTRNPPILHPDRRDKFLTAVFGKLDTVLRINKENLLAQLKYRQQEQGPWITGFSDLFREWIRKAKSDYIDYAIGYPRAVYMVRKEQERNLLFKKFLEDKLKHKSSSKHDWTHFLIAPLQRLQRYVLLLESEVKDARGEKKYDISKEPIPMPLLFLESMNEEXXCHEAEGHRSTTQTLGQTSSNSDEKILYPFKVKHLGHEVYTLYASSARDRLDWCTRIVETKTRHAKALFSQNAEPFRLRVLADAAFHYEPSSMHARAVGVPVKGTPLDRAIEDLESILGSGQGIAPVCRAQVNCAAGFTAFGKAIIAIGTDYGVFISDPSNPRGWTRTVQATRVTQIAVLEDFNVCLIITDKSLVSYPLDVIAPISEFAPPVNDNPRRAPQRLAKDVTYFATARMKDRMLVFYKRKESLHTIFKVLEPIMQKSSEKKSRLFSGRKGGSSATDTFRDYDEFFFPTECYSLSLFQSYIAVSTAKGIELLTLDKKQPMSIPDLKAPSIANIASRIRDQRPLGMFRLNDNEFILTYEDCAVYVDKHGDVSRTLIMEYTGKQKKARSATMYGQYLLLFNDDYVEVRNAENGRLRQIIAGRDVRVLDHGVRGPTGGNASTHWEQSHGKNGGMNTLDASKGTVKIAMSHPELQGRQIVLEMLLNDGHTETS

SEQ ID NO: 1831 - protein, 271 aa, Unknown
  Kingdom: Fungi, Phylum: Ascomycota
MDTAAPPSFPALEDRPLKNTICLFDVDETLTPARLGISPEMLALLNALRHKCAIGFVGGSNLPKQEEQIGKPAGVPVTTLFDFCFSENGLTAFKLGQALPSNSFIQHVGEEPYKEFVKFVLHYIADLDIPIKRGTFIEFRNGMVNISPIGRNASTEERLAFSAYDKDAKVREKFVAVLREKFPHLGLTFSIGGQISFDVFPTGWDKTYCLRHLEAEAKKPGGITYSTIHFFGDKAYEGGNDWEIYSDPRTIGHAVEGPADTMRQVKELFGL

SEQ ID NO: 1832 - protein, 139 aa, Unknown
  Kingdom: Fungi, Phylum: Ascomycota
MMSGEAWLFLLAVLINAVNLFLQVFFTIMYSDLECDYINPIDLCNRLNTYIIPEAAVHAFLTFLFLINGYWLPLILNLPLIAWNAKKIIDNTHLLDATEIFRKLNIHKKESFFKLGFHLIMFFFYLYSMIVALIREDSS

SEQ ID NO: 1833 - protein, 426 aa, Unknown
  Kingdom: Fungi, Phylum: Ascomycota
MFRQTIVWLKIIFKILSIAGSELKRQLRFARVRLQRRFSEQAAPPGPAKNIVVVGANFAGFFAAEILAKSLLPSSGYQVIVIEPNSHFQFSWLLPRFCVVEGHEHKAFIPYEGWRKNLPDGILQWVKDRVVSISRSHVKLQDGTEVQYEYLIIATGSGVKEGLPSRVNHTEKLEGIRRLQEMQKGIKAAKSVVIVGGGAAGVEVATDAKDLYPEKQVTIVHSRDSLMHRFGKKLQDEALEGMQKLGVDVILGERVLAEDAAMGTVTLRSGKVLHCDKFVNCTGQKPTSGLMKELSPSSIAETGHIRVKPTLQVADDTLPNVYACGDVADTGVPTPNARSASRQAAVAADNILASIRGQQPSYAYEYSWPVDSFIKLTLGLYRSTTYMGDGKESVVFRSKEKIDLMSEFVWQRFGSKPFEDDTLKSD

SEQ ID NO: 1834 - protein, 1620 aa, Unknown
  Kingdom: Fungi, Phylum: Ascomycota
MPNPAAGGHQMNGMTQFPPPPPRYPGSASTPAGMVAPPPPGPPPGSAMGQQAPWHGNFGRAYDSRSGLVPPPPPSAGHQPYNPQHHAHLSGQTMAHPPPPPPPNEQMSATYIPQGDTYGEVAGFPAFGPDDWVGASGATMPAQSFYTSTASNPQSATDTNQMTPLDTMQSRGLSNASSATNTTNTTSSIPPEVAAQWPLETVLLWLAKNHFSKDWQETFRGLNLYGAQFLELGTSHGGRGNLSLMHKQVYPRLIHVTTTSGTGWDPAREREEGKRMRRLLRNVNSGKPSEGYSMGNHNTHNRRESGTSAPPGSLPSAGTDQAESPNPLQTPGPGFSAKRYSQSRSTTMPTLTNNTMSSEPAHRSTLKGLENDRRHSPNVGEGGEGGLFRGTAMRTDSPEGSPALGSGTFAPAMSASPNTTKFPHRNPRHSMDSQSSNAAIYGSGVPADAASMLSRSLNLNEALASARSPTDRPRISPVDTGDRSAGTEPPSSAKGPGFLSFLSRKKKQKEDGSHHSPDDLESPTSDGFTKPPFANRSATASDTHLDRSSNSSMPRGRSDSHARGPRLFVLATMDYWTYRMCDITDAETAADIRQVVCMNLGVGNYERSSIYLTELGKFDHSEPLDDQKLLQQRKAKADAAGTLKFFVAPAWKQTNADGSTTTVSGVPLALSPGYLPPGASLDAETYDQLNGRQRSSSSPPSSRSNTLMGEQVDDQALAQEASEYRAIMERKQREYLAKRKQAGKGTSPTALEISSGYGIVGRNVDFDQPRNSPFEDKKPDQLFPQRKPPAPPSDPSATLIKANSLSRKPGHNGRPSNGSMDGVPTPRHPSTWSPDNESPDRARKGRYASGGSAAAGGIGAALVGMGRNLGAVGQSSANSRAISPGRTTTGSDEVPQSGKTFSPTASHDQLDSGSSGRKSKSGSPGTLTWSPGSVAFMVPDYVRGQPPRLEEWSRPSSPTSALAELPPAIVPPTTETSPDSMQQRSTFPQETKRRQSGQHGENGDSNVHFTSPKSVARRPMPSQDDSDDSDDGLFAIPLANRNKGKAADKSGHAHRPSLTLKTQRSKKKLSVSFNSPQSSGLEGTDETSGTRTGGSTRRTPMTPASDSWESEQSESRLNRRKSFIEKDVWANRPPTDALLNNLDDFFPNLDLDQPVLEDSVDGEPGPSPIPEGDENGEGSAPHSATAPELHTASAIPPSRQPSLYTNDGDTLGSDESTLKALERPSSYQNVAQRSMRRSGGLGRMKSIREVARGAHEANKRYTNTSQDMGKSSVGNGGNYNSNILRRKSTKMFNANIVQIRPDQRGSMVMPQVPQDMLPKRQTTFRWFKGQLIGKGTYGRVYLGMNATTGEFLAVKEVEVNPKAANGDKAKMRELVAALDQEIDTMQHLDHINIVQYLGCERKETSISIFLEYISGGSIGSCLRKHGKFEEPVVSSLTRQTLSGLAYLHREGILHRDLKADNILLDVDGTCKISDFGISKKTDNIYGNDKTNSMQGSVFWMAPEVIRSQGEGYSAKVDIWSLGCVVLEMFAGRRPWSKEEAVGAIYKIANGETPPIPEDIQETLGPLAVAFMMDCFQVNPFDRPTADVLLSQHPFCELDPNYNFHDTDLFHKIKGTFNKNE

SEQ ID NO: 1835 - protein, 136 aa, Unknown
  Kingdom: Fungi, Phylum: Ascomycota
MAAFIKAANAKIRSNPWTDYLCSTHFWGPVSNFGIPIAAVMDSFKSPDLISGKMTGALCIYAITFARYSVAVTPPNYLLLACHVINGGAQFTQMFRFVNYNYMGGREKLAVQAEKAKDVVQDKAKDAVQAVKDKTS

SEQ ID NO: 1836 - protein, 327 aa, Unknown
  Kingdom: Fungi, Phylum: Ascomycota
MPLTNATSTIDSPAKPNLGASLIDTLPDQMQSFIRLSQARFSSNLIQTHPRFFSAQAILHYTMATNEANGSKPAAKTNVVNGKKEIKILMIHGFTQSGPLFRTKTRAMEKLLAKALTPFSIHPTLIYPTAPIRLRPSDIPGYTPSPNSNPDDAPDMWAWFRRDEASGTYRSLDEGMATIAEAIREAGGVDAVCGFSQGGCMTGLVTAALEPGREIPEGKAGNWARLLREANAGKQVRFAVSWSGFKAVPEDFAWCFEPKIHVPNLHYLGSLDTVVDETRSQELIDRCENPQVMVHPGGHHVPVSKEWVMPLAAFVKDHAQGEPRAGL

SEQ ID NO: 1837 - protein, 156 aa, Unknown
  Kingdom: Fungi, Phylum: Ascomycota
MAAAQNLVNAVDGAHDPPSGGFDDTVSPHYSHPFTPDAILTLRCWYTANKHHPYPSQEDLESLCAVTGLEMLQVVNWFANAQCRCNNIGKPPTAPTDPELDLHGNMKVRRQNLHHQDHRPATMPRGNAATACEPQHVEGIDPPQRRTGSSLKNETR

SEQ ID NO: 1838 - protein, 181 aa, Unknown
  Kingdom: Fungi, Phylum: Ascomycota
MKFSATLALFPLLALAQNNNGEGNSAGDVVDDVVDGITSDIPSGAQDIADDIRSTVENIVSGASTFVEGIASDASTAATGIAGEVTSAVGEASTALSSFVDSVTSEARARQSSIESELESATGSRASSLSEELGRITSSVDEALSSASEAVQTSTDDKGAVPTAAVAMGALFGGAAVFANM

SEQ ID NO: 1839 - protein, 826 aa, Unknown
  Kingdom: Fungi, Phylum: Ascomycota
  misc_feature (623)..(626): Xaa can be any naturally occurring amino acid
  misc_feature (648)..(649): Xaa can be any naturally occurring amino acid
MSGHADDPKKKVNLADVSGAEIKNEDDTATAILKKKKKPNQLMVTDAVNDDNSIIALSEATMDSLQLFRGDTVLVRGKKRKDTVLIVLADEELDDGSARINRVVRHNLRVKHGDMITIHPCPDIKYAKRIAVLPIADTVEGITGSLFDVFLAPYFREAYRPVRQGDLFTVRGGMRQVEFKVVEVDPPEYGIVAQDTVIHCEGEPLQRDEEENNLNEVGYDDIGGCRKQMAQIREMVELPLRHPQLFKSIGIKPPRGVLLYGPPGTGKTLMARAVANETGAFFFLINGPEIMSKMAGESESNLRKAFEEAEKNSPAIIFIDEIDSIAPKRDKTNGEVERRVVSQLLTLMDGMKARSNVVVMAATNRPNSIDPALRRFGRFDREVDIGVPDPTGRLEILQIHTKNMKLADDVDLEQIAAETHGYVGSDVAALCSEAAMQQIREKMDLIDLDEDTIDAEVLDSLGVTMENFRFALGVSNPSALREVAVVEVPNVRWEDIGGLEEVKQDLREQVQYPVDHPEKFLKFGMSPSRGVLFYGPPGTGKTMLAKAVANECAANFISVKGPELLSMWFGESESNIRDIFDKARAAAPCIVFLDELDSIAKARGGSMGDAGGASDRVVNQLLXXXXTEMDGMTSKKNVFVIGATNRPXXQLDPALCRPGRLDSLIYVPLPDEPGRLSILKAQLRKTPVASDIDLGFIATKTHGFSGADLGFITQRAVKIAIKEAIAADIERTKAREAAGEEVMDMDDEDAEDPVPELTKRHFEEAMSMARKSVSDVEIRRYEAFAQQMKNAGPGAFFKFPDAADGSGSAEAGNSFGDAGNDDDLYD

SEQ ID NO: 1840 - protein, 462 aa, Unknown
  Kingdom: Fungi, Phylum: Ascomycota
MRFSTFASSLFAVSVSAAPTSADSTVSTLEERTFLPSCQGGQYFNFLDWKCECPWGQSWSSGDNCCKPKQQGCQSGWTWFEKESCCKPQPQECDQGWYWDFGESCCKQHVCPAGQYWDDDTNCCKTHTCPTGQYWDTTDNCCKQHTCPAGQYWNPQENCCKDQTCPSGWYWDIPSNCCKQHTCPAGQYWDNGSNSCKQHTCPAGQYWDIPSNCCKQHTCPAGQYWDVPSNCCKQHTCPAGQYWDDGSSSCKQHTCPAGQYWDIPSNCCKQHTCPAGQYWDNTANACKQHTCPAGQYWDIPSNCCKQHTCPAGQYWDNTANACKQHTCPTGQYWSDKDNCCKPKTCPAGEYWDNTANCCKKHECPGGQNWDTKSNSCQCPTGQVFENNKCCKPQEHHCPTGQSWNEQANCCECPAGYVLWQKQCVKKPSCGGGSWYDAGSNSCQCKTGWAYDQKKNCCDKVGY

SEQ ID NO: 1841 - protein, 182 aa, Unknown
  Kingdom: Fungi, Phylum: Ascomycota
MALNGKLSHPQRLITTHNEEGKAVLSELSSKAPFYSLGNGDAFFAQAYVTEGFPTKLADNADLDVYNHYLNQPPGITVSKGTVLRYVDIPPDFTSPMHRTVSLDYGVVLDGEVDLILDSGETKPMRRGDVCIQRATMHAWKNTSKTEWARMLYILQPVEPFSVAGQEVKEDYGGMKNVKASE

SEQ ID NO: 1842 - protein, 682 aa, Unknown
  Kingdom: Fungi, Phylum: Ascomycota
MASTRLHQLAEHLTIKQSTKHPLDPLDGREISAAVAVVRAEKGSLYFNTITLLEPRKKDMLRWLADTSSPRPARVADVIATTKAGQVHDIWVDLEKRSIIKAEVVDGIQPTLIVEEMLSVEEYVRKDPSVIEQCGIIGIAPENMDKVFCDPWTITHDPKYGTKVRAIQALLYYRPNHDDTQYGFPLDFFPIFDVNNKKVIDMEIPPVRRPISLAEPNNYHMPDIEREGGYRTDLKPINITQPEGVSFTIDGRTIRWQNWSIHVGFNYREGIVLNNITFYDKFEGKERPLFYRLSIAEMVVPYGNPDHPHHRKHAFDLGEYGAGNLTNSLSLGCDCKGAIHYMDAEFPTQAGGVRTIKNAICIHEEDAGILFKHTDFRDDSTIVTRGRKLIISQIFTAANYEYCIYWTFLQDGTVQLDVKLTGILNTTAMNPGEDLEGYGTEVYTGVNAHNHQHLFCLRVDPNIDGQNNTIFQSDAVCSPYPVGHEKNKWGNAFTAAKTKFKTVAEAQSDYDAKTSRTWDMANENKLNKHSKKPVSYKLVSRESPALMPKEGSLVWKRAGFARHTVQVTKYKDDQLHPAGRHVVQTSGDPSPGLPAWIAENPQENIENTDVVLWHTFGITHFATPEDFPIMPAEPITLLLRPRNFFEKNPCMDVPPSYNITPTQVKEGKKGCACAASKESVQV

SEQ ID NO: 1843 - protein, 676 aa, Unknown
  Kingdom: Fungi, Phylum: Ascomycota
MLPSQLASAMHQQAQAHLQSPDATPQDRLAEARKNLQVLIDCGFSRDLLHQWVDENSHSPQLNLAQSLGPMIPSSTPQQHSPTQAQAQSQQQQSQAQQQQQQQQQQSPFAPSQPSPSSSAPHQHSPPSHTPPQIPQSVPHQQPSPQEPLGPPPPPPPQCPPPPIPTMVSNASSTASTPAIDVSQAPHAIPEHSASPWSPTHNAGLVSSMAEADSNIFLPPSAPFAHRPRISVSSTSSGSSGHASIWSNSSAHTAMSWHSAGTGFKSHLSSPTTSPTGAPLISGAQAAATSKTNIYWCTSCETSFKRKYDWKRHEDEFHERWRKYPCPEPGCNRSFWGSNSFNQHHKQCHGCTTCPHAEKVVKFLRKRKYWACGFCSALHPARERHVEHVARHFESGLTKGDWMHSRVIYGLLHQPLIHEAWDALVDSKQADYMGRRPQFSWHPSKTGRAQGFLEKENNGQLQDLLEFFSGNEGEAQFIVSSAYSLADIVLTTAGPVPSPQFNDAASLGSQMFSQDPRMSYASLSSQGSTPTPTPTPQAQQHHQQSMMHPGDASSQHPYATSFSAPVFVHTQPFAPPPPPRAGSDVSSHSPLTVSHSPVTVSPSPGIKRELPPPPQESGENLMDFEFSPAPVNFDDWENFGGAVLDDSPQPMQGPSNQIPQSSWGMMPMFNDPRVSS

SEQ ID NO: 1844 - protein, 225 aa, Unknown
  Kingdom: Fungi, Phylum: Ascomycota
MPDYTLYSYFRSSCSARLRIALNLKGIEYELVPVNLLKDEQLSESHRALNPSATVPLLVVRTGDDKTGLKIGQSVAALEYLDEAHPQGASLLPPASDLRGRAVVRALAQIIAADTQPVTNLRIMRRVRGLGGSAEDWNKELMAEGLRAYEAVAREHAGKFSYGDSLTIADACLMPAVWNAERFGVDVKGLFPTIAKVAAALEEHPAVKKAHYFRQPDTPDNLRID

SEQ ID NO: 1845 - protein, 562 aa, Unknown
  Kingdom: Fungi, Phylum: Ascomycota
MRPRLVVRRLWLPQPRINHRLSLLRAFTSHAQLTHTSSRPNLPFLNTPSTSAGSRRIRNFTSDRKRWLRRELKNGVKYTLVLWVAAGCVLMIFFAISEETTEREHPTPHEWGFFTRKALRDCHQRSDPRNGQRKWGDAVQLGAEVQRRLEDPSKDGQGVVKLEGYDLEDPDMVPCDITAKSEEWRRGYFDALMATAKAAEHTEGWLLDTTRDLNIPPEYVIGPSNPRPKPLPKGAPPAPREEDCVIAFPSAAEYYLKISRTKGLTPKQQLDARLEEAAYWEYMGRPDTAQECLAHCLVLANGDANASAVEEWIRVDQMAPVRRTSGEAPSSNMLDVMTSLANLWARNGNLPHALTTYLSVLHARRSLPTSPPVTSRDALPRRVPTYQQVINFFAPPPYPPPPPSGFSTPWRSPEERCQEAALQLHIGEILFATSSKEEGLAWTRDGVDAAEEQLRAIGPSDPTREQAERATCRECLNMGLKNWTTMVSRMAAREKQKLAEKEANGAGSSSWGLAFWRGGNGEGEGRWTAEEKIVAERVRRTKELVDDVAAPKENYLVSLFKV

SEQ ID NO: 1846 - protein, 224 aa, Unknown
  Kingdom: Fungi, Phylum: Ascomycota
MADDYQPDPRPPTLEHSSQEKRTVTIPERTEEDDERVFRLFRGWTVSERDGQTRQWVYRFGYDIQNVATKERRWVCFLCVKRKDPKPKNYNHKGLQNAESHLFKDHDGMVDPSGKWLAVKSTASTPARSIATLLRLNPEVPRDQEITNLLIKRLGREGKRNLSDDVVAMLEKRRKFEDESSKSEFEWEQEQTPDPHVGEEFWVTGRCCDYNEPSAELAQPGCMA

SEQ ID NO: 1847 - protein, 1070 aa, Unknown
  Kingdom: Fungi, Phylum: Ascomycota
MSSSSRKAVDSRIPALIRNGLQEKKRSFFVVVGDRSKDVIVHLHYIMSSMDIAQNKSVLWAYKNKLLGFTSHRKKREQKIKKEIKRGIREANSQDPFELFVSLHDIRYTYYKETDKILGNTYGMCILQDFEAITPNILARTMETVEGGGLVVLLLKGMNSLKQLYTLSMDVHSRYRTEAHDDVVARFNERFILSLGSCPACLVIDDELNVLPISGGKNVERLPPPDLDQPKTPEQLELDGIKEENQEQQPVGSLISLAKTVDQAKALLTFTDAIAEKTLRSTVALTAARGRGKSAAMGVAVAAAVAYGYSNIFITSPSPENLKTLFQFVFKGFDALGYADHADYTIIQSTNPDFNKAIVRVNIHRQHRQTIQYIRPQDAHVLGQAELVVIDEAAAIPLPLVRKLMGPYLVFMASTINGYEGTGRSLSLKLLKQLREQSTNAAALKGDTEVADRSTGRASKTDNFGAGRKLREITLSEPIRYAKGDAVEKWLNTLLCLDATLPRAKASANGCPDPNQCELLSVNRDSLFSFHPVPEKFLQQMVALYVASHYKNSPDDLQLMSDAPAHELFVLVPPVSENSGKLPEPLCVIQVSLEGRISRQSVMNSLSRGQRASGDLIPWLVSQQFQDEDFATLSGARVVRIATNPEYVSMGYGTKALELLTDYYEGRFANLSEDEDTTMQESMKRATDAELANTSLLADDVKIRDKAEMPPLFSKLMQKRPEKLDYIGVSYGMTPSLHKFWKRASFSPVYLRQTANDLTGEHTCVMLRPLENSGDRSWLGAFSRDFQRRFLQLLSYQFRTFPAITALGIDESANMGAKLDDAPTTTLTKAELDRLLTPFDLKRLESYANNMLDYHVILDLMPIIATLYFTGPLKSAINLTGVQQAILLAVGLQRKDMDAVAEELSLPSSQLLAMFIKVLRKVTAHFAQLVAEAVGEEVGDDGRAKIGVSRADATGVHDDEVVDEKYVPLATALDDELEEGGDEALKELRKKQRELIDSLPLDQYEIEGDAPAWQEAEKQVKKAARDGKTNTVVSVKTGKQKRKEGPTAADVYEEVLGDKSSRKKMKKSKK

SEQ ID NO: 1848 - protein, 131 aa, Unknown
  Kingdom: Fungi, Phylum: Ascomycota
MDAERFDAWQWVMWLLLCLAGLMPGEVAVGQTADSSSVRMSAAIAGVEQDVKVAAVGISKMVAEESTLSLASMAGRLSLPSKLDDNTSHLNLRSTLINPCLSNDRERMRSSIGRISSRLISKRALRSSIMA

SEQ ID NO: 1849 - protein, 123 aa, Unknown
  Kingdom: Fungi, Phylum: Ascomycota
MVLAAKDPNAPMAEPQQAGVKDVKSMEYHRQVFQNKKAEEPSDQYISPSDNIMSPCTAKINALRNKHASKFVCPPPIVLTAHIGALVLTVLSRRAKPKSLFAQASAKKLQSGENPLGARSIQK

SEQ ID NO: 1850 - protein, 445 aa, Unknown
  Kingdom: Fungi, Phylum: Ascomycota
MSYTIAFLSLLAAAKAQKVGTDTAENHPPITWSDCTSGTCQSVSAEVVIDANWRWVHNVGGYENCYDGNSWTSVCSSNTDCVQNCALEGATYDTTYGATTSGDALTLSFVTEHQYGTNIGSRFYLMENEEAYQMFTLAGNEFAFDVDLSTVECGINSALYFVAMEADGGMGSYPTNQAGAKYGTGYCDAQCARDLKFIGGEANYEGWEPSSSDSSAGVGGMGSCCAEIDIWESNAYAYAFTPHACTENTYHVCVDQECGGTYSDDRYAGKCDANGCDYNPYRMGNTDFYGAGLTVDTSRPFTVVSQFGTDAFTQYFIQDGVRIDVPAPTFDGISDTSEITDEFCTNQFNVFDERDRYAEVGGWAAMQEAINIPMVLVMSIWNDHHSHMLWLDSIYPPEKEGQPGAARGPCSQDSGVPDETVANFPDARVVWSNIRFGPIGSTHDL

SEQ ID NO: 1851 - protein, 395 aa, Unknown
  Kingdom: Fungi, Phylum: Ascomycota
MFNLPSHVSAQDAPVFVQGGLEDATVDDPSVYNTGGTITVNGFNMVVPKNVLVQFPAAWVPWKDFVDSKGDFLGFETLVLGNTIDGVHRVAQVITYEFFEGLASGFIESLNFEDGTIKIKNGPTVRISDPNGVFSVGYDGAPFMTADDQSPSISSFSGFPMCIPRNSTDPLCPLTNRPFKGPGTLSTAPDPLVMVPFQEGDFITFAGFRKGGEVIAYSIVAQNVQIQTLGDIVYVRMELGLLGIDNPNANAELPESRFIGFTSNNRATVALYAMDIDPCSGNVTDRILATMGLRGGRNEQNKFEYRNDILHSYTREYRVIAEINGVPKTRLTKNGILSGSYVQPVNVWVQGEQNIPGTPPPPHDFSEMGFLTKGVGRDENGNIWGKWTDLVQCLK

SEQ ID NO: 1852 - protein, 206 aa, Unknown
  Kingdom: Fungi, Phylum: Ascomycota
MSETVFAQNFLTTLSSRPVKLSADHVEDARNFPARSPYILPRMPKPMTKTTSSSSAPGQERSITLHLKSARNPVLDLKLTSQPLGTSVLDIKNEVQKQTRIPVEKMKLLHNKRPVGDSKVLKDLIGEDASANSLEFSVMVLGGAAAIPPLEAGTAASAGQEPPPLETEAFWSDLKSFLMQRLKDEKQAENLSKLFKSSYDSSQSKP

SEQ ID NO: 1853 - protein, 131 aa, Unknown
  Kingdom: Fungi, Phylum: Ascomycota
MSDQINIFTKNAPAPVGPYSQAVKTPTAIYCSGQIPLTAEGNLLEGTIAEKTRQCCQNLEAVLKEAGSSIPKVVKCNIFLSDMAHFAPMNEEYEKWFSHKPARSCVAVKTLPKNVDVEIEAIALPGEDSKL

SEQ ID NO: 1854 - protein, 344 aa, Unknown
  Kingdom: Fungi, Phylum: Ascomycota
MSVPFKVLKFPCSDGNQVLVQATSKGNHPLDLKLVGTEGSAAYRVTLKQDRIAALRVKNCPVTESEWEEILQALFQLRPPPDIQATAAVEPDTAIALTVRKIIQGTTHRLGSITLNYTESEEIGLFEWCVAAVDASVDGRKALSAVESQKEALEADVKDYKRQLDELIQAKNDDETVLLQKFRDLLNEKKLKIREQQKIIAAASFPDGGPASPEVHDSPPPTRKPAASRAGKRKAAAKDAQDGDETPEAEEMEVDSPIKLEAEDTDPGNTTEGTASTVGDEGDSDDEEPQAPSNARRASPPRPTSKQKSDKPPPPRSLPFNQKKVAAKAASEATSETDSDDDEL

SEQ ID NO: 1855 - protein, 388 aa, Unknown
  Kingdom: Fungi, Phylum: Ascomycota
MSAPTDGGSGEVHNTWIGEKSHGAFDLRSDVLTVPTSSMLAAIQNCTMKDDVFHEDPNTIDLEAHVAKMTGKEAGLFVVSGTMGNQLALRSALTQPPHSVLCDLRSHIWQYEAGGVSSLSGAMLIPINPKNGIHVTLEEVKSHIVLSDDVHACPTRVISLENTLNGMIMPLSEVRRISAFARSHGIHMHCDGARLWEAVASGAGSLPDFCAEFDTISLCFSKGLGAPVGSILVGTEKLVKHARWVRKSIGGGMRQPGLLTAAARVAVDETFGPALDGSKGLLKNTHKMAKRVEEAWTRRGGKLVHPAHTNMCWLDLEAAECQEMRFVQIMKEEGLGAGGCRLVTHYQVAQRGDEVMERLERAFDRVFKGEGGGESKEKVGQGSMYTTN

SEQ ID NO: 1856 - protein, 137 aa, Unknown
  Kingdom: Fungi, Phylum: Ascomycota
MANALTELTGPAPKPGKYVKVSLFLRKRPDLTDEYFHAYWANNHIAPAFMNKKFMEKVRRYNQHHVTAGEKALAKSYGAPVLEYDGIAELWLDSFDDWRAIVTDTDFVENVASDEGNFLDSPIHIMFGWDHLLIGGK

SEQ ID NO: 1857 - protein, 1119 aa, Unknown
  Kingdom: Fungi, Phylum: Ascomycota
MPATVGFLGLPPPSWELARRLLEGPRWREYLVKAFDGYECHASDGNALTAGGGREEPSPQDALAGSSFLVCAGDCSRDVERDVFSDSALSALAPRAVVAIMGGTALRSFFDRLSRCLALAGRSDVAVVECHAVEESGSLTLLTAGTDEALQRAEDVLRDGSDKLLAFPGNPGNASKAYTVYRLLLGSHIAAAAEAIGLAARAGLNTQQVYDIITNAAGSSRAFESRVPSMLEGDWSVKSSSLDACVRHMAPVVSAARAANFSLPLGGAAEQLFISGCSQGYGADHDSGLVRLYLPTTPDLVRDCAKSVNLKEALTPGGSPLDISKIGVIGLGAMGQGMATSLARAGFPVHGYDVFPQAVDRFAASGPNAKAAGSPSEAMRDADVVILMVQNASQVDEVLFGPDNNADALSDGAVVILSSTVPPSFTRELDAKLKALARGIWLVDAPVSGGVARAANGTLTIICSGEELVLAKVNSVLLAMTGKASNLCHVEGGVGAASSVKLVNQLLAGVHIAAAAEAMAFAARLGLDTRAMFDLVKSSGAWSWMFENRVPQMLEADWTPHSALAIFVKDLGIVLDEAKRLQYYAPIASAAHNLYLSGASRGWTKESDAGVVRLWELPGSSVAEMAGAKGAAAEGQASDDGRPPERLPASTLESLPPVYEQDVIGSVRRVVESGDVPMLVVLDDDPTGTQTCHDIDVLTVWDPEILDQEFSLNPSGFFILTNSRALPSAEARSLIVDICNNVSAAAKKANRKVEIVLRGDSTLRGHLPEEPEAAEEALGLFDGWVVTPFFSQGGRLTIDDVHYVKEGDKLVPVSQTPFAQDATFGYKNANLRQYVLEKCGSRFSESSFLSVTLDDVRRGGPAAVTEKLLSVPADPNRVIIVNAVVDQDMHVFVAGLLEAERSGRRYLFRTGAAFVSSRLGITGIPPLTMGDLGVTARPDACGGLIVAGSYVPKTTAQLQALKSHRGDKLATIELDVESLIGAVEEADSVIETAANDASRSIAAGKDTLVMTSRKLIKGHDGDSSLNIGSKVARALVRLVEKINVRPRYIIAKGGITSSDAATKALRMRRARVLGQAAPGVPLWRCDEETSRHPGMPYVVFPGNVGSDTTLAEVVEAWAI

SEQ ID NO: 1858 - protein, 1612 aa, Unknown
  Kingdom: Fungi, Phylum: Ascomycota
MDLYRQTNTLTNKTLKIILTRHFTTTLYSALILPVVASVYLGLGRQFNQPNSKFGFGDLQDIRSLGDALGNAEGGRNTVALVNNGHAGGEIERVISSVAEIVTGAGKNASRLESEDELGYVCRSSIRGTSKCFGAVVFHSSPDEGNGGIWNYTIRADGGLGLDFKVDSDDNDAQLYALPLQQAIDRSIAGDSFPSKTQQFPYTADTEDEREAKLRRDYQSSFINYLSVAFLIALIGVCYHMPGLIATEREKGLSQLIDAMMPATHGWHRQFARLISHHNAFMVTYMPGWIIAAVICRIMIWKETNFGVLIVFFLLSGIAITSMSLLGASFFRKAQLSGVVTAVVWIVLGIIAQALTNPGTGPVVVLSLLFTPCTFVFFITYVARYEQVGRATNLLNAPPESPWNLPGIVLWVFLGVHIFAYPVLAAYLERTFHGVTTGVRSSGPSKAGQSGASAPDVVRVENMTKIYQPSFLRRLFSFVSPPRPKVVAVDNLTLTAKKGQILALLGANGSGKSTTLDIIAGISNFTSGNVSIDASGGLGIAPQKNVLWDELTVEEHITLFNQLKSPHKHATREETMALIDAIGLRQKAKSPSKTLSGGQKRKLQLGMMLTGGSAVCCVDEVSSGIDPLSRRKIWDILLSERGSRTIIMTTHFLDEADLLADNIAILSKGKLRAEGSSAQLKDTFGAGYRVHVLNSRKIQHAPQVVGVDCKMEANTMTYVAPTSALAAEVIRVLEAENIPYRFSGPTIEDVFLNLAEEVRDEAAYGGSAQNAGRPPLAKEKSPFGSEDTVLPNGGSKGAAQGLLPGRTIGWAKQIMVFLRKRLVVFKTNWIPYVAAFLIPIIAAAITQILVRNEGAVGCLPSEQSSQDSNDDFEELVNTAMIVGGPSSKFDSSSVLNLLKPLLPGGSGSGNGNGETSAGNVTVKLVDSLDGFKSFIEDNRKNVTPGGWFLGGSGALPTVAYKADKYSMLTAVITQNLMNSMLANKTIATTYSIFDSPVAPGTGKALQVVVYFALACSIYPGLFGLYPNIERRMNVRGLQYSSGARTLPTWAAHLIFDFSIILVSMALVTVIFAASSDIWYNIGYLFPVLMLYGMVSILVAYFFSLFLGSSLATYAATSVLQGLGFAVYMIAFLYILTFSSAADADRNILIGHWVISAIFPTGSLVRAFFVALNTFSASCDGDKLRAYPGDITAFGGPILYLSLQAIILFSLVVWFESGSGKFNTGMARKSNEVDDPEIANEVDRVDGPEGQKDGLRVVHLTKAFGNNTAVDNVTFGVEHGEVFALLGPNGAGKSTTISLIRGDLATSKRGGDVFVENASVSKNRPLARQNLGVCPQFDAIDSMTVTEHLEHFARIRGIADVKHQVDAVVRAVGLGAYTNVMAHTLSGGNKRKLSLAIALTGNPSVILLDEPSSGLDAAAKRIMWRTLETIIPGRSILLTTHSMEEADALANRAGIMARRMLALGATDSLRHRFGDTLHVHLVSKTAPHSTPEEMDRVRTWILGTFRGAEVEQETFHGQMRFSIPTGSVRELQKRKGGRPGADAEDTGSAIGQLLIVLEENKDALGIAHHSVSPTTLNEVFLTIVGQHDVMEEGYRREEVHKKPWWKKNIWEFF

SEQ ID NO: 1859 - protein, 388 aa, Unknown
  Kingdom: Fungi, Phylum: Ascomycota
MRQPHLPLNVVPAPPLLHSSIPPRKVTNSNLAPKLHYHNLEFAIASSTLCKPTGPKKPPIYHFLEVFKLQPPNMAAVASNRPKYDLLETPSRPSRSSIANPANRQDWADDDDNEETSTDLPPPQTVSNKDGTKTIITFRYNDAGNKVKTTRRIRYTTHTETVNPRVADRKTWSKFGASAKDGQGPATDTTSVGENIIFRPSVNWRKDEKEGEADEGAKAMKAQLKDKQVKCRICSGEHFTARCPYKDTMAPVGEATPTTDVAAGMPDEPSAAGPGGKKGSYVPPALRAGGGAGERMGGSKYGERDDLATLRVTNVSELAEEGELRDMFERFGRVTRVFLAKDRETGLAKGFAFISFADRGDAVKACDKMDGFGFKHLILRVEFAKKAA

SEQ ID NO: 1860 - protein, 499 aa, Unknown
  Kingdom: Fungi, Phylum: Ascomycota
MQHYFILDSIDARNEDFASRDEDHLISRSKSSLQSRDSTPPNVTISDTTAFTSPSSPTITTRASRHDKHLHSTPTLLFFWPSSLTLIRHLTTGALPCPALPPYPCLAMTSRRRSNIPATPRVISPSPTPSERENLEYNGPVTRSATRSSRVSTPQPVAEDSNEESDAPELRRARTRSRSPIETRRPQRLTPRESLSRQSTNKADSKTQSPSTNGQTRVTNGHLAPPQPATPSGWTWRDFSRSPSPLGLIPIHRHWRTFVHKHEVPRKALHVSIGFFVVWLYLTGTQTSSVPPYLMAGLIPIAASDWLRHRYETLNRTYVRLLGALMRESEYAGWNGVIFYLLGAWITLFFFPKDVGVMGVLLLSWCDTAASTFGRLWGRYTPRIRRGKSLAGSLAAFLVGVATSLFFWGWLAPSFGPFPGDETFMFKGTLSLPAIVTQALGIPAAKATIGGSLALGIMSIWSGFVASASEVVDLFGWDDNLTIPALSGIGLWGFLKLFG

SEQ ID NO: 1861 - protein, 713 aa, Unknown
  Kingdom: Fungi, Phylum: Ascomycota
MADRQYLVRFGPNANCTFELCTIDESVYGYRPSLPANIAFAALFSTATIVHIILGIKWKTWWFMWCMILGSTHEVAGYVGRIILYINPWSFVAFIIQIICITQAPVFYCAAIYVLLGQTIENYSPSLARFPTKYFLWIFLPCDIISLTLQGVGGSLSAASSGDDETGVNIAMAGLIFQIVTLFAFCGLFGDYLVRLFRSAKPGQISPRQRIYFSFLSLAVLVTLIRCIFRADELKAGYHGELITREDLFIGLEGVLIVVSIFCLCLGHPGYAFNDKTIRYSQVTRGEVTGQLLPHGIEMAPKPAVDRYYSSLTPALAVTLEDRATAFFVHHYVRQGHNGSLSAPGARGTNEYLPALLREECVSDALKKVVAAAGIAAMANAGNSTASWRGEAYTLYTGAVRQLRSDLYDPVRSKLDHTLAAVMLMGTFEVIASGDASSMKSFGHHTPEDSSYAVQTYHQLQLAIPYSLKCWSHWAETIQSEEEFAANRFSEINERLANARAEIKQQRISSPSVIASRLLKFDDEIEAWRRDLPASWAYKSYCSVRSTRSPPSEVFESHYDKYPDLWIASTWNNYRSVRLLIHEAIIAATLKHGSEEEIANLTASMAVLARMARDICNSVAYIMGRGREGSRSPTPEDGNGSASPGGYLLLWPLFLAGMLRTTRRVQRAWITSEIRHIGTTMGIHLAISMARVLVEHNKSFSDAEVWFIGQFYP

SEQ ID NO: 1862 - protein, 403 aa, Unknown
  Kingdom: Fungi, Phylum: Ascomycota
MASTVPRPGPANLTPNAGLDEWLEEAKQCHYLPERAMKELCEKVKEILMEESNIQPVCTPVTVCGDIHGQFYDLLELFRVSGGMPGENNVQPPKTATTVITSEDIEPPSEITNPKLRKKLRSPIPGSSADTQQDAAAAAPAADTSTASAGSSPGSGPVPTVTSSQSAENRFIFLGDFVDRGYFSLETFTLLMCLKAKYPDRIVLVRGNHESRQITQVYGFYEECQQKYGNASVWKACCQVFDFLVLAAIVDGEVLCVHGGLSPEIRTIDQIRVVARAQEIPHEGAFCDLVWSDPEDVDTWAISPRGAGWLFGDKVANEFNHVNGLKLIARAHQLVNEGYKYHFEESSVVTVWSAPNYCYRCGNVASIMSVDKDLNPKFSIFSAVPDDQRHVPASRRGPSDYFL

SEQ ID NO: 1863 - protein, 420 aa, Unknown
  Kingdom: Fungi, Phylum: Ascomycota
MHSKTPFADPLWLTRGISPYYTESHRRLQEEVRAYVEAHITPFCAEWESKGVVPQEAHQRHAALGYVAAAVFPLAKDHLHGQRLPGDVPSEEWDAFHDLIVIDELARCGYLGIVWALGCGNSIGSPPLVQFGNEEQQRRFLPDILTGKTRFCLAVTEPDGITTTAERRGDKYVVNGSKKWITNGIFADYCTAAVRTGGEGVSGVSALIIPLKAPGVTCKKIDNSGVRASGSTFIEFDDVEVPVTNLLGQENKGFPIIMNNFNHERLWLACTALRMARVCVEDAYNYATIRETFGKRLIENQVIRAKFSMMARSLDSTYSWMEQLVYMSDRAKREGVDAKMGGLFANLKVLAGQTLERVNREAQQVLGGLGYSKNGRGARIEQVSRDLRVMVVGGGSEEILADLAVNQEVKAARTYGAAKL

SEQ ID NO: 1864 - protein, 138 aa, Unknown
  Kingdom: Fungi, Phylum: Ascomycota
MTSSFASHGRGGAGNMAKASESPKLTASDLQTPTLKTSVVTTGRGGQGNMAKNTDPAETRLRQDVEAVLRRESTGAQHAGRGGAGNVFKGEDLSNLETTDAAIEDDIASDVPGDKEKNGEKLEKVPSKGKNWLFGKKA

SEQ ID NO: 1865 - protein, 532 aa, Unknown
  Kingdom: Fungi, Phylum: Ascomycota
  misc_feature (383)..(388): Xaa can be any naturally occurring amino acid
MSIFESLDNAVTGLFGSWNIYSTGLATALVTLVTYRIATIREPDVHPMLLARQSVPSTVRHEGESAVYRAQAAPHSMPLNGGLNVKNPDAAKWSRGRDGDLRDIWRKVVLGGDEGAKGKLLTALGAQKVVEHKTEDITRQINLIGQHIVDQGGIRVAIYLPNSIDFLAALFACSFAKNLTAVLIPFDVSHDALTSMLRRAAVDTVITVPGFFPLDAVVKAYPALRQLIWVVEEGNSHMDWSEVPEGTGGSVNVATWQDIINEAPAGAGTELGSSSADTTPQDVVTFWQNKSGQPADMVRFSQANLVAGIAGQIAAVPSRDRLGPSDLFLPVDPLTNIHTLTLTLAALFSNTSVAFNSVAGRECDLVLATRGVSPTIVVASPQXXXXXXSSSCPIYPFASGTKPVVGNEPGRLRLVYVADRAGAGDAQLASSVLSDLRVFLGARIIYALSAARVAGAVTQTALFDYRVEENDKTHFGAPVTSVEVFFKDTKDLKTTDEKIQGEIYARGPSVSGGEAALGVMGKLNEDHTFSYA

SEQ ID NO: 1866 - protein, 1107 aa, Unknown
  Kingdom: Fungi, Phylum: Ascomycota
MAVPRRAMYFNPEAQKWHSSPSAELDDAYQFHKSMPGYAPTDLIPLDDAAKQLGLGKVYVKHEGDRLGLPSFKILGASWGTYRAVTKAYGLPSNADIATIRAATATSSTALFAATDGNHGRAVARLGNMFGMHAKIFVPSNMDAHMIAEIRNEGAEVINTGKSYDDTILEAARGSNSEVGILVQDCGFGDYQELPGRIVDGYSTCLREIDTQLGDQTADLVVVPVGVGSLAQAVVAHYRRKGSHTTVLAVEPDTAACLWKSLQKGESVSIRTTPTIMNGLDCGTVSTTSWPILKAGTGASVTISDQEAHEALVDFDKWAVRSGPCGAAAFAGLRRLTDGDKEALHLNKNSVVVLLSTEGVRPYKIPRDVRLADAGLLTEQLTNIMSISSRSGKHERPVETSIAEYVMSWLEHRDIECHWLETVTGRPSVVGVVRGTGGGKSLMLSGNLDVKLGSHGRLVGPDKAKLHGSKVYGDGAANMKGGLAANMLALAQAKTANLRGDVVLVAAAGGHGANAGLQQVLAANWRADGAIVTKVTDEDLVIKSNGTLSLEVEVEVEVQGDSDSSEDLETDPVTQAAYFLVELDRYRRKKNGYKLGLRDGLQRVQVLEQADSSSSCIIALEWETIGEETAELVRRAIQAILDNVSRKRPSFRFFLRVTSARDPVDTPAAHPFVSLALESIKRTLGRSPAVRNNIDWADCAVLAEAGITPLAWGPIGVETGLSKGTEEWVNIELQRITLSIIAAMASPQQIRTPITDMFGIKHPILLAGMNVAAGPKLAAAVSNAGGLGVIGGMGYTPSMLKEQIEELKSYLVDKKAPFGVDLLLPQVGGNARKTNYDYTKGQLKELIDVIIESGTTLFVSAVGVPPKAVVDKLHQGGVYYMNMVGHVKHVKKCLDLGVDIICAQGGEGGGHTGDIPTTVLIPACVKEVQGHKSPMTGRPVQVIAAGGIHNGQLLAASLMMGASAVWVGTRFILTDEAGAPKPHKEAVRTAGHDDNVRTIIFTGRPLRVRNNDYIRNWEENRQQEIKELTAKGTIPVEHDIEKYFKEHEGKEDSDDDAEDLMEQARPWLMGKCAAVCNEQKPAKEVVDEFVNDAVKALQGGNQLIAKL

SEQ ID NO: 1867 - protein, 332 aa, Unknown
  Kingdom: Fungi, Phylum: Ascomycota
MAPNLADSQHQLISDMILSKSEGDKSLKDGEIAHAANCSTRTVRHIRSNLLLFGSTKAPPNGSGRPKSISPPMLTALLDKLGSDPCMRLQDMASFLNDEFEADVTRFSVSRALKGAGWSRKSTQNVANERNARLRDEYMHEISNMRSDQLVFIDETGVDRSIGTRSKGWAPRGRRPRQVKRFHRGRRVQILPAYAQDGVVHFQAYTGSTDTQMFEDFIEQLLPYCGKWPSPKSVLIMDNASFHHSERLQQMCDSAGAVLLYLPPYSPDLNPIEEFFGELKTYIRQVWEDQIDFVRADFISFLEECVEVVGRRKASAEGHFRRAGISVEEPPE

SEQ ID NO: 1868 - protein, 1086 aa, Unknown
  Kingdom: Fungi, Phylum: Ascomycota
MASNTRATRSRYSSPAQPQSHLNGSLETPKGSVTETSRSFMAKWLEPTVQKKASYEEAGLVRQGVLEGMAPLGALPKGKKPSGDGHSGVRKIILRPSGGNASAAPSPRESVPTLAPNLPAAPSSTSPPPPPLPASLSAPSSPQRRKVPAPPKDDEDDGDYDPKPTGSRRRQSGRVTKGKKPLPPTAPQPTASPAEAPVSVDPEVKEFAEKVVEAAVDEALQHYRFPTAYALRTLYDERSVEPGFVAMIEDVFSQTADADTVSDFASLLEEKKREGKKGNVAASYFAPTSPSKRNTPWKPKPAPCAKKHKKQNSDADEQEATTTPRAVKKIKIRHSRTSSKPNHLNGTTDEVEATATGTAAPKIQTPSSHKRNRRASGSSDSSLSTTMSLSPFDTHLQKSAVALQSPVSPSFRRPVVSTSDGAQTSSADNHANDAPNPQPITARGKTLVAPASKAKGVSNTSDTHPQTLTHQHQHRQNTRQPRRSRAGRSDSPVVDDARMPGRVSAAKLFPNLPRKTSNTPPKEEPEAQASSHDDGGLWDRKWEARRVTENYEAQHSFLRGSSPDEKVTPTVKTRRTRQSLLPSVGMRATRSASKRPNEDIDDTISPTAPSWNGDASSTVESRAVTPSSLRPAAKKAKTGIRIKLSPIKKKGAAGGLPRPLSEPQPASNGATREQTADNDEYCSACGNAGDVLCCDGCPRSFHFEFPRRVPVHRGVFGGALNNLEKGNPRAFSLPKKLQNRFEGVKAGPDGDYDEVVSKPSRDKKRHANEDGGPYPMREDGRPILCHNCQKGDGTPQELMPCSCCPLWWHLHCLDPPAAYPPNRKTWQCPAHSADVAAEAHPLAPAHRFRKLKGAQVITPALGRGLKNNGQIELDWGDEPEPSHTGWPDPRSFGRTYKLPVNGVILDFIEQMRHQGAGYGPRLEEPKWLPTKVLPSPNSDAPLKGSALDRQLQEMQVSLTLTSLQRDRSGGTEKLTSALLNAVDPNVLALMAKTNADNIEFGKLSEDDRLGLRTMMLQMDAISARIRQTLGEDSKSAASALASPGATSVAEVTPMSSPREKMQTILPINEPTPPPTIEQGDGPMELD

SEQ ID NO: 1869 - protein, 601 aa, Unknown
  Kingdom: Fungi, Phylum: Ascomycota
METSSSALQSALTDYLASHNISARRIREEAEQRRQQAAASARGNGEAENADAGSVPITVGSASSGRGDSTGQTTTPQKTAKKKEEAKAIEKIKASKAFKKRKKDAEDSDDDDAIARAIFEERHAPLPGQMENCAVCSKRFTVTPYSVAGPEGGLCCAPCGREIAKQRQGEQPKKKQARKQTGGVGSRRTVQSRILDGDRGTKSLSTLCVQTLAKNVDMADSLGDLPEHLVDKVARIFSKRRLLRPETLPLFSQPTTEVLHIYDGARLGEQDFISIFQVSPKLRRFKARSAIQFKDEVMDYLLTRDIELEYFYLHGANLLREDKWHAFLNAKGRNLRTLQVYYTDLHFGDETIALLKEAAPNLSRLKVENNQKVTDVGIEAAGDLPSLEHLGFQLRNETNPAAVVKALQKCGSRLHTLSLKVMPLLDDTVLQALHQHCRALTKLRITDSEHMTDQGFADLFNGWLNPALEFIDLQKCRHMDSTRPRDNVDNIGLCDQGFRALMAHSGHKLRILNVHGCRHISQQAFEEVFSEDATYPELVDLEISFCENVTDFILGSIFRSCPRVKKVNVFGCMKVREVRVPRGAVLIGVPNAQGMVTEGDA

SEQ ID NO: 1870 - protein, 315 aa, Unknown
  Kingdom: Fungi, Phylum: Ascomycota
MAPSALTTTTTAEAAPASVKHVRSKQVNEPEEMECQLSEMSRGPNALSGIPTFDSFDEHRKHICLHMAAVFRNWARMGFTEGISGHISVRDPEHQDCIWMNPVGKHFGLLTAGDMLCIQISSGRIVGGNKTRPYNLPGFYIHSEIHKARPDVHSICHAHTIAGRAWCAFGRPLDMIQQDICDLYGVLAVDTEYAGIVTAEQEGQQIARALGPRSKAALLINHGLITVGSTVDEASFLLGLLDRSCEIQLKVEAACAGNPELKKSIIPHELAMNNFKMAGEKHWLYEEAQPDIEYEIEMAGDKIRTGIEDVKVDRL

SEQ ID NO: 1871 - protein, 371 aa, Unknown
  Kingdom: Fungi, Phylum: Ascomycota
MPATPYTPPPEERYSFLDDYSEGAHPALLQALVSSNSTQQVGYGNDAFSAEARQSIRRLVGCPDAGVFFVPTGTSANVISIAACLRPHEAVIAASSGHIVTRETGAVEASGHKIINVEPQNGKLTPSTIKKALESNWHYPHMAFPKCVYISNATEVGTLYTKSELKAIKQLCVANGLILFVDGARIGAALASDLNDITLPEFLELTDIFWIGGTKNGALLGEAIVVKDAALARDFEFYVKQRGSLLAKGRAIGAQFAELFRLSSSADAHLPIEDQFRNTLYFDLARRANTAAQTLSLAVTQAGYELQAETETNQVFAVLPVELIERLKEYFRFYVWETLEGGEKAVVRLLTTWATDLKQLEHFVDMVKTPL

SEQ ID NO: 1872 - protein, 803 aa, Unknown
  Kingdom: Fungi, Phylum: Ascomycota
MSSDIGLPRATFAKLSPHPYLLANLDPSDGTSSPSRSNGRSQNETRAPTVNLSSLSHAHGSAVVRTGDTTVICGVRAETLLTSNIPNFRDTNRETELRDYDLLVPNIELATGSSPQFLPGGPPTNLAQTLSTRIFSLLHSSKIVDPADLRIWDKRMEDEVAQIEDEQMEDADDVDVDNEKPAKDVVIAYWVLYIDIFFISFDGNPFDAAWAATVAALRDTKIPIARYDADREMVICSRSTPAQPLNITSMPIACTAVIFTGKETDRPTDGKFWLLADPDRLEESLCDESVTVVGGELQVMESLSDIKWDAVISGTGLQQSLLALALSRSGKEILHVDPNGYYGGTEAALTLDEVDDWVQKHASDAGTSEDIFSAARVVREQADAALSSRSYNIALAPQFVHSKSELISQLVSSKAFRQIEFLAVGSFFILQQSSSTDAPPSITRIPSTREDVFSNTSIPARAKRSLMKFLKFVLDFDSEPNTEVWKTHAETSLHEFLRSEFKLDENLQSYIIALTLSLDGNIAVEDGLRAIHRHMTSMGVFGAGFAAVYPKWGGLCEIAQVGCRALAVGGAVYMLGTGIKQVVQGSTQDESGTTGLEIKLDNDIAVQSRRLVQSQEQREGSRRVRRLTAVVDSKLPSLFATVVEGAPPPAVAVVAFPQGSLCAEDATFGYPVYAMVHSSITGECPNSQSIVYLSTIADSNADSTLEQALRSLLTAASSNIEDGGSPRVPYRLSYEQAQGPTSTSVDGNIINMPCSSLSLAFDDATLQSVRHAWDVLRGPEDEETFYMKFDDREGQDDADDVYE

SEQ ID NO: 1873 - protein, 244 aa, Unknown
  Kingdom: Fungi, Phylum: Ascomycota
MRQDILLGAAAFARFSIAQDNDSDEDGVADERLEACFPDDPTAPCVSIENIEGICMQRGISMGDHQRCMCEGSFFEDWLGCRECLRVNGALSQNEVKYWSSIAADASQNLCDRDSTPTTYWRDYFGSAITNPTGTDLTASEGSGRATLVSETDVSYYYTAPGSQGPGITPTVTPQTGSETGTGTETTTTTTTTSSDEISSTETQTQAGDDQGSGDDEDTAGRTFAHGAAGLAAVIVGAALIMIL

SEQ ID NO: 1874 - protein, 282 aa, Unknown
  Kingdom: Fungi, Phylum: Ascomycota
MADLSKHVVHSGSAVPPAEAWVPFEWDEPKLGKQVFGEVTIARKFGVGGSLTSGFWRTSPNAPGSSSDGSSFKNIYSAPLGDETACVIDGTATLTVVSTGKKYTVKPGDIISLPKNLEVLWEIDAPFFKKYWCIWNGTDAVPNPPTELTINSIHDNPAEWIEYHFEEPKEGPLVAGELYFIRSAGSTGTMMSGVWRSGKGIAGTDVDEQGTMTTPYTGVLGDESILLLEGEVEVTETESGKKHLFRAGDAIGLSSGMHVTWVSKGPFSKKLWVITRDVLPSE

SEQ ID NO: 1875 - protein, 1451 aa, Unknown
  Kingdom: Fungi, Phylum: Ascomycota
  misc_feature (385)..(388): Xaa can be any naturally occurring amino acid
MPTTDPDTAPICDRRPTSIKGSNEAVGTAAMQLRHRKCHDLQTVLDSFEAKDASLREGGSSWTDVLESMATAREDYNQKRRETKAGSVHANKSTIATLEMLTDMIPDQDGLSILRGGLKVVFRLVQRRMYNREEILGAFEDIPLTFLRACEKLQTHPNDAELHTYVEELFGTLLEQIPKLVNILLRQHKGSLPSRIFKQHPEHEASIISSCVEAVSRASRRVSDRIGVLEGKVIVETLRETQSIGLKVDETSAEIHLLQRGQAQLDLKLEEQSARARAEIPFMINMAMNPIYTELQTMRHVLMASLSDSSWLRAGLETPQQEHAQLQWQPGEALPYSTSGPTSSTEMFCALGLPDPELVDNDIYQALQTGNKMRAACRHTPLEQXXXXAGYVLLETRFQNWIQPSNNRSDVILVHGRLGNFTEGKISGLSVVAAMFSTVRHFPRFVILHHFCGLHDRCRDAGSGPVGLLQSLIAQLLVHINGNSGFTVLPGMQENSDHLQSAADGNFASLCWLFGFLYCQLKVDLVVYCIIDGIDSFEGGQEGWAEQLCDVVELLTNLAAGSGLRGPVLKLLLTAAKRSVKKAGIECPGYQRRALFVNRTVANPLITANDAIGTLSVSDEATSTSKQDVLDDYRIMERSFAASSYVTSDFRSTAFRILQRLYLPQKGMMNDSIAIGTSFWVTALYITQHGGMTLDRALEVYSSGLSRLANSLQRVNANNLPCLLGSIVALSTCELFVCPLTPGWRAHVQGMAELLRFRTEFDHHDMGATPWMHLCARARVVTVLTDMMSQTQTNVTAAQWRTIMPDRPEDDPMDNLLDIISDIPALFKSPDALQDPITSMLRILKLIYDWEQRFRKRIGPAPYRFVPSQLSNPADEGHDEPLYPLVLEFKVLQIASCLIVCWSAMLQTLATVIRLHQRASRSSSYDLIWGFLDRKAFRNASPEIAIIVEAKRRAGLLCQSTEYTHREEMGSIGPQCMTYARGVLQRFFEENHMPRELAWCKNIPHMTNQRAYMDAISENTIADSRPLSHDAQAVANSEKHEQEPHVLSRPDPAAFPDGGLRAWLAVMGGFFAIFASFGWINCIGIFQAYYEENQLRSYSSSTISWIPSTESFMMFFCGPIVGKMTDYYGPRVPILIGSFLHIFGLMMMSLAKNYYQIFLSQSVCSAIGCSFLFFPTVTAATTWFLRHRALAIGIMVSGSSVGGVILPIMVNRLVGPLGFGWTIRVIAFMLLGIIIIANLTIKSRLPPSKQPFALKDFLTPLTEPAFALLTLGSFLTYVGGFIPFNFIIVQARANGMSAGLAGYLVSIINASSTFGRVVPAHFGDRYGVFNVFIIMTSLGGIFTLAVWLGAQSNAGAIVYAVLYGFTSGCTFSILPAMVASMSDVRQMGTRTGSMYAFSAFGVLTGSPIAGAISKNGFSGLIIFCGVLLLAGTLFAGLSRLKLTGLRLLAKA

SEQ ID NO: 1876 - protein, 488 aa, Unknown
  Kingdom: Fungi, Phylum: Ascomycota
MGVNGIVNSAAGGPPPNTSPYSSTPGTASSAATSAATSSMEIDTFGVLDGAVPSLTSSPFTVYDDAGPSPTRGSPFPAPGYDGSLPDYGTSSFVPLPDNANNADGSNWPPVPNAIPSAVSSPSSSADDYTTAGAAPYMPTSMPNGMIPTAGANGVVKMEFDDGDRAPRHWVPPTSQQRPSPTSAPTAPAPGGYARPQPHQQQQQHLLPRSAPSQHAMGRAPQHVSHVLPSAAIPSPLSQQQQPPALWELPALNETPKSRADELLLGFILDCRRQPRMDVVRMMLGPVKMDVRALFPEDMRQYFQPNVQMPPPPARSPLGDLITAVIANAGLVRPLERLGVVAPMHSYVAWMAHPSRETQARVAAHLVPRQSQLEIQHPAWVGMVHWGRLRCAIIHRQDIYGTDEFLRVYSTSLRLVNWPPASPQSQQPRGDGAGPLDAAIETDPVTGQVWLSDSFMAHASRFDSWRLDMAFARHYPELANLVDLVDLS

SEQ ID NO: 1877 - protein, 271 aa, Unknown
  Kingdom: Fungi, Phylum: Ascomycota
MNSTYNYASPDLVMAPNTFGDDENLAAYVDPSFLLGAMLPNQALPFLAESTQFAMPVDFPLATQDTPPMSGFDSYLAGNVDFDENFLNNMGDLSWGADMYNQTFATGMDDFANPAPPSTASESQGQSPSETTFLPFTPSDVSDFVPSTMASPSSAATNPSPSSSHQTTERKPSSSTGPKYVPQDQPAFSDIEANIFSTRRQLRKLIKPETCHVCGKGHAQIRERDRHIITQHYDEAVRMGLNVDRPKCGLCDQTFRRKDHLTRHMKRRHGW

SEQ ID NO: 1878 - protein, 513 aa, Unknown
  Kingdom: Fungi, Phylum: Ascomycota
MTMASYRSIERHSNDDDGKPPGQETGGGIAVAFAAKDEERITRKVDARILPFLLFAYLFQQLDKSTLMYASVFGLAEDAHLVGKQLSWLGSILYLAQLVAQPLAAMILVKYPLGKVIAIAILMWGLTLCVMSRCTTFPTLLFTRFVLGAFESIIAPSCLAVTQMWWAKERQTTRVSAWHAMNGIAPIVGGILCYMLGHLQYQGLFTYQILFLTFGLMTICLSFPVWRLLPDTPSQATFLTHEEKAILGDRLRASRSDAATKVWKWDQTRECALDPKTWCWVAMHLCLAIPAGGLGVFGGLIIKDFGFDKFKTILFNIPFGLVALGAISGMTWFANRGHKGIVMAFLCFIPMLGCSILLLTPRSGEPGAHMAQLLFAYVLIQFQSAFVPLNLSWQAQNTAGETKKQCTTALMFIGSCFGNVVGPLLFDPDQAPVYKTGLMSSLLMFAITFVISTATYFHLTYLNAKRKHSAYVSLNEEDDEDVESTGGLLQQPPSHSLGADLTDRENKAFKYVT

SEQ ID NO: 1879 - protein, 1021 aa, Unknown
  Kingdom: Fungi, Phylum: Ascomycota
MTPPLSLLHKEEPTQPTKTLPYSDESRAPYQTNTAKRSRLPSGETWVSSRASHILPSLPTPPSDEQTPHQLCDPGSPSAAMSTWQPAAESLNQLAAFLKDSLSGFDKNAQKQAEQMLQQAKTSPDFNNYLAFIFSSSQPPQGLQCSEQDYHLVRSAAGIMLKNNVRNEWKSIPEDSLRLIKLAVPMGLQDKNSQIRNFAGNVATEIIRKGGLLGWPDLLPQLLDLIANTSGQTPNEAQEGAVSAMAKISEDNFKMLMREVNGQRPLNYVLPQLIAATKSPLPKVRLGALTAINVFTSRESQALLNTIDDLLQHLFVLSADESIDVRRQVCRAFVQLVEIRPDKLQPHIGGLVDYILQQQKSEDEDLACEAAEFWLAVGEHDNLWQALSPYINRIIPTLLECMVYSGEDIALLGGQSDDEEEEDREEDIKPAFSKKSHTRNIANGEDTGEDKNGSYEKMNSMDDGLEDGEIDDFDEDGDENPDERWTIRKCSAAALDVFARDFRGPVFEAILPYLSQNLKHEDWPHREAAVLALGAVAEGCMDVVTPHLPELIPYLLSLLNDQEPIVRQITCWTLGRYSSWAAHLPDENQKNMFFVPMMEGILSKMLDKNKKVQEAGASAFANLEERSGKSLEPYCGPIIQQFVRCFGKYKDRNIYILYDCVQTLAERIGPVLAQPELSGQLMPALINRYQNVPDQSREVFPLLECLSYVALALGDSFSPYAQPIFLRCVNLIHNNLEQTLAASSNPALDHPDKDFLITSLDLLSAIIQALDDRKASELVKGSQQPFFELLSFCMEDPTDEVRQSAYALLGDCSKNVFNELQPFLNTIMPILLKQLDLDSMLDEDIDSGFDVINNAAWSAGEVAVQYLKGMQTWVPELMQRLVEIMTNPRVPKALSENAAIALGRLGLGNAEQLGPALPNFADDFLNAMSEIEPTEEKATAFRGFALTVCQNPQAIEKVLMNFFVSIARYEDMELQNPTKIELQQSFQDVLNTYKQIIPQFDAFVGQMRPEDQQRLRSTYSI

SEQ ID NO: 1880 - protein, 87 aa, Unknown
  Kingdom: Fungi, Phylum: Ascomycota
MLLLRTLLPGARISVEIEKPGREGLKDLAAQADVVFYSRAWAEQPPPKLLLLSVALMADPGPPVVVSQSSGYESPEACLKGEWSQRP

SEQ ID NO: 1881 - protein, 412 aa, Unknown
  Kingdom: Fungi, Phylum: Ascomycota
MLSSRTVSRAARHSACRATAFPRRQPIRFQSTASSSSSGSSSSTSHFGAGIAGGIIGAGVFYGIYSFTPAGRTASTINKTAIEANKKYKEAAKKLQNNTPSADQAVESIKQFAYSYVGWIPGGRGYVDAAFDDWEKIRENHREEADKIVNDAYKEFQNIAKSGLSMETASKAYEALAKLAKQVAELSGDAISDIIDNHPQLKEKLGGNIDKLKEMGDKYGPEAKKQVDETWKQVKEIVAGGISASNLSKARELIEDKVQKLSKLGDEAWKKAYEQAKPVLDKNPKVKELVENNADALKQGNVKELFEKAKSSIDSGNIDDLKSYVDNAVGKAKDKASSASGGVFGDLEKYAKMVPQVDEILPKLKQLGEVAEKHREEGEKLLKETVEELKKVLEDKAQKGKEIAEKAAKESK

SEQ ID NO: 1882 - protein, 180 aa, Unknown
  Kingdom: Fungi, Phylum: Ascomycota
MSYAMEDTQNSAPGSVTANKLGATRKGPDSQSVTKRLQTELMQLMTSPAPGVSAFPGSDGNLLSWTATIEGPDDTPYAGLTFKLSFAFPSNYPYAPPTVLFKTPIYHPNVDFSGRICLDILKDKWTAAYNIQTVLLSLQSLLGEPNNSSPLNGEAAELWDKDAAEFQKKVTARHRDIEDE

SEQ ID NO: 1883 - protein, 947 aa, Unknown
  Kingdom: Fungi, Phylum: Ascomycota
  misc_feature (471)..(480): Xaa can be any naturally occurring amino acid
MIAIFPPTSNGLALSYNPLLHKLLSSVTFVLHFCVKTRNGRDDYCTATAFTALERPPEYGTSSTPSREDSQEHRRHPQYPFIIQVSAESPSKRIAGPFYEFWSTDSCSDISTPAAEEFRNPESSTPDTRRQDRPEDRQHQLISPPSTQRNPFEVIERLDTQHVQPKHTKLAEWERRGQIHHKPQDSYSTSATTYDDPAEGSAPKIESTAEKRTSKIDGKGNVLVSVRVRPDTNADHEKPEGEWMVDGRKSLISYKGKEGGDHYYDNVFATHDNNARVYDHIAKRLVRRVMEGYHGTVFAYGMTGTGKTFSMQGTASSPGVIPLAITDIFSYIRETPSREFLLRVSYLEIYNERIHDLLSMPTASGVGGNVQQDEIKLREDSKRGVYATPLKEEIVQSPTQLLRVIARGDQARRTASTQFNARSSRSHAVVQIVVESRERVPGAGIGEGKRSGLAPGGVRVSTLSLIDLAGXXXXXXXXXXKLSEWKDKEGKGGDKDGKHLPYRDSKLTRLLQGALSGNSLVSILCTIQIGAAGSMAAANSHTTETLNTLKFASRAKNSIVSHAKKAEEALGAGGDGGARVLLERYRMEILELRKELETQAKKKKKNTNDRDEESQKDEESERAREQEAAERHEEQMLEMQLARTALKERIDHLNRLILSSKSVGVNSSGSLSSMGQYARFSQVSLAASVRSSVATSTGPKSLVERTSSMTSTSSTIGRRSSGGNGQRLSDGPGSIEQDDDAMGDYGDGMASLAAQNRALQSDLMDKNRYIATLEKRLLQARRASSSRTSVGLSASSKGIMVGEDHSVAAAIKERDAEIADLRARLDDKDRMLTALRSAARSRDTAEGVEPRSPQSMGSPDLNGPLSPTRTDKIRRKSVDEMNKMLEEMIQDRVDNGQIVRGTRGSFRFASGQKLDSLAEPEHNLEPLRRTPTPTPAHAPAVIGNSDA

SEQ ID NO: 1884 - protein, 247 aa, Unknown
  Kingdom: Fungi, Phylum: Ascomycota
MDASTTIPVPSSQASRLLNSFTTFLTLTIHSLLHHRALYPPSTFLLTRAYNLPVPQSRHPAVCAWVNDAIASVAVRIRKGEVQRVAFVVYAAKKVFERWVFDVGAFPREGWGLADEGDDETAQQQGGEEGVNWTDVQEALRGALRRVAYAGESRPKLPPGCTFTLAVELRDDAPAPIGHPQPWIPAQPDLQPPTERSPADQGCAIGGQSTTPLRSVQAGPLFFECWVEDGKQVSEPSSSGAQTNSTT

SEQ ID NO: 1885 - protein, 505 aa, Unknown
  Kingdom: Fungi, Phylum: Ascomycota
MASPAMASFDLVITNGVCVTASDVAAFDVAIKDEKIALLAPAGSLASANATRIIDAEGAYVTPGGIDAHVHLQEPPMFGKGTTSDNFESGTRSAIAGGVTTIVPFAPQQKHEPSLLKALAETHDKARDNSYCDYGFHLLVGNPSEQALAELDTIPQEQGITSLKIYMTYTALQLRDDQILSVLLKAREKHILTMIHAENGDVLNWLTDQLEARRLFDPKYHSHSRPPILEAEATNRAIALSSIIANTPILLVHVSDPGAAARIRQAQTNGQPVFAETCPQYLFLTRDDLESCSGFDGAKHVCSPPPRDRASQDAIWTGVKNGTFTILSSDHCPFNFDDADSGKKACITEEHPVGCFRHIPNGIPGIETRLPLIFSSSHRLPLTKIVEVSATNPAKLYGLYPRKGAMIPGVSDADLVVWYPQDTGRSITITNGALHHATDYTPYEGQTVNNWPRFTVLRGRVVWDKDNGGILGDKSYGQFLKRLPTSLDGIWDTVDKQGPFDVSAF

SEQ ID NO: 1886 - protein, 392 aa, Unknown
  Kingdom: Fungi, Phylum: Ascomycota
MRFISVVTTALALGSGPVIAAPNLGPQAPTTEEVQGAKSVEDFRNLAIQAIEAQQSDLQRPGELGSCTLENALVRRDWEHMSKCERKEYIKAVKCLWTLPAVDPEFSAAQNYYDEFVAIRANLTDLIHGTANFFTWHRYLIHLWEETLRDECGYRGALPYWNWYKYQSALHLSPVFDGSDTSFGSTGKYFKHNGSLVGSRTVWLPPGEGGGCIKDGPFVGYTINLGPIRPAMNGYEPWMKDQRDYNPRCQRRDLVHAASERYTFDGLYDLLAGDHSHTIELMQNEFQAFGTLSQHGAGHYAMGGDGSDVFTSLNDPAFYLHHAMVDKLYWMWQALHPREANTVAGTLTYQNIIPSRNGTVEDELDVGVLGPHLKIKDTFNTLGGTPYCYIYE

SEQ ID NO: 1887 - protein, 195 aa, Unknown
  Kingdom: Fungi, Phylum: Ascomycota
MRSTVPGREKDRRRKNETRKAEKNTLEAPGNDGGVASLVLSWPFRQFGELSATNELVPHLASYNFSTELYHTQSNQLAAGHEDSLNMRSHDAMKNEEANQAAWEASKGGIVGAAKMGVVTAIAGAIGFAVSPLYRGTTIQFKVYLQMSGMVLGGMVAAEHKLQEFEAQMRLKRRMIAEQARWERYEQELASSEEK

SEQ ID NO: 1888 - protein, 1160 aa, Unknown
  Kingdom: Fungi, Phylum: Ascomycota
MLLLHQVGSVKIGEVIRYHVTYTPSQDRILPSPERLYVRIRNTSAIALRAAFVHGPYTLAVAAWPSNFNPNEKFEEPRKYGVPEFEPMVKAGGSWECELTVPDDIRQSAGTGSHGGFGKSPEHDGECASWAIEVSSQVIFSTSAAVSYELVVARDKKSLNLGLSLPVVGNQTQAPQPGRVVDHQQSVGAKDGHHPAQTKGVFSRAVKVVVEDTAALWNTPRLPSWDDAGGQRLKHRHGANEPVESMAQTGDPATKEKGKQAKPRKQKKVHLVLLTHGLHSNLGADMLYMKESIDAAARQAKIDAKARRARERAARSRASTSTASTNETSAKPGDQKTETPDNKNGAPTKSGEGSNEGTADEETKEPSQNSTENGHAVPDDKEADADDDEDEDDEEVIVRGYSGNATKTERGIKYLGKRLARYVLSMTYPDQPYLPMGKETVEAVTHNRQHPSDIHPSHKHSTIHSDAHRERHAKQERAYRVTSISFIGHSLGGLVQTYAVAYIQKHSPQFFDIIKPINFIALATPFLGLSNENPVYVRFALDFGLVGRTGKDLGLAWRAPTIARSGWGAIVGNLGETAHKKVYGESQPESKPLLRILPTGPAYKALRKFRNRTAYSNVVNDGIVPLRTSCLLFLDWHGLGRVEKARRDAGLVETMVGFGWAELTGANLATPRQKQLLASKDQPAPTNVEAQSASGDATPKGKNLSQVPQPADDAVVEDNRRSIEHSPSTPHTDGGSSDTSGMISNGPLSSFFNFFRSHDPPKPQVTSQKQQKAFRSGQIRPSDDSSSSTGPPSPDVASPRQGKATTGHDPGSESEQMNAPPTTTFFEAAGDLLNPKLPDVEYLLDPTKRPRTIFHDRVYHPSDIPPPPLKKRQSTLSRRAFSRGSVSSQQTQSTPSSPSSPYPSTHRQDSTESAKDYDNGHHGQPDEVIDSSSMRVEEKIARAYHRDLSWRKVLVKLEPDAHNNIIVRRMFLNAYGWPVVKHMVDAHFSDSAVARGRDDDEYLGERALDPAQPPDEHGGETRSIPTGRILVTAPTASPEQRSASEAREAVDKVPELPTLNTSSLPRGSDGKEHADSLSPPTPTRRGIDRYDSASWSDRDFQDSENDSDNDESLDGSRSPGGTKGGNAEDAAKQKGHEKRVSQEWNWTEKIVGKGVGSGKK

SEQ ID NO: 1889 - protein, 469 aa, Unknown
  Kingdom: Fungi, Phylum: Ascomycota
MSLQRLENLLLANSGSLTPAQALAELGTPSTSIAVLENGAISSVCHSTVGNDDATVFQACSISKPITALAIMRLIDDGHFTLESTASQLLPADILNILMEGSPASQKSIIEEITVGQLMSHTSGLSVHGFGGYSSPDKIPSTADILLGRSPANNLRVRLELLPGFTYCYSGGGITVLQIILESVMGKPFPKILQEVVLEPLGMNRSFYGPLPKDENNAASAYLTGHVRADTPHHVQPELAAAGLWTTPTDLLKAVRAVQQSLEGGGFLKQGTAKDMLTRRKANMGLSWFISPNDTDFSHGGANDPGFRCIVSGFAQLGDQSVPDNCGYAIMTNSAEGDAVIGQLGQALCYLNEWPLAALTRSVIPVTPFGDNKRLAGDLWRSYTGSWRDNDANIYQIAENDGEPSLYYNGLGPIKMVPAATPGARNAKGDVVFFVLEGLKLLLKCDQGILTVQDGEQRESRALERTAVS

SEQ ID NO: 1890 - protein, 374 aa, Unknown
  Kingdom: Fungi, Phylum: Ascomycota
MSSPLSDVRASRARPKPPPLLSTYHRSHTNAVAGTESSTVTESVTRNPRCVLVDTPTDLIWEASAEELHTYRGREKCDPGFIMGHEFVGVVAEVGASVTSVRIGDKVVTPFTVSCGDCFYCRDGNTSRCTGSQLFGSPDLNGGQAEFVRVPLADGSVMKAPETISDQTLVLMADIFPTGYYGVRSAIELCPKVKIHDAVMVIIGCGPVGLCAIAAASHFGPRRIFAIDSVHSRLELARGLGAEPLNFLDDREGMLTRIKAATGGRGADMVVEVVGQPAALKTAYDVVRPFGSISSIGVHGSEIPFSGEEGYDKNIRLQMGRCPVRGVFAEALAVLESKQHAFGFMFDKVMPLSEAVEGYDLFDKLKVQKVVFKV

SEQ ID NO: 1891 - protein, 385 aa, Unknown
  Kingdom: Fungi, Phylum: Ascomycota
MKIQHLPAAILAATTASALPASNMARQSAPGRVLLSNGGHIYLADYTGSAFDITMTGDDAGHSPSWLAFSEPSLLYAVDESSNLTRSFNLDVAGNKLEKKAEEVGSAGVVYLEFNKERTRMVGAAYGAGTIDIWDISEGGLSLISTLKSDDPLGPNKERQNAPHPHQALLDPSGRFFAVNDLGTDHILLIDFADDAFKIVNHVPVEPAGAGPRHGSFYPRDAEKATHYMVLCEIKNLIIVFELSYTDSSIEFTKIQEISSFGPDANPGADAAAGELAIIGDHVYISNRLTGGKTDDISHFAIHKYGEKPELRFVDSVSTGGTLPRMFSVASSGKELLVGNQGGALGVVAIGINEDGSLEKEFRASIKASEFGEAGAGPQFVQQIA

SEQ ID NO: 1892 - protein, 697 aa, Unknown
  Kingdom: Fungi, Phylum: Ascomycota
MRYQQAAMALAMQGFLPGAQAGVMFKRTGNLLGGLQGLPRPPVGAPQPGGPGGIGGPGAVPPPPPPGQVGPPPPAAPPVSDALTRSGTDVPGETANPTDAGPILITLSSADISNELRTEAPTETPTLIAEPPAKIASTIETPSVVETPSVVETPSIVQTPSIVETPATVETPAAVETPSVVQTPSIVQTPSTVETPAAVETPAAVETPTTVETAAEIVQTPAGTPTETPGLIQPPPAETPLVTPPAETEAELPGGNTREVTVTVTQEDGKLETVTQTLAGETITGQDVTVTITKDNGAVETVTQALPVAAVTAIITQPIIIIVQQTTNFNFDFSLGGVCPPVVADPAGSGGFVVGDNAMLPTLPQACQAACQTQFKQCSAKAGANFQVADCEKQLSACNDAAATETLIEAPPQTVTKSVFLPATGVPGVEQELSSDGCAIISTKTLPPNQVATIGDGGISVITTTAKAEATAAQDEAVETTMVVTLEAPPAGGAGANKPSVVTMTMTASAPPKGTDEAGKPGKGRPGDGRPGKEVEDSNEKPVEGSAPPPPPTDTNAAAPPPPKATNGPGRGPPAGRPAPPAGSGECPEAVTVTVTQAAVTVTVTKGSNTDAVNTDAVECPAEETTSLVQIVQPTPEVTPPALDTPLLPPAGTTLTTKIDTSPTDVPAQIPDKLSVGKEQPAAQAPHKGLFGSLFGH

SEQ ID NO: 1893 - protein, 364 aa, Unknown
  Kingdom: Fungi, Phylum: Ascomycota
MSSVVEPSAVQPRKTPFFAPLPDCTPAPRAELTPEQQTKYEALLEKAKAFDVITCSKESDKSGPITDNERAWLTRECLLRYLRATKWSVQDSATRLIATLVWRREYGIEGFTPEYISPEQETGKQMIVGFDRQGRPAQYLNPWRQNTDASPRQINHLFYMVERVVDIMPPGVEQLSLMINFKTTKQRQNTSVPISTAREVLHVLQNHYPERLGKALIINVPWIVKGFFTIITPFIDPVTREKLKFNEDMTQYLPPAQLWSEDWGGKMAFDYDHETYWPALNELCRQRREERMRRWEAGGKIIGESEDYLQGGTDTSVEGVKYEGPKLGWSEDGVDAVTEKLEGTKLEDGKKQAVEDEKGEGESK

SEQ ID NO: 1894 - protein, 559 aa, Unknown
  Kingdom: Fungi, Phylum: Ascomycota
MRLQVTVPFLILTGGHVLKVHVTPQWLAASSTLQRRNALQCTSWAACSAALLRVTILTFAFLISTSAAPDTGLRISRSVLTDVPVSEYSSARTVIRDCTEISPLHLPSLQKKICRIPDMEAGMASRLRRRATGNNILLKDNILLQDNTHLKDNTHLKANIRLKANILLLSKANTLLRVSTLLLNKGNILLTKEGISNHLPHRGNTRRLKANTLLRGNIPHHNNHTGSLHLSSPYGGAPPTPPTLGYGPPQRINWDGRSDAQALRSAMKGFGTDEKTLIRVLATKDPLQVEEIRRSFQSDLGRDLIKDIRSETNGYFEQGLVQLVRGPLMNDVYNLYDATDGPGTKETMLNDILLGRSNADMNAIKQAYRATFGRSLEDAIKSDLSMKTERHFMMVLAANRAEDAAPVVPQQVDDDVNRLYQATEGRTGTDEILVCSILTQRNDNQIRAISHAYAQRYRKALDKVIRSEFSGHMQEALLFQLQHAEDKYMHAARLLEDAMAGMGTKDVLLVSRVIRFHWDPTFLANVKGAYAKKYGNLAKRIAGETSGDYERLMLACIRA

SEQ ID NO: 1895 - protein, 572 aa, Unknown
  Kingdom: Fungi, Phylum: Ascomycota
MAPRTYGKKKRSLFKALSSRRRRQSATAALVEDGPGHSASSAISAPRAATATRSRGTRHSTSIDEIASALLDDTNYQTDNGGRAPSPNRSRAQLPSGRPMPMTTSASTGPTLDGVPLSPLSMHAVFATTTTPVPHRSSPSRVEKTSPRKQRRQLAKRSSTRKRSGSLKQDKATREGDSSGNPAKSPFDDSHEENNDESGLEPFPAFDENAAPSRPEPTTHHGIDADEIERKVAAMLAATEALKPTAPQAKGTAASKVSRMVPSVLAKMSNAWDKLSSRPSTPEATEAAKIRKEGIRHNLGGVVASRSTPHILAPAGRVSIDSTELRRNEGANLNKRKVQKILGASVDCKLTSDSRKSLRTDQAVDVSGGEPTAPQAPSDLEIWRMFVEMGETGTQAQMGTQASNCPFDSEAGFEQNLEDRILNTQPAGSSTPRPGSPCKSANAPGTPRPGSPCESSDASDSKSAHLSGEESLASDVKVNLAEVAVRLGDDEARATIRQVDVKPSDFARGAASATGSTDRRVKSNVHNRIDAIKGEERQKKHPSPSKQELEDLEQALQWYLTLENSEPDRHVD

SEQ ID NO: 1896 - protein, 277 aa, Unknown
  Kingdom: Fungi, Phylum: Ascomycota
MQSSQQIEAAPSPPLNPLAITEELTPLPQLKSAGDTQVQFEGQLSRPLRLHEDVRTGCGGQTWPAGMLMGKHLLRYQIDTLRDARILELGAGGGLVGLGVALELEMMGRQNNKLLITDQEEMLQLMKTNIGLNQLDDSVDALILNWGEPLPEIVVTQRPDVIIAAECVYFEPAFPLLMQTLKDLFELNEEAIVFFCFKKRRRADLQFVKMAKKAFLVEELYDEDRPIFERQRLFLFSFRSPKAKAEAKKNPAKKDADGDREEAGRTSPLSLGVKVKI

SEQ ID NO: 1897 - protein, 781 aa, Unknown
  Kingdom: Fungi, Phylum: Ascomycota
MANNILACTACMRRLVLAPLAARALSETTFLASTRAINTRRAASTKAIQAKDFEETFGSKPMTEEEKESRERESKEKLAKQYARRKLSRIDDPFHIGQAVTAALREGKFEGALLLTEKASRTMNVVVSWNALIEHQLSKGEVKTALKTFNNMKKRGQMPNVQTFTTIFVGLLNSPNKQLAVAEAVKHYNMLLQDTRLEANIMHTNAVLRLCSQAHDLDQMLLVASSLDNKTRAPDATTYTILLDGIRHKVSAEVKNMEPAESARYRKQMADKAMVLWSEVTRKWKAGRLMVDEKLIVSMARTYPFQEERDTKPEDSKILDLLSEMMGIPNYAKFPDWNKTQAELRKAEQVEEADRKKSSKALAASKSRIGVQVQPGTRTLGLILEVLGLAARRATLAIKYWNKLVDGFGVRPDQDNYFRMILLLKQTKSSAHIVWLLKNSERSILNAGHFSVALKACINDNVNMNAVRNAQEVLERATEILPPDHEELMKFHRMYLRVALVSHHAFRQQAMRGKDEAAVKAYGRQIFSALEYLGKPFQKLHQQWFEAAPGSSISDEASANLSKETSKWQPSSKKPNKVHRKAPLSQGQVRNGQREVIALARNMYAAYNKLMLEKMLPGAELAAVRRKAASLNREIQSFYKDRAEHEPNLPEQDPDSTPARRRGRLPGAASASDLSSSARAVRGSSETEHAMTTQDQDSQESDRRLAEMADQLARELAPADQDLAGVDRVAREFVWASRSPMGTKGGPRAKPDETKATSEKRRHPRQVPAYKRRVHRSPLWE

SEQ ID NO: 1898 - protein, 385 aa, Unknown
  Kingdom: Fungi, Phylum: Ascomycota
MSSETLAASEDESRPTFVSNGAGLAAPTSAPTRRDIQDSAARPFPPMTTDWNVPQSCTWTYNAASEPVPGATGAVAWLDLEPDADATTLSCYPNGMFAGDRTGVFSPGTCPSGWTTAEVVVNTDEDHEHATTTAICCSSEYSLVDTICKRSVPTVLAVPISYNKTASTHEVLSDSTTTLYSATIAVYTIMAMFRETDKPLLGIGDEDDIDVENLPRGLSINARIGIGVGAAVAGLLLIAGGILLFLHCRQRSKRKKPGVGHEMGSVHRNCRGIDRDGDDASFTSADDDSCRRSYGREPPPAYEATTETNSLADNESGTTVSREEIRVLRAQKEAIQRRIDELESVDTDDSVEARQQHLQYREPQQMQQSQRPVSQEEESRARRDA

SEQ ID NO: 1899 - protein, 521 aa, Unknown
  Kingdom: Fungi, Phylum: Ascomycota
MEVNANAAEKETHDGQDLSVRASQLSGNVGTSELIGNVVDPALAAKTRLLNEAIDEIGWTTFHLKLSCLSGFGYAVDSLIAFVQSVAAGQAYLEVGNGGFRTGSTMGLYAGLLVGALFWGFFADGIGRRTAFNTTLFLASAACMIAGAAPNWIFYSSFVAILGFGAGGNLVLDPTVMLEFVPSSQQWVITAMAGWWGMGQAAAGAIAWGFYSRSEWSCDGTDCTWQNNKAWRLIMFTGGALVLVMSLLRVFVVELPETPKYLVATGQDEKLVSTLQKIATKYNRPCSLTLDALQACGQVQQVEKASHLSRGQRTVSSLVHQVRGLFATKKLALSTAMIWVSWMGIGLGYPLFFIYLPALLADRVPGYTPTFTETWRDYTVTNICAIFGPLIAAAMVEVKWLGRRYTMSIGATLTAILFFGYTAIKTPPQNLALSCSISVAINLYYGTLYAYTVETFPSAHRGTGNGIAVALNRVMGLLSAVISVTAGTKSATPLYISAGLFLLLAAISAVLPFEPRGNGAA

SEQ ID NO: 1900 - protein, 434 aa, Unknown
  Kingdom: Fungi, Phylum: Ascomycota
  misc_feature (212)..(225): Xaa can be any naturally occurring amino acid
MEEESKTRADVESAYNSHPPQEAQDEEEEDLKAAKSLVWKQDIRIIPLASWTYFLCSLDRGNIGNARILNHSHGNDLLTETNMTQYQYIIALMVFLIAYGLFEVPSNILLKKYRPSRWIAFLMFSWGAITIGLGGVQAFCFGGAIAYGIGHMNQVGGHSGWRWLFILEGIPSCLSAIAVWFFLPDYPDTASWLSPEEKALARRRLAVDGSKXXXXXXXXXXXXXXYLHYIVYFGISVPFSSLSLFTPSITAGLGYYDLQAQLMSVPPYAAAYVVQVLTSWSADYFNARALHSATLATVGAAGFIGSALLPAESYSHRYGCLIVAASGSFACIPPLLGWLSSNVFSGPAIGMAIALNIGLGGAPGQIAGVWIYKTDEALQGYPTGHWTNAALLLMVAVGCVILRFWYIQLNKRRHIDDPGATHEFKVDQVLSKTM

SEQ ID NO: 1901 - protein, 219 aa, Unknown
  Kingdom: Fungi, Phylum: Ascomycota
MDSQDDSQESQDSVMTITQEKRHEILYFAYGSNLSTTQMRQRCPFSTPVGLGFLEGWRWIINERGYANVVPMTPSPGGSGGEGSSSSSSNKKAGVYGLLYLLPPQDEARLDGYEGVPWAYERMHCDYLRWATPPPPEGTDDGEGSGRGGAAAAAADEPVRALVYVDRQRVTEGTPREEYVGRMEEGIRDAVWNWGLDEAYADRVMRRFWRKKNQRGERI

SEQ ID NO: 1902 - protein, 351 aa, Unknown
  Kingdom: Fungi, Phylum: Ascomycota
MKLAVFSSKPYDKRYLNAVADAKTPSGSDAIELTHFDFPLTPETLALVPDHADAVCVFVNDHLPASAIATLAREKGLKLILLRCAGFNNVDLAAAAEHGVEVANVPSYSPEAVAEFAAALVQTLNRMTHKAYNRVREGNFALDGLLGRTLHNKTVGVVGTGKIGLAMAKIMKGFGCRIVAYDPFENDELKQIGDYTSLGKLLSESDIITLHCPLMDSTRHIINASSLAKTKRGALLVNTSRGGLVDTKALIGSLKTGHLRGVALDVYEEEGSLFYDDHSSKIIHDDVLMRLMTFPNAIVTGHQAFFTEEALTEIADTTITSLLQFKKDGKCDYSLIKKAKEGSKAEPVRKP

SEQ ID NO: 1903 - protein, 668 aa, Unknown
  Kingdom: Fungi, Phylum: Ascomycota
MKSFSLALVATQILSALGAKVEVSSSGGNATSGRQYGFLHEDINHSGDGGIYAELIRNRAFQYNEHYPLTLDGWFPVNGASLQLRELDEPLSDVLPVSMKVSKGKNYRHGKIGFRNDGYWGMDVKKQKYKGSFWVKGDYKGNFEASLQSNNTNDVFGAVKVKSNARKDEWVEHKFELTPWENAPTSNNTFVLQFDPKGVKGDLDFNLISLFPPTFKDRENGLRKDIAESLYELHPSILRIPGGNMLEGLDNKTWWDWKDTLYPLRYRKGFPGVWGYQQTYGLGMMEYLWWAEDMDLELVVGVYAGLSMDGSITPEDELQQFIDDALDQIEFLKGGVDTKWGARRAELGHPEPVDLHFVEIGNEDWYAGGQAGWDSYKEYRLPRFIEAISAAWPELTIIASGTHTDRDGIDLPEGIYGDYHPYKMPDVLVEEFDRFDNDGPHIVGEVAATHVNGGIGWEGSLYYFPWWIGTVGEAVSMIGYERNADRVFATFYAPILRNMNFWNWSVTLVQFDAWTVTRSTSWYLWELFAFHPMSHTLPATEDFGPVYYVAGKNEDQGNLIWKGACYNTTNGADQPVSVKFDGVEEGTKASLTMLTNSVGDPMRWNDPYNHTNIVDRSTVVLSANKDGAFEFEMPELSIAVLDTDYKKEACRNKKAKQKRRSVEQAFAA

SEQ ID NO: 1904 - protein, 286 aa, Unknown
  Kingdom: Fungi, Phylum: Ascomycota
MGPANPVAGNVLIPTHAARDDDEQLALANKVTCPTLRRMDTEPGVYIKQICSLESYPDRYRTKLWENGGVKGWNSNPNLRIYFFANHKEPPEIPLIWTQRLTDSNLAIAILTFVVHSARLVLLPLNFLPLWIESVYDLLLAGLWTISAAGQASGDLSDPDHTSHYPWYLTRSCGEGWASTKGFCQAAQASFCLSIIAVLLYLCRTLSHLLDLMAVGSWRREQEESRFKDVHGDWEEHDAYHDRVSDIGDDILLGSKGREVPQVFAEALSPVLAFFPEAAGRRRGEK

SEQ ID NO: 1905 - protein, 925 aa, Unknown
  Kingdom: Fungi, Phylum: Ascomycota
MSLYGRPAELPPPASWYDESGSPCWPTTYSLDFNPFQSVEHPVLGPEEHPAAIFPFPPLDDNAHATKQPNIIFDVPNEDTWSSSPIESINHRFVPRYLGKSPRRRKCPSSTVSASTSISSGGASTWSSVQTDDDYQTIVPASSSSRVPSPSAPFPSPVSMSMVCLGPQCSEAFTSDVELEAHIRAAHTHTCKWVGCGHPSFASRDGLVWHVESTHLLVCPCRGCGEADFGDARLLQNHIAVGHPEVGKNGIIEWQLSKQVTGENTGPRKGEKAPDQPAEDHEHLLIATAKRKAQQQLQKVIDKRAKKASVQLQPSEDRISAVRRKPMCRLCIEQRSFSNFDALKRHHRVAHPEWPAPQSGNLRYTAVSSPSGSVLTPTSVGNTSSPLSPLRESVSSVTPISTEKAIPFPLVFEHAVLPFLISFLPRWTGPRHVVSVTRGRTPQARRISIMTPTPISRARKILIAKHLHDLLSLPEIQHHRANISFLFPVGTVDRTFGNSCWARGLSREHMDDICVPRNPFYFSSLCMGDSIGISGTEEFEETTATLGPCISVGGGSYWLANFHPFIDAYRSANAIPVEHPSAQDRAICVSECHDAVAGKTSFHIGDVQVTSGLTLKTTRVTHDPYWEENCTDQPLVVTDWALIDSQSSHANILRRFPIDYPNRAAAPEPEALVRATSAVIPGGSVVSSGRTSGYGSGQVCEIPAYVSGAENGTGKATREWFIEEAYPCDNEDENKYWGPGPRHTFFTPIADIFDDIQEKCGQQTRPRLPQHRNEGDCYPVEPPCRTCYDTYRNLDSRRSSRMSIQSMVMAAGEDGDGAYSIEAASELATPRPVTDRNANVGLEEIGMTFGAVLWSAPTPSRVSQGIASPGFNDMRSPYAQTLELDDLQERDHGSSDPLRKRAAYSAFGASPNAASQSSKRQRLVE

SEQ ID NO: 1906 - protein, 919 aa, Unknown
  Kingdom: Fungi, Phylum: Ascomycota
MHWTVTFAITLLGGFGLTANAAEDSELQPILNSFIIEYDSDLTTQVHSLAADNGNDIKLIKSFSSDIFTGASVETAKENVDTLGQLSGVKRVWRNRQIPLAVPTPDFVPDDVAAGEYTTHNATGVSKLHALGYSGKGVKVGVVDTGTAWDHPALGGCFGEGCKIAGGYDFVGNGQWPYEPKAPDDDPMDQQGHGTHVAGIIAGKSESWIGVAPEASLYSYKVFSRASGTDEETLIESFLRAYEDGCDIITASIGGPSGWADGAWAEVASRLVDRGVVVTISAGNSGDNGAFWASNGSSGKGVIAVASVETEVFPASPFNATFATQDGEEDTVTLGYLPSTDYFPPTVKDWPIVPMNMDVVDDDGCQPYPEDTPRIEGYIPLVRRGTCTFETKQKNLEALGAQYILFYNNDAPLVTPGTGFVMDSLIALITAKAGAEILRTFKDGGEVTADFSGNPEAVVGLDYPAGGRPSTFTSWGGTYDLQIKPEIAAPGGQIFSTWPNGQFALLSGTSMACPYVAGVAALYISVHGGRDVHGAGFAHMLRQRIVSSGVALPWSDGTAQGFDVAAPVAQVGSGLINAYKVLAYSTSLAFDSFALNDTRYFSRYHDVTVANNGDEPVAYKFSLAPAAGFETMGVFDAPLKGDKRLFSRRELTPVQLVPRAYLPKDFTLQPGQSKTVSVNFDNPDKLGWNANGLPLYSGNILIQGSNEEQLAVPYMGLGADLKRQMTPIFRATYPFSRSGINLQNINQKPWYTFNLSLTAQDFPKIYVKLVWGSRELRWDVSIYYLICLESFLPVEREREFIYDTTYKEHQWRYPPVVGENGYIGTVAGWNGATMNINFDPRRHDANDTFNFPDTNLFRNAQASNSYHEFWWFGKLGNGSQIELGKYQMRFAALRPFGDPKASDAWDVFKTPVIEVRGKY

SEQ ID NO: 1907 - protein, 644 aa, Unknown
  Kingdom: Fungi, Phylum: Ascomycota
MPPEVPYHRPSLQGQRLWSDDERSLSDSDDMSDSGSRDGPARSVPAPLYLGQDQRPTSRKELLGWYAYAFAAETYIICGIASLLSPSEPPEADHRTALASFIPILLESLARENGVLLSDPSKPCGASDDKSGDDGQCVVYVLGIEINTASFAMYTFSISVLLQAILVVSISCAADHGNYRKKLLLMFAWIGSASVMSYIFISKETYILGALLTIISNTSFGASFVLLNSFLPLLVRNHPEVIAARGTDTPDLGDSDLESRQLQVSPPDSTTNLANSTTTLLADDMPSNGIAASARNLRVKTNEDLTSKELQLSTQISAKGIGIGYSAGLFVQCLAVGILIMMNNTTWSQRIALCFVGLWWTVFTIPAAMWLRPRPGPPLAQQGRGRFAWLQYFIFAWKSLFKTVMVARRLLDVMLFLASWFLLSDAIATTSSTAILFAKTTLHMKPAALVLISVISTTFGVLGAFGWSYVSKVFGLRPHQTILVCIGLFELIPLYGLLGYLPFIQAWGIGGLQQPWEMYPLAGMYGLVLGGLSSYCRSLFGELIPPGSEAAFYALYAITDKGSSVFGPAIVGAIIDRTGHIRPAFWFLAVLVGVPAPIIWFVDVERGKREGEKLAGGVGVEVAAHTSSDAHYERETRGMLADYD

SEQ ID NO: 1908 - protein, 1073 aa, Unknown
  Kingdom: Fungi, Phylum: Ascomycota
MLATDRRHRHSLPTTAATDDLGSSLITSASGRVPSSNWINANEGNIFYRPRNHVDRHQRSAASRAAQLPAPLIGPRRTRPHSIHILTYPSGYIPRELRPKANQSSRRRSPAQSDSNHHNPRSSRDSSEPQRQQNSSKAQRRRLASARRDKSPIRPVLHKIFSTFSNRETSQTSSLPRSRPSSALVDRIPQSFSFPPTTSTDTVGTHPASSPTLNHSSTSAGAPLARSATTPGLNSGELARVTTGATQRSILALRPADDVVGLALSPGANYGDACSHYHHQPAYHAELSHAAGNCSYNSRPGQFHSLSTPDIPSNTTDFFSHDMAGRIAAPHSAYHLPHGARGNSLMSVRSAKSAVNSFVTEVPKPVATGSGVTCSILLAEPNVFLSGFDHDGNTQREGTSGTALLRGKLQLNVTKNIKVKAVQLKLLGRARTEWPEGIPPLKADLFEEQGLRTQVLTFFSAINEGWETEYGNQCTYKLRNSSANSSSTNLPAGPPHSRPSPFATSSPTNSSRHATTAKELKRLSLQHNQSRSFQKGESPIAASTQVKGYKVFYPGTYDYNFELPIDHHQLETTKLQYGSVKWELHATIDRAGAFKPNLHGVKEVSIVRVPDQMSLEMTEPISISRQWEDQLHYDIIISGKSFPIGSKIPIAFKLTPLAKVQVHKLKVYLTESIEYWTNDKRVTRKDPGRKILLLEKSAGKPLEPQWASSNMRTVRGGELSQEERNQARNTAARRRSVEASHNRTTPEPLPPPTDNILGDLDLGLESLWGSTEIEANVQMPTCEMMAKNKELRLHPDCSWKNVNVYHWIKVVMRISRLDPDDPTGTKRRHFEISIDSPLTVLNCRATQANTVLPAYSGSQSAPALYQAVCGCPDAQSIPNDHSPNSSSGTLPNLEADNDMPAPPQAAHLSHNHPMNPASGTQSPPNDSTDAWGMHGGARPIHLLRVPSYNPPAFDDDTAPPPAPELVAANPEAAYAPIATPPPQYDVVVGTPSVDGLADYFTRLADHRFAEDDSGSDSDESPLRMLERTGRVNVAHPHTPGGRMTSRSFEIARPPVQLDLNSLASHTRPRPTAS

SEQ ID NO: 1909 - protein, 527 aa, Unknown
  Kingdom: Fungi, Phylum: Ascomycota
MRQVISHTSVPGHLQQRFSVLSTMAMAFAILNTWIALAGSVGLVLPSGGSSALLYGFIFCVLCNFALVGSLGELAAIWPTAGGQYHFVYAICSERWRRPMSFLTGWANIFGWLSVITVQAFFAAQFISAASVIASYEAYIVTQANTYGIFMAVLVFGTVVNIWCNRILALWSKASLYWSIIGVLVVSIILLAMSKKATADFVFAEFNNETGWPDGMAWLLGLLQPALSLIGFDVVMHMAEEMPRPSKDIPRAMIYAVAIGGVTGTLFILVTLFCFWDPETLLASSTGIPVAELILQATKSRAAATVLNLMLAICFINGTVASITSTSRLMWSMARDDGIFFSRFFSKIKHSLDVPVNTILACSAFNALFGLLYLGPYVAFSAYMSSCTIFLNVSYAMPVIMLLIRGRDTLAAHQYPGVPHQLGRWGLPVNVVAALYVVITTVLFSFPTVLPVDSDNMNYVVVVFGIFLIFVTIFWVIRGSQFTGPDFDSIFRSAGAMVEDPETLAGVPPPSESKEEGLKCGKHLSNN

SEQ ID NO: 1910 - protein, 319 aa, Unknown
  Kingdom: Fungi, Phylum: Ascomycota
MLLLDYQNVLIQSVLTERFSGAPPASIDQTVSDFDGVTFHISTPETKTKILLSIQIRCFQDLVQHGAREVLEREYGPYVVQTEPGFDFSVMVDLESLPESKEEREALALKFALLKRNAMAAPFEAAYEEHYKLREEASKFSSEDAPQGVREGGEVKAIHYREEEAIYVKASHDRVTVIFSTVFREETDRIYGKVFIQEFVDARRRAIQNAPQVLFRNDPPLELQGVPGVKATTTGEIGYVTFVLFPRHLTPQRMPEVISHIQTFRDYFHYHIKASKAYIHSRMRKRTADFLQVLRRARPENEEKERKTASGRTFKVQSG

SEQ ID NO: 1911 - protein, 477 aa, Unknown
  Kingdom: Fungi, Phylum: Ascomycota
MANDAAAQSGAVRPQLGAMRSSSYLSDHQQYRPRHKSPEGFHGIDTVVEDLNLGSHASSPKPILPFNGIPSEDNPPTIVDSGINHNYSHPNCAPPEGEKTDKLVATLFYKTKARAAAAAASNGSLPPSGGSNEHLPANMAPTTDMKAFPLEPPTHENESLDHLYGNYISPLCITSFLHLMSTFPMPHEGDEPHSSHRCLDNPENPRVVELTLSPAPRADYLSLQDLRKHEMIYRFEQEWNVDVVLQKESVLRRHPRLVVFDMDSTLITQEVIDLLAEHIKDPPDLAARVAEITERAMRGELDFEASFRQRLALLKGLPDTTFNTLRPVLDVTKGVPELIRALKRIGVKTAVLSGGFLPLTAWLAGELGIDHAHANEVVTEDGKLTGEAKGIIVGKERKQELLIEIAKLEKVDLKQTVAVGDGANDLLMLGTAGLGVAWNAKPRVQMEASARLNGESLLDLLYLFGLTAEEIETLISA

SEQ ID NO: 1912 - protein, 548 aa, Unknown
  Kingdom: Fungi, Phylum: Ascomycota
MAGGVVKKPVNIFKLGDLGEPAGVFNWRLWFAVFSFGMMGAARGIDEGLISGAFKSKDFQKSIHFSSYSTVEQANIKANVSAMVQIGCVGGALIAFLICDRIGRIWATRQLCIVWIIGIAIFMANSGSLGAIYAGRFIAGLGVGQTAVVGPVYLAEIAPAAVRGLCTCVFSGFVYLGIVLAYFANYGCSIHMDPESKARWLVPTSLHLIFASIIFVLSLFQHESPRFLIKKGKSEQATKVLARLRQQPVDSDYIVGEISAIQLAHEHELESVNTSFIGTCKELFLNGSNLYRLYLASMVQVLAQWSGAGSITLYAVDLFALLGIKGSETGLLVTALFGIIKLISAIACALFLVDVIGRKRALMGGIALQALAMVYIAGFLTAVPDPHGGSAAARCAVAMIYISGIGWALGWNTMSYILTAELFPLRVRAFATSFAMTLHFLCQYGSTRATPNMLLPTSEGGINPNGTFWCYGAILIVGGLWVIVSVPETAGRTLESMDRLFELPWYKIGLFGNRDAEQRDIVFNEKGQAMENSQGQVTYVEEKPTRTV

SEQ ID NO: 1913 - protein, 1081 aa, Unknown
  Kingdom: Fungi, Phylum: Ascomycota
  misc_feature (502)..(504): Xaa can be any naturally occurring amino acid
MMLLNHQQVECEVGSDARHAFHIESWSQLITSRTRLNGEARGYSMAEAQGDDGPKLTVPKFASFKAKEPSKSGTHPPSFKQEHHHRSRDSRKERRRDRHDVDQPSSKSRHQDENQSRHERPRRIETRSPSPSRSHQHHKRGRSDVAQGGPDRKRPQPGTSDEKRGVEGLYVIDTKGDPLLKKYGNNVHYHVPSSYRYPPGRVLGAEGRLYIHRDGTREQFSILQPGERPDSSRHSDSLRSRWPRAHPDPVRLRPLPISSGKEDENPSFLQIGKPKKRKPLQSSGSDTSSDEADLAYRSIEGKMKAKPVSEDESELDSDAEVDIHQDNPLRWRSVQLNLRVKEHPEDIDSWLELVDHQDALLKSGHSIDQSLHENEVHSYAEIKVSLLESALSYAKSKDDRQRVLVPLMREGSKVWDRKTAAKRWAGLSEEERSSFELWKADLDFRMSDVANFQYEDMKNLFLARLKFLVADALTSADTKERYEEAVYVFLRMTRMIADAGYXXXLDKMTFLLHWSPSKTFGRAKFLAETPETNSAGDDELTTRDPYKLWAALEQRRGREARIPARTLDQGNDDDPFRVVMFSDIEQMVFSIPRRILEEITDQLVDAFLVFAGLPPAVRSDAWTQLAAQDPHVVSGSLRTRALGEQSASGDDDSTKRPPPFHGRVIDHGEASVPRDVVERALGQVVQIRNIPGLAEYLLAISHTGDPVSIKKQAKTLLKQYPTNISLFVAYALAESSNGNNSAVQKTLASAADISTQHDLALVLRAWAWIELERRNRAASLRVLCSAAEPVLRRSLDKQEAVTSSQILKASQMFESEIHAALYSGSSDTVSLYGECTLLLAYLTSTDSKEPSSAAQGGIEAAMEVTSKLSHELSRRSMRQSTGHEMLLQAASRVLYWHAANGRVFLREKLSAFVEAFPRNGIFLSLLEWSDSGLRVIDETRQLLHEKSLSKDQDCFSTRVFAIQHELERGNTNSARAAFEGAVASDACKASPCIWTWYIQFSYSQKSLRTKAKEVFYRALRHCPWSKQVMMQAFTTLIRIMESTELKAVYETMTSKGIRIHVEMDDYLQMHEAKRTRERGQR

SEQ ID NO: 1914 - protein, 451 aa, Unknown
  Kingdom: Fungi, Phylum: Ascomycota
MAPARQQPPPLYSKDEKVLCFHGELLYEAKVMDVQSGEKSGNGEAWEYKIHYKGWKKTWDDWVGKDRIRPFDDEHKELAAQLHAQAKRSMQATAKQTIKTSKVGNDSTRGSEERGSAAVQGGRGGRRGKDWELEQNCIMGLTHNHPCVRIQQLTEITDHLARLPKPGQHYLSACGKPLWDDRYSGTFSGVKKPSRSVQKARAQRETKRSSCAACLVDRGIAESLSSADMARPVRGLDTPGRSQCTLPPCEDRLLSRYSDFRPPHQEDAFHSKPMINIPVPDHVQAMLVDDWENITKNNQLVPLPHPKPVSKIFQDYLAYEAPRREEGSASMDILEEVIAGFREYFEKALSRILLYRFERHQYMDVRKLWDNVDEKSEYKSVCDVYGAEHLARLIVSLPELLAQTNMDQQSVSRLREEVSKFTSWLGRNTETYFVSEYETPSQEYVDKARSF

SEQ ID NO: 1915 - protein, 484 aa, Unknown
  Kingdom: Fungi, Phylum: Ascomycota
MAMLCQKCRQPLKLDGSLDELNPAAYDLLISSSSPQTPLKKPSQSRTRSPIPHTQEAARKSVYAQASQNATAPTFKRQSAGNPRDSTMSFIYLTESVMATPASPAKEQPGTPTKMRRTSSSKGGEEQETPRADEVDRMNRLFEILSARSDIDHPVCVECTDMLIDGLQKKLDAANRERNMYVAHLKEVQATQPTPVELKQQHEALKKAEADKTSAMTELRKLEAEKDSLDAEILALEEESRQVDKEEEEFWREHNAFISEMTEFRAERDSVAVKYANDTQLLDKLTRTNVYNDTFCISHDGTFATINGLRLGRMSSKPVDWPEINAAWGHALLLIVTVADKLGYKFQGYDPQPLGSTSKIIKYETASPSSSRLTSHRGPGPPPKKHILELYSSGDMPLGLTFMHRKFDNAMVGFLELVRQLGAFVQAETEARGKMLGLPYAIEGDKIGDVSIKLGIAQDDGWTKACKLTLTCCKFLLAHASNVG

SEQ ID NO: 1916 - protein, 417 aa, Unknown
  Kingdom: Fungi, Phylum: Ascomycota
MASSLFVAALLATGAVAQQSVWGQCGGVGWSGPTTCTSGNTCTKQNDYYYQCIPGGAGGGSPTTTTTTTTARTTTTSQPSQPTGGNGGGNSGKTQYFGVNIAGFDFGCATTGTCTTSKIYPPLRDFTGANNYPDGIGQMQHFRNDLGMNMFRLPVGWQYLVNNNLGGNLDSTNIGKYDQLVQGCRATGAQCIIDIHNYARWNGGIIGQGGPSDDQFVSLWKQLAAKYGSQSNVWFGIMNEPHDVNINTWAQTVQKVVTAIRQAGATNYITLPGNGWQSAGTFISDGSAAALSQVKNPDGTTNKLIIDVHKYLDSDNSGTTTTCVRNNIDDAFAPLANWLRQNGRQAVLTESGGGNTDSCLKYFCEQIKYLNQNSDVYLGYTGWSAGSFDSTYELVLTPTWNGNGWTDRALTKCLLQS

SEQ ID NO: 1917 - protein, 389 aa, Unknown
  Kingdom: Fungi, Phylum: Ascomycota
MADRTVPVPDTDTLPITGLPHLLTHLDALDSDPSTPIQPKLFDDVELQLTDANSPRILPTLLPRLTSLLFTLTTQDPSPLLSLLTKLLSPIPFQSILPHATPSALLVALRSPLPGANILALSIIHKAAASTEDVSILVDRMADLVGETVTLWVGSRDTGVAEKAAKVLGELLEMDCPTVVPRTSTATNGTSHFLSTSSTTRHLYRLETAGQGLLWRLIFQNPDNLTRIIANCSLRLPSAVTSAFPPGAESRPERDITISQGRLLRLLPRLVALDIQPLFADHFPLFQSFNATNNNLLSWAALEMVDPSDALMQLTLIDFFETLVSIARVSSHQPPIKDEFVKGLVRLAMGKDESGELRRAMLSLPDRTIESEAEDLRRYLSDVLNLSTE

SEQ ID NO: 1918 - protein, 574 aa, Unknown
  Kingdom: Fungi, Phylum: Ascomycota
MSAPGQNNVDLDALLDLTEYDAVSNYQSPSLSPTSASKPTFASPVTTAVPTPSVSSTQQPMSGPSHNYELYRQQTGFVPGAIANTMAVNQTNNTGYQDYNSLNYFSSFTPEDNLFDFNTSPSQATLGGSDLDMEFDSPSDTQNFFSTVNPSSIEQDTNGIPSPSSANTQASNVGRLWPGAHSQAAMAKAQAQQRQQLMQQQQQQQRQSSQQPQKVRGKAPQQTDPLVEQKITQLLNSMRAKPADPDALNQANLGNLPRAKKEDDEMDEDERLLASEEGKKLSSKERRQLRNKVSARAFRSRRKEYITQLESEIAAKVNENGELKVQNRALIEENKRLQELTRMLLSSSSFSNFLDDLSTNPAALPQAPQQIKVEEPQVQQQRQLPKDVNAFGAQPSQQQIGMAMIPEQTMDFSMLSLDNTFNFQPQVFVVDTPEIPASIDTAALSGKTSNFVEETFDAEEKMEVPVIERPVEVPEAVVSDSIPVDQEFESDPDFALFHSEPAPVRDSLKELNTDSLTGLDLFGGVESEKALARYELVDASEEEATAVIALARVHHISENIESVVSRLELLTMDL

SEQ ID NO: 1919 - protein, 901 aa, Unknown
  Kingdom: Fungi, Phylum: Ascomycota
MAAQDILFIDAYDSFTYNIVSLLAEILPIGPDAQIVVQSLHDPLPGLQQTASDVSDDVFAQYLRGFSAVVCGPGPGSPLNPQDVGPFSRIWSLSDENMIPVLGICLGLQSLVSHFGGRIRKLKLGQHGIIRPIEHQGERQTGAATEDIFEGVKPFQATLYHSLCADIGQDQIPEEEWPAAKWATFPSVPDLQPLAWTTIDLSDDSERVLMGIKHRSKPFWALQYHPESICTESASRRVLQNWYKEALAWSQRTGRQSRHVERPGSHSGHGTLPTAIEARIGGHLANHSIADDIVFADDWLEKHRPDLASTAPRDYVCAQLDLPHGVDAAGIADILGETSGSRIILDASSARVKDPLAVQSIVAIGVDNAIRFEHVAKSGSSIRMFVPGSGQAGAQVVELKPTGDIQAWEIVSHFWSARSCKDADKMVTSTGQAHDHFKGGFMGYLSYEMGLKTVSPELARAASRSDNHTDLCMAWVTHSVVLEHKSGKANVQAWGTKDEAASWVRWAVEQLEDGFRKVEVRSSVVPSLNGKERISHLRLRTPDPAVYEEKVRQCQREIAEGNSYELCLTAQTIMTRPAMVDDAGRGNGHLNGFKNANGNGYNGAAVASTCTNGHTDQPSGQTGTDNLAVKNSTGRSTACSTRTPWEIYKALRSRQPAPFGSFICLGGAMLLSSSPERFLQYTEDGLCSMRPMKGTVRKSKAVSTLADAEKMLRIPKEIAENLMIVDLVRHDLHRVCGYGQVTVPEPFKIEEYATVFTMVTGIQGHLNRYIAEPESQESSPAAMTGLDVLRSVFPPGSMTGAPKKRSCELLAEIEGHQPRGLYSGVVGYMDVTGAGDWSVTIRSMFRYDDEMADPEPGETVPREVWHIGAGGAVTILSTPEGEREEMFTKLEGPLGIFRDVA

SEQ ID NO: 1920 - protein, 376 aa, Unknown
  Kingdom: Fungi, Phylum: Ascomycota
MSGDSFASRRRTARSSVPFHLLLLPSVLLVLLLFWQSHSSSSLDTFHSTRSEFQGIPNTEVTLPRQKALQGEDKDILASKSKGNMQITNTQLLKGSMPLRIITFNIRYATETPVLGEQPWAVRGPKLTQQLIFNTEGHDNSFICLQEVLHSQVKDVQARLGHSWSHIGRGRDEKPTDGEFSPVFYRSDIWDCVKHDVKWLSETPHKPSKGWDAVLNRIVTMGLFQHKETGLTVIVMSTHFDHIGVKARENSAKLLIKFAREWNQGSDSNDPTPSAVLIGGDFNSDPSDGAYKLMTAKGSGMSDIADLVPNKEHYGNYLTYTSFGEPGESPSRIDFLFIKEPRSAKVKTFGVLANSFDDNIRLSDHRAVIADLSIPI

SEQ ID NO: 1921 - protein, 922 aa, Unknown
  Kingdom: Fungi, Phylum: Ascomycota
MDAFNGSPASRDFSSAFSGDVSSRTSASSTMEPQPAPENPRPKKKPTTRRRAGSGSGKRRCISTACIACRKRKSKCDGALPSCAACASVYGTECIYDPNSDHRRKGVYREKVDSMKARSSTLQILIEAILNAAEEDVPSIVSRIRTCDSLDTVAEFLINQQQEAEKEAEAAAACIQPQEQTDRGLLTDDGEIELARKMGELRMENGNVRFIGGTSHLIYVGEPTDTSSEDLDTGDYSASDDPITTWTRVTKDPHVIKHLMQMYFNYHYAYFATLSKVMFWRDYSKGKAGLVGHTGTVYCSSLLVNVMLALGCHFTDIPEAYAVPGDNRTKGDHFFAEAKRLILENDEFARPRLVTVQALALMSVHEAGCAREAKGWVYSGMSFRMAQDIGLNLEIGGFDKERMTEHEVDARKITFWGCFIFDKCWSNYLGRLPQLPGNSYSVSKLDVFPSEDAELWQHYTDDGFGNKDQQPPQPARTRAAALQLSSLSEISSDLLIFFYHPNHIGRSSGKAVELKKLSELHRRLEEWRKNLPQEFEPRDGQLPNVILMHMFFHLQYIHLFRPFLKYHPSSSPLPSHVSPRRICTANAGAISKLARLYKKSWDLRQICNIAVYMLHSACTIHLLNLNLEKTARRDITHGVRHLEEIAEDWPCARRTLAILSVLARKWRCELPAEAAVVLQRTDEKFGEYNLSEVPSPHSQTGPSPSNSERANGVTVPHAQRETSPTMQYAQSQLTQPTRPSAVTNGLSMANPMNNLGNGTRTRPDVLDGVSSTNALDSFAPDWPSQPPASAPTHMQDFSVSYPQGQRQQRQQQQPPPMPAPSAPLNLNMDGQEWLFTDSARWQQSFESWPGPGPNSPVFIFNDRLASNSPGSTGSNAGGVNGGHTSNMNGGGNTASGDAAMGAYGFEGLGVSLQDGGWLPGLD

SEQ ID NO: 1922 - protein, 831 aa, Unknown
  Kingdom: Fungi, Phylum: Ascomycota
MDTSTSSPRSRREIDHSAPLKDIVVCCTSIPTEGRTIISQRVAELGGIHKYDLTPDVTHLIVGDYDTPKYRHVARERPDIKAMDASWIVAVAELWRNGDDDFDFDALERKHQLKPFERCGSMPESLAGDGSPRQGLLISLTGFGEARDGIADKITANGATYTPDLTKQCTHLIVHQPEGKKFTAAKQWGVHTVSLQWLEQSLERGLILEEPKFDPLLPFEEQGLGAWIKKDPRRTSLGKRSRSGAAGPGEEGKGPRKLRKTASMKLNSQRDGLWGDILKRPDSKDNTNAEESNSALAPDRAPPGAAKTQGEAQRISLPVPQGVFGHSTFFIHGFPSQRAQILEQTVASLEGSIVSSLSTLSRSLDSSFRFLIVPQSSQPDTHPTLPDGDIHIITEFYIEKCLHNKQFFDPRDHVIGRPFPAFPIPELAAMTICTAAFTGIELSQVARSVTQIGATFAEEFRPSASVLVCRSLAGTRKEKLKCALAWGVPVVSAEWLWECISTGYRVPFKEFTFTELKKRRSLADGEDHKSSSSGRSQGNEASAKHGSVQSLPPTAPAPAASKSTTSKPPTVDRSGFTADDVSGRLKQTLQRNATTKQESTTSADFHTARTNLVPARDTDSSLTELSSASLNKSPSPTKVDTSTNPFRSKSDPIPRQKENTLSTRAPSAPPADTAPLGDANEEAAQHQALLTSRLASLVDTSASGGSPSFHASADEPKPRRRQLLGRATSNVSATSSNANANPSVTPAVAPSDGAVAFGGDENSVAGDLEGQDEAAYDNAHPGTQLAYGDPEAQGVKAQIISRMAGENTKVIARTGDGALDTAVGGRSLRKR

SEQ ID NO: 1923 - protein, 327 aa, Unknown
  Kingdom: Fungi, Phylum: Ascomycota
MATITETTTSLSTQRDPRAPEGIEKLERHGYLFGQHLANSFSPYLHDVIYSHLGLSWGQVRLDSADMDLFLHLVQHPDFYGASVTMPNKVAIIPHLDEMTDECRDTGACNTLYIRDDPVTGRRKLCGAQTDVIGIRDSFIHNVDNLPQVVHNRPGLVIGGGGAARSAVYALRKWLKVTDIYLVNRDPSEVEAVIQDCRRQGYGEGLVHVSSAEQAQGLEGPGAIVACVPDFEPQTAEEKLAREITNIFLEKNKGAMLEMCYNPTPFTKLGGIAESKGWQVILGTEALIWQGIEQDRYWTGKSSDELPVEEVKAAIANKVAQSSKQKL

SEQ ID NO: 1924 - protein, 211 aa, Unknown
  Kingdom: Fungi, Phylum: Ascomycota
MASSAQPTGKTFIVEHLDPELGPWSELEYLAIANETKETGGKFILSSLPDAFQVPEGLKVNDAFTAEKRGVEELYAANKARVCLLDPAAAKDLSPEDGETFDAFLFGGILGDDPPRDRTSELRKKGFEGRRLGPKQMTTDTAVRVTRIVVQDKIALTEVPYVDFPELKFSKHESTEMPFRYVTDAQGEPILPPGMKDLIQKDADKSVDDLF

SEQ ID NO: 1925 - protein, 502 aa, Unknown
  Kingdom: Fungi, Phylum: Ascomycota
MNNTILPIVVGEDPLILYWPSDAPTTTPSLTANLNLITIVNALIWRNDDVANWWPGYGLCDVLPYIQHFVTLLYMTCLLAIVRNLAQQVGLLRANPLTAKEKRRRNLGQALIMFPFPLLQAVLTWFLTYQRYVVGTLVGCSWTGYPTWVYIVFFIIPAPIFAFVTSGYAILIYVRFRELAKSTGLALSSNRRANDRAQRTRRRLYLMVVSIIIPFFPIVLTLTVLNILDLRDLKPYDYAAIHDHMEPYPWDTIVYLRSGDLDFAYLNVSWIPILSAIPIFGFFGTTKDAMNDYRRLLLFFGLGKIFPRLNQEYDPDRRVGDSSNGSSHYNSTISAAGKSPHKVISLTSSFRMLAHSSSSGGGSAAHELQSMERIASNDLESGVAVPSQAAKHPTDDLIQIPHRNPWLMRTHLNFPIIPFPFSRKSNREQVESPSQVSLNKFNNTLGQTSPPIRTRVWHDEHSDSHDTRDCDDDADQRSIASAQGVVVETHLVRESHPTDGQR

SEQ ID NO: 1926 - protein, 1435 aa, Unknown
  Kingdom: Fungi, Phylum: Ascomycota
MPSAGGNKSGSPMIAGSAMSGSGFSDLPDDEILSTGLFDFENSPDTLQTFGSANSAGSKMFISPQELQTAESLPDSPNGSGQDSSSESAPSVKRDGSNVHSPQNMNNGGELGLGSDMDGGMDWDSGDFADHGHDHDSYSTFNFGHSTTSPNMDEVYPFGADDSFLNSSFDVSGADDGMTSGAVTAMPSPGMPTIESDNRSNIKTESAKKTPPRAKKPRQKKSQQQQTQLHQPGSATSALPTASQAPGSREISPMSQVMGSENGTQVSAMQTSPQNTVADFSGAMTNGSNGWMQNMNAGQFTMPRDLPYHNGMNGQPGMAAPNMNRLYHHSPYPPGYFFSNGPYELLIFTRPTKSRVETQIPITMVLNPLPPGIRRLHLPTHKISKPKLLAKPPVAPAPDMLELHVSLVCTTAMEKPELQEKALKRAREAPHKYLPREDEELKPQEGDEVFICKGCIMRERKRAGRKKIKHVADELMWTQDEQHRAIVFNTKEVQVWESLENLFDSEVPVDTGLPRGTMQCSIPLRIACYCRHHGEKSGFKVIFTLKDWEGNTIAQTMSRSIMITDDHKTHAADKDKTLTAGSKRGLSDHISAANANVQPNGFPAAAGNSSQPAAMNANLNQMPPTMPANFQPSPNPAAAPPTAASRPQSTPNSPGQGGPSAKKRKSSGGSRVPNDLTMTRLETSVSPGPTGPGSQISTAASPFSPNMNPFPSGEQLFAQPGPLTTGPPTPNNNDQIPFFGAHRSGSMDNLTMAQLYSAPTSNHASRAPSPNGLRNAMGGGPQAQLGQAVSNSLNNMYTMPMNMSQARPPPTIHKIVPAEGPTSGGIDVTILGSSFFSGLEVWFGEQKATTTTYWGEPSLVCLLPPSAVSGMVPVILKNQLGQVVQTLGRTPQMFRYLDDNEDKLIRTALSVLGHKMSGQMMDVSELARRILNDSGSSNWGGNSGGQSSGSGATFNQASREHLESQLLKCLDLIDLDDSPHRTFLDLKSETGHTMLHLASSLGYHRFVAALLARGANPNARDLGGFTPLHMAAMRDHPEIVRRLMLAGASPSAKSVSRLKVADVAKSRSVLRAIQRSARHARSRSGGSLHSRASSTSSLRSLWEPMSKIRTHDGTHDEPTSPDSSDESPEYSTSDYEDEEEDSDEQPEFLHMRRPSGFHQDTDKPDPDELDEGLPSPTMNAMTAAFKEHLQQQFQQFQQSMALHIQNLPHLPQMPQMPQMPQMPNFPNMPILPDYQAYLQQRPFMRKMTQLMPGKPGSRPDSQDSDSAKTDSKWWALSTYMNNTGVLPPAYEDIFPQKARDTKQLSAAQAATEAAADAKCSQQFDLASDSIVEPATRVQVPSVLKIGRKDAITKEQQEQFLEAQKQKYKRLSNDRNLFFIWIPLLIAMICAMLYNYCPSLFTIAFSYVLLALDKGVSQVNRLLSHLEDRAAPAITA

SEQ ID NO: 1927 - protein, 818 aa, Unknown
  Kingdom: Fungi, Phylum: Ascomycota
MAGLDLMDELQYDAAIEALRRTEYPSIQDSTYLDHAGTTLPSRSLMETVGRELTQTLYGNPHSASSPSQLSSCRIEDVRLALLSFLGADPRHFDLVFVANATAGIKLVTDGLRSMPHGYGFIHHEACHTSVIGAREEAAWTQCLSEAEMDSWTSTTGFTQSSARRTSATLFAYSAQSHFDGRRYPLSWSDAMRKASVDTLYTLLDASSFCSSSSLDLSNSQLAPDFVVLSLYKIFGFPDLGILLVRKPAENVFAHRKYFGGGTVDMVLCGKQQWHAPKTQALHERLEDGTLPFHNIIAAGIALEMHKTMFGTMERISQHTSHLANHLRQGLAQLKHANGQPVAVQYSSNDGDDALGRGPIVAFNVRDSSGAWASLSEFEKLANVRKIHVRTGGMCSPGGVASALGLEPWEMRRNFSAGFRCGAEDDIVAGKPTGAIRASFGAMSTLSDVIRFLDFLSEFFVEKNVTLSTEEDVANDDPVSKHALRVKAVTVFPIKSCGGYTVPPGVEWEVKPEGLAWDREWCLVHQGSGQALSQKRYPMMALLRPTIDFAKGVLRINYRNTDNLTEATVSVPLDEDPRLFEPSISDSTARVCGEPVSMMRYACGNINNFFSEVIGVPCVLARFPAGGRGMASRNSKAKLQTHQRKRAPRLPGAFPGVPSPPDSDSELYQPGRILLSNESPILMIYSSSVAELNRCISDTGADAVPESTFRANIVLESTESGTAPAAYAEDSWDNIQIGSQRYKLLGACRRCQMVCVDQETGKKGQEPLSTLAKTRRYDGKVYFGAHMRHEPWTGAGGSRNSRPWIKVGELVSINSLSS

SEQ ID NO: 1928 - protein, 190 aa, Unknown
  Kingdom: Fungi, Phylum: Ascomycota
MGKSQSKLSQEQLAELQKSTHFDKKELQQWYKGFLKDCPSGTLTKEEFQKIYRQFFPFGDPSSFADYVFNVFDADKSGTIDFKEFICALSVTSRGKMEDKLDWAFQLYDIDGDGKISYDEMLQIVEAIYKMVGSMVKLPEDEDTPEKRVKKIFRMMDKDENGSLDMEEFKEGSKRDETIVSALSLYDGLV

SEQ ID NO: 1929 - protein, 1175 aa, Unknown
  Kingdom: Fungi, Phylum: Ascomycota
MAPASASPRHTPTSNGRRRGRPPGTTNAARAARQAALGAGMASEPPPKKRRYIPGGPGGGGRFVDADSDDATPTARAATASRPRAPRNSLNGSTPSVPLRRERSARTRSFAADDAEDVEWGSAAAVAASVQQADDYKPREERGWEEFHPNLDIEGTFMVLSADEVDGVLPQDAPNTPKAQTPGTPLLGNTTPSRQADLASTNNTPSGQNRTETNPFETSLATPTRRPRRFTRDISSFHGARGSEPFTTPKTPKILPIHNQTPKERLDLKLPSYRKTNRIELFESKKFGQARYVDRSMSNVGYQESDSFPRPERNLIKAIEGNVDDDPIMGSPANTEEGTHATRLLRVEYDMDEQDDMWLEHYNAHRKQNELEAITREVFEITMTGIEKEWHALERRIPKPNPKPPQTHRPRSSSAAAVNGESREGEEPDSKCAICDDGDCENTNAIVFCDGCNLAVHQECYGVPFIPEGQWMCRKCQLCGRGVPTCIFCPNTDGAFKQTNSSKWAHLLCAMWIPEVSLGNHTFMEPVMDVEKVPKTRWKLSCYICHQKMGACIQCSNKNCYQAFHVTCARRAKLYLKMKTSHGALAVLDGSMVLKAFCDRHCPPEYSKENGVHQATRAAKKFYKRNMRGRIWADNHAMANVLAARHRNALTEGPPPDEAQGVKNPGTVGENKKSQPPKNVWKLPSGAPVIPQQVFEVVEASIQRFPFRKRKDYLSEACRYWTLKREARRGAALLKRLQLQMESFSSMELTRRNFAAMGPGGKQRLARRLEFAESLIKDLEQLKELSDELVQREAVKLDAAELEQEFVDECYFPVAKVLGTAMEKAVSLDKDVFAKALSQMQAQMQQRYYVTGLSFAQELGDAISKGIAMPFEPPAKPSQGTDTIDASPVKGTFADIRERRKLGKRILKAVQPYIETALQIESEISSRPYDTLHTELEAVIETSVEAKQSTVTGTSNGTSAEDVEMPDAADHNSDNANGLIESDSMKVDKTEADQDSPTERDTRDAQATEDAPGEATGETTQVPATGDSKPQAAPQAVDSHTPPGTNESFTTLTQTGHNGPPTPPQSNGSLGKTSADPLSEGGVLWHMRAFEPEGTSVVAEFWAGRDAIRMLSEDLTDMDDDELKGLGVDVDIPDAILTPADADEDSSLGHAVKGRTGKALVANANKKRRTSARRR

SEQ ID NO: 1930 - protein, 331 aa, Unknown
  Kingdom: Fungi, Phylum: Ascomycota
MPGGVCAVLDYEVELMTEYVAEMATRVVTPDANVTSSFRKFVSQILTSTRLPSTTILLGMNYLAKRVNGMKSQGPYKASEGQVWRYLTVSLLLGSKFLDDNTFQNRSWSEVSGISVMELNRLEFDWVQAMSWRLYVNLDLSKDYQAWLDNWREWQDMKKRQAAQASRDRLAAIVPAIDTELARYNSHHRHSPHSRYIQDQVAEYERYQALKSQQHNYRSREAAWAHNPWNAPLTPPDSGYGTPDYGMSSATSANARYNEWFSQASTQQYASRYQQPNAFYTQHQNPYATQTHCNQGMWEHGVAECSCPNCIGPMKQAPYFVSSGYGQPVMG

SEQ ID NO: 1931 - protein, 512 aa, Unknown
  Kingdom: Fungi, Phylum: Ascomycota
MTFGDAAAYSDVVVVGVEGQIREETGAFNANVLRRLRRLEDHLNLADSDDEVIKEPRAVANMRMRIAAEPRDESLKPLWPSIQVLEQTCSSRVDSKVWDEGLIKRLWMSFHDTMLGLHFMPSRQTFSSPTPLLLAAMFYCSSTRGSSDVAILATEYFSVLCNAISQLCMPGSLVGQQPDHPARAEEWAFQTVLGIILAGLLREGLTKETGVWISIAYRLLLEHCPPNIGERSLEWQRLMTGLQIVDLEHASIHLACPVIPIVAPFARLRVSPQDQLYRLSHMMHTGLTHFTGRGLPTIWSYFTSESPVAMDSSTTFSGVDAAVIRDWARQLDNWLGEFGARNSDPEGEEKLTFRQYVLHRVLVLSIYLPARGSDLLSSTTPNEQYELLISARAAVRLHLADSSIWSNFDLVIITWAALIIIQGVEGGFGEPDDLEVVNVHLAKLREINSQGAGLQELLATRLEARLEALTTPAVPTDDHLGPDGEFDSSWAIFNQASLQVGYDMFAFGVQPS

SEQ ID NO: 1932 - protein, 307 aa, Unknown
  Kingdom: Fungi, Phylum: Ascomycota
MSVPESKYMSPIWRDGIFNGRVAFVTGGAGSICSMQTRALVRLGANACIIGRNVEKTEAVAKDIATVRPGAKVIGIGGCDVRKPEDLKAAADRCAEELGGIDFVIAGAAGNFIVPLSAMSSNAFRTVMEIDTMGTFNTVKATIPHLLRSSCPRVLFISVTFHYTGVPLQAHVSAAKAAVDSLAVSVALEYGPLGVRCNVIAPGGIADTEGLSRLGSAAPETLKSYNAAVPVGRLGEVKDIADTTVFLFSEGASYINGEAIAVDGAAWRRQSALPLGVSHEAKYPDFLLTGEISKDLKDPRKEKKAKL

SEQ ID NO: 1933 - protein, 180 aa, Unknown
  Kingdom: Fungi, Phylum: Ascomycota
MPNSDAPSPCEQFNIPPPSIYSPTSQYFAIATTSQSIAKMFRFRKTLDIITLFHKPNNPASTRVATLLKQASANAQAEATIDQASDHSNQTSPARDDFELNITEDAPTQDQVQTILEYVGKNKIQSVIKGAHDQKDALQKFKENKDSFQRPIVVDWNNGKAVVGDNESEILKLVKASNTQ

SEQ ID NO: 1934 - protein, 127 aa, Unknown
  Kingdom: Fungi, Phylum: Ascomycota
MPIINHTSPLPHSYQDLPVVAGKPLLVVYAASADPSTGEPWCPDVRAALPHLQATFAGADQPELTYVEVGQRLEYKSPDSIFRSSRWNIANTPTLARYERVDGVVKEVGRLIEEELLDKERVKKFIA

SEQ ID NO: 1935 - protein, 625 aa, Unknown
  Kingdom: Fungi, Phylum: Ascomycota
MPSTKGPIRVAGASGGYTDRQRAIHDLAQECDVDVITGDWMAEGTMVMHGVNKSKKLQDPKAQAGPCYDPYFLGTLDPALPVLAEKGIKLAVNAGASDAALLAKEISDRIKERGLDLKVAWIEGDECIDQIRELRKKGDPLTNLDTGKSMDEWGFEPIYAQCYLGSFGIAEALRRGADIVVAGRVADAAPTVGAAIWWHGWDRSNLDELAGALMAGHIIECSAYATGGYYAGFKDLMENCENLGFPIASIEASGETAFTKGAGPGGEMSVGTATSQLLYEIQGPYYFNSDVVADIENIVLTQVGKDEVRMTGVKGLPPPPTTKVGVTSETGKLWQAEFHFFFVGLDIEEKAKWTEKQIRYAMRDHIHKFTQLKFHMVGSAAEDADSQDAATVDFRVFAQTRDPTIVGAGGGPAGTGLGTMTTGTFVRWCLENFLQSCPGATVEVDTRQSMARPMLEYWPTTMPQALFQERAIMEWSGEAIDIAGPTKTQTYGPQKSYEATNPVELSSFGPTTRKPLGYVALGRSGDKASDANVGFFVRNDDEWDWLRTVLSTETFIKLLGKEYTGNRIDRCEFPGVRAVHFLLKDHLDRGSVTSSSMDPFGKNLCEYIRARHVDIPNKFLERGRV

SEQ ID NO: 1936 - protein, 655 aa, Unknown
  Kingdom: Fungi, Phylum: Ascomycota
MSSYRCMRLACQSKALPAFPRCSPAQRLGHFLARSQYSSEATAGRFAHQSGSDANASEHHGQDAQNDEMSAFKQQRLVDLARAREGESPLISESYPRLKSNPNKMSNAEFRRRFTELEQTKRSQSSAQGAPQVLASTSSASSGASPVQSKDNPDRKPTDEEFKEVYQEAEREATLLRATLTGRVRAKRVVGSGLVFVDIVNDFQKVQVMINKKKCLATEHRQVFKMWRNLIQVGDHISVTGTSRLTDAGELTLEAESLPQLLSPTLEQIPDKLSDSKTKREERHLDMLVNKQTTDVLRLRAAITKHLRDHFHSNQFLEMQTPILADNAGGAIARPFKTRATEFSEKELALRIAPELWLKRLVVGGIDKVFEIGPAFRNEGIDGTHNPEFTTCEFYSAYSNLAELIQQTEHIMFGIASECQKLISTDLTALPEIDVEMFRGPYKQVEFLPGLEEAIGIRFPNLSAEGALPELIAVLKLAGVDLGGDTPRSLHKLLDRLGAIYLEPMSFDEPIFITNHPVCMSPLAKGFLCPKTYQLVSARAELFVGGRELANMYEEENDPAEQSRKMNAHRRLVNKPSGDIALRPENTQDLEEFEEVDEEIPPVDQAFLRSLEYGLPPTGGWGCGVERLVMLFSGTDRISDCLSFGTLRNVVNRNN

SEQ ID NO: 1937 - protein, 361 aa, Unknown
  Kingdom: Fungi, Phylum: Ascomycota
MSRIQILKALADTAQPNSSGFLRDLDCHLGSLFADVRTRSSDYDAHLIRRFVPPPVRDAYAALRTLNLELVRLPELVSNPTIGALRIKFWQESLENTFAGRPPREPICILLHKALSDLEARTGSRMNEKSIRFWLSRFVKTRAKQMDNRPYASLTSLEEHAENTYSTLMYSFLAMMPMRSMHVDHLASHIGKACGIVAILRGVPVLAAPSPPVKTPSGAEAPSTREPSLLLPLDIMAEEGVKEEEVFRQGPNAPGLQDAVFKVATRANDHLITAREMLKRVKAGQDPGHEFEHQGESEHVYEEGSHATEDIRRAFGILLEAIPASQYLQNLEKVNFDPFAVRSGGWRLPWSIWQALSKERL

SEQ ID NO: 1938 - protein, 206 aa, Unknown
  Kingdom: Fungi, Phylum: Ascomycota
MSRQSLTQASRLASRTLQSPRIRASAIFSRCNAARPAITTAPRPACRGAATFFSTSSARNKGIMPDTENPSHSAPASEKRYTPVELSESEYHEIADEYMDRLLNVCEDAQEEREELDVEYSAGVMNISLPDRGTYVLNKQPPNKQIWLSSPISGPKRYDWCLSGESQRDKEGTASGSWVYARDGSKLDDLLLEELGIDLGPPALEG

SEQ ID NO: 1939 - protein, 399 aa, Unknown
  Kingdom: Fungi, Phylum: Ascomycota
MTEVPATTPAHRHDPDISNTSFKRLYGAYVDGKWWCNCQPNRKLAALREVTKDSPNKGKFFWTCPVFNGCNFFLFWDEARAREGGPHPTPLAQDLPPRPKTPTLTQPKLTAYGVQLTPGRRRQSRGEEVNEEHRDTGGEATTTMAKRSYPSHDEMPGALRTPESGKRKRHDIAEPGRGKDDSTDEFSDFAVDSDDERQLIDLTDASAKKVAASKVNGGLVTPKTGTRTVAGLPTPSSVSRNLFPSDKSRPKSVTFDPATPSRHGVNRDDEAADDDDDDTIIGDNTQADASFTSTATLPTTDSPSTITQSDPTSEILSILSSHGIDPSARRSVHHLLSISARRARGVEKSRDALREELRKQKSRNAKLQDKIAALEDKLKMRDRSVTNLKAGLMELYDEN

SEQ ID NO: 1940 - protein, 1554 aa, Unknown
  Kingdom: Fungi, Phylum: Ascomycota
MLSNFQKLGQDPVRVADLSDLMICPTQTLSSALPYSTTSAFVSDDGLSLTVSHQGQSRMLYLPEKPIASALQVPAQTSNEIAWRLRLPPLDKPLQRFILEDQPLPWSARDVLTGSAVTCRECGEELVQKGRIGVWKDLPSDNWAEMMEFWHCHKPVDHHKSAEGAESDDTTTKKGYGANNVISAQQGTGLVDVTSFVLSKVDCSAVLYSTSAPNIETTVEGLDIADTGPTKFLPGYCKTCSAEVGVLNASTEAVSLFKWSVGCETAVPGPAPDIAECLAATLTATISRSGSAKSVIAPHLNGGRREQLGSSGSLYVWILNPNVVYAATKSGQDAGTSAMKVLFRTLSVQEGNDIVDAMNSDVQELTLPTTSIQAVTRALETSNRLLPTRERVFQEWHYLIIMAPLEEKYLAVGCLSITREESGIAPADWGLEILREWAWLSRKGEASVLDDTVRLVDPDVQSILLKTPSLANCARLLRASWARLEFKVGKNGDARGTIRVHLLPDDVDRRIVDRANSALRKARRQLLQDLDVSAVSWEHGMQSAVPATDALFSTRADGGDTTLLQLFNEIPPPNPDPDMAPDPFAQDAIVDLLDSRVSGLITPLYHYQRRSAALMCQKEVHAEMTPDPRLIQRQDHNGTVWYIDPVSGNVLRERRSYDGIRGGILAEEMGLGKTIICLALILATRHLPTLGPDIFGVAEPPKRQRIASLADMAASCTTRNGVPWKPYLDAYQSRTGDEFSHLAGVLSRNPGFYNIPPPELRRAATRRPQHPDVPIQKPKKIYLSNGSLVIVPNNLVAQWKQEINKHTEGLKVLYVALTKTLDPFTLLSAEELLKYDVILFSQGRFEKIGRELGGFEASPLTQIHFKRCIVDEGHKLGNSRMGNRSVLLMGLDMMRFSSRWIVTGTPSHGLYGTDESTEQPAIWPATGRQDQALDTDIAPNEPSTELEKKDLERIGAIAALYLKARPWCNSVLETGDTPAEWSKYVMLPKHDPKGCGNWDTLRSTLNSLIIRHPRADVGDLLPEVHERLVVLEPSFQDKLSLNLFSMMIIFNAVQSERKDLDYFFHPKQKKHVLQIVSNMKQSSFFGGSFFSRSEIMTSVETAEKFLEERKVPVTDEDETLLRDAIQLGHIAAENKLRMQSNEFHEMPLGVEGFPGRSGPSWSLSGEGDPDRPISTSASLLLALQRLVFETAGAPEALNSLLNGGLVQEGIAERHRILTGQALPATTTQPRSQTLAGNTKLGNDSPRKSRSHGINGVKPKRQVDPDAFRGPLELTKITATVSAKLSHLIDSIVEHQEEDKIIIFYENENVAWYLSATLDVIQHLIYARGLSTERRAQYVNTFHNNPTFRVLLMDLSQAAFGLDMREASRVYFINPVLNPQVEAQAIGRVRRIHQKKPVYVETLVLKDSIDEVILERKEHMTQAEHRQVKSILDIRPIYNWIKNAKISLLPDTGDNDASQMARLRTPHNVFGRGFGQRSHPDDGLVLDDSPRGKTGPSDPFIVNGSSSTTTAGLKRGHVEDTESFAADTAEGASSPSQELAERPARRVRFAGGDDD

SEQ ID NO: 1941 - protein, 526 aa, Unknown
  Kingdom: Fungi, Phylum: Ascomycota
MAPQAIRNIWPRAWHTRLPLSHPEVRTYRIKFLKAAGLNFVLIVVLFFSLFCYLFGSLYQQETRVHSLTVLWVDYDGGIIGDAVRQAYASLKSSGFPTLIEKAVADYPTTGALREAVCNTDYWAALYTTQGASTALADAISGASSSPYNASNVLSFIWNEVRYPTVMDGLIAGNLQTLSEAARVAYYSLNGTAALASIPPNDGAAMAAFTTPWTLTSYNIKRTTQGPRAVYNTIVIVLVLIQDFFYLAIINGLYVQFKIYTRISPGRIVLVRDAISTVFTMTGSLLLTCAIWAFRTSWDVSGTQFALTWLVMWLFAHVNFLTLDVFTIWIPPQYISMALISWVVLNVTSIILPFDLSSPFYRWAYALPAHEAYEALTDVWSGGCNPHLHYALPILFAYEVSGLFWTTLGVFRRCHYAALTEESAQEAMRLRVEAALALEREHDRRVACEKPLHGEGAEAGEPSEAGHGAAGGDVGKVATRETDEADRAEAEHEMEELGEEIERMETRATRLANFGPRFRLVGTHED

SEQ ID NO: 1942 - protein, 221 aa, Unknown
  Kingdom: Fungi, Phylum: Ascomycota
MATSVDNALARFLYAILKQKNLKDIDWNQVAHDEALIDPCPNGHAARMRYSRYKSTIEKALENGDSHKRSRTSEKGGIMKPKKGSSSRKGSIVKSESGMNLASLAQFSPASIASSAFTGDCHDGILSARFLTPCSDDMTHGALHQQTDVPADYPPPGSQFLDAASHDPTSPSYSAFNAAFDLSNLDAGSDAFQTSHSLDLGGNQITGGHDWSDRFHDNTTF

SEQ ID NO: 1943 - protein, 952 aa, Unknown
  Kingdom: Fungi, Phylum: Ascomycota
MATTFVLDGPVGSAPMPIGTDAAGHLSPTSDAVEVPSSPRLPRAPPPNPPFSFPALPSPSSAPSSLSRSSGRRPQSAIESPSPRFDLDTDDLGQSTGRMALPAFSFNPGASLPPEPLTPTLLSPPISPNTPRTGGASAQRPGGFGHRRGGSEFVGGRLRDGNSIAVMSTSPTKSESGFASPTFQPPRRGHRRGFSSAVSSNEIPTLPPPADDAFTKGSSAPTSPTDFQRSEFTKFLPRQDPPTPPESKTEFQELEPTRKPSDKEEPKTVERFTLDAAEAKPASRARVGFSDTLEFIPRPLSLVSSDTSSTMTAKPGHSVTGSMSSLISLGSPLDSTGRGSPAPLSRTPTRDLDESRPSTAGAVLEHALKQQLPAQPKVSPRRRNSIPALVEIPDLPATLGEPTPSPSKTPKRWSFFGLDAFATSSPTKGRPASACSNDSMTRAVSVGSSSEHGSESVGETSESTSSKKSHKDKKQKKKKKRASAWAGAILPRKPKGESKRGKISERPPTPPAAVVPPEEEEEEESTTPQALASPTPTVMITESQSESSAPAPKKRSIDEPSTPMIDLDAALGPFNTPLPNNPEWDAAQQAAGNVGKRRLHSAQGLKGFSGPGMHYHRRAESAPDLPPFDAGRQGIHRFGSSSTMADVFEEDEEDDGVPRNRAKPADGRPQDEDSDGELTPPAVPSKELVLEAAQELIPPMVRRKSSGLSDKDHASAHSVRNERSRTSLHDNVIVEDHPSIIFRSANMFPNRPESSHSAATSYRKSSGGKELTPVDIGPLHSSHSANIPLSPYSNSLASSYPSPRSPMSLDAQRISTAPSSVTDDNNFQSLLMGEPGPEVRISMDYDIPSLTSSNSTMTRDSAFTGPNPRYPKPSSRDARPASVGSTAFGRRRSSLVSLSRLISSSHGERSKLSMEVTLDNDTEKKKVKSGKSRRLGRLMSFWKPNKEESSPT

SEQ ID NO: 1944 - protein, 309 aa, Unknown
  Kingdom: Fungi, Phylum: Ascomycota
MPQHSHAGSSPALVEAVAGLSAGTVATLVVHPLDIVKTRMQISRGSPTGSERASTMAIVRSLTSNANPIASLYRGLTPNLLGNASSWASFFFFKNRCERLIGGTRPTPADYFVASALAGAATTVLTNPVWVLKTRMISSDRGSKGAYPSMLAGARAIWRTEGIRGFYRGLFVSLFGVSHGAVQFAVYEPAKRWHLARIQQGSHGEDAGDTAAAAPLKTEATLLLSSGAKLVAGAVTYPYQVLRSRLQNYEADERFGKGIRGVVSRTWTEEGVRGFYRGLIPGVVRVMPATWVTFLVYENVKYYLPRWLD

SEQ ID NO: 1945 - protein, 318 aa, Unknown
  Kingdom: Fungi, Phylum: Ascomycota
MMNFRSIVLGGVIAAISLVSNVNGQYPNPGLVTGSIGVHDPTVVKTPGGTYILAHTAPNIALKTSTDRTAWRDAGVAFPNGAPWTTPYTGGDTNLWAPDISYRNGQYFMYYSASTFGSQKSAIFLATSPSGASGSWTNRGLVIESSAANDYNAIDPNLVVDVNGAWWLSFGSFWTGIKMIRLDPGTGKRSGNDLIALARRTEADGAIEAPYITRRGNYYYLWVSFDKCCNGASSTYRIMVGRSTSVTGPYVDRNGRQMMSGGGTQVLASHGSIHGPGHQAVFTDSDADVLVYHYYADNGQSRLGINLIRYESDWPVVY

SEQ ID NO: 1946 - protein, 720 aa, Unknown
  Kingdom: Fungi, Phylum: Ascomycota
MVRFTAGLPGLLTLSLVQPIGAFYIPGWSLKSYEPNERIPLLVNKAFSDNTQLQYAYNELPFVCPPSEQPKEAGDGLFTGQSIKLNLGEVLRGDRIVTSDMELEMGKDKKCAMLCRKNVTREALERSRDIVRDGYEVEWIVDNLPGATTWVQDKGETKFYSSGFPLGFTHELGGGLNPQYFLNNHFTIVIRHRKAPGRAGARGEKLIVGFEIYPRSLGPGFKRGEDGCPVDMGPEGDIPQGSGLELLVPREVPKAEPADDTASPADDDDGEVAEESKPILEIPYTYSVYFKEDETIEWSHRWDRYLDKPDTAYVHYLAIVNSLIICGMLTGVVMIIIARTVRSDIQSYKDSAIEGGKLRKKGNGKKSGRNGLLGRETAEVHVNYLSDEGDEALEDVTGWKLLHADVFRAPRQVSILAPLVGSGTQLLFMAVGLVLLSAAGVLNPSFRGGFISVGVGLFVFGGVMAGYYSGRLYRSFGGTSQFRNAVITEGILPAVVLPLVLVQDIVVWAHGSSTAIPFTTLIALLLLWAGVQIPLVHFGSWYAFRRAAPWEHPTKATSIPRQIPKRQPWYLHTIPSIVLSGLIPFAVIFIELLYIFQSLWQDKSHYYYAFGFLALVSSLVFVTVAEISVVATYVRLGAEDHAWQWRAFATGASSAVWVFGYSVWYYFVKMGGRERGLLDGWLFFAYSAAGCAVYGVVTGAVGFLAAYAFVRKIYGAIKAD

SEQ ID NO: 1947 - protein, 242 aa, Unknown
  Kingdom: Fungi, Phylum: Ascomycota
MNVAYNSALRQSKALKHDLTSLSAKELPTPADIGKVSASLASFSKALDDYNGLARQEIVPKKQEEALERVKRFRHELSEYRTEVDTIKKKREDSQHQANRTELLGRRPYNATPENPYANPSATTTHSQFQPRHPQAQQQQQYGYGEEAREAHAFREQSFLANTNSALDDYIARGQAVLGDLSQQREMLKGTQKRLYGVANTLGISGDTIRMVERRAREDKWIFAAGVIIFFAFCWLVLHYLR

SEQ ID NO: 1948 - protein, 189 aa, Unknown
  Kingdom: Fungi, Phylum: Ascomycota
MTLRPATPILTLEGSLWGSGEIVTEDVGNPSDYRAPIHTKRGEVDDDHPASSVYCGPTITTVTLNNCGVGGNLQVIGGISFEAARVMDQPTKEEQAGDDTRRDEVTQGEASKDRALEAREFKPPLKGVQAEMAMFGPDYIYFISDARVAELEAQGLGRPENKEERIEWFKKYHTVKRKNTGPRLARRVE

SEQ ID NO: 1949 - protein, 320 aa, Unknown
  Kingdom: Fungi, Phylum: Ascomycota
MSQLPTLVFVPGAWHKPACYDKIIALLRERHRLKCIAITLPSTTGDPNATFKDDLDAARAAISGETTQGRDVVVIAHSYGGMVGNSAVKGFARSNSSNSSSTDGHVIGIILIASGFTFTGVAFMDPFLGRPPPAWRVNSATGFAELVADPRDFFYHDLPAEEAEHWAAQLTPQSLKALFEGGEHAYAGWQDVPAWLIGTTEDRGLPLVVQRMQVGMAREMGARVEHRELATSHSPFLSRPEETTRLVVEAVEAFAGTSVEGAAPVDETTEGRLRAQEALPVPRLWRPLTWFRFGLPLVFGHMIGRSILIFTWGRRLWRSR

SEQ ID NO: 1950 - protein, 1974 aa, Unknown
  Kingdom: Fungi, Phylum: Ascomycota
MAAEGREWPEEGYGNEDGDSNQHSDQQVEEYDPESHNAGDAQDSGGEDDGGDYDPESVALGTPAQLPDRQSSSAQPQNPPQVQKPKVSGGFLIEASDDEDEGTPAQAGSTAPKPSATPQTTEASNGVPPRPSTNLPPALAGLDPIAILEARVKQDPRGDMDAWLELMASHRQHQRLKEVRNVYNRFVEVFPQSAEVWSEWIEMEIGLDEFVEAENLFARCLMTVPNVRLWTVYLNYIRRRNDLTNDTSGNARRTITQSYEFVIDNIGVDRDSGDIWMDYIQFIKSGPGQIGGAGWQDQQKMDQLRKAYHRAIVVPMSTVNTLWKEYDQFEMGLNKATGRKFIQERSPGYMSAKSANIALDNMTRHLNRTTLPRLPPASGFDGDVEYRGQVDMWKKWIAWEKEDPLVLKDDEPKVYQQRIMYCYKQALMALRFWPETWVEAAEWCFEAGIREQDQDTGVAMLLQGIAANPESVLLALKHADHIESTFPGKEGDKSEYAKAVRKPYDEVLGHLYALGDKVKEREKLEISTLKQAAALGTPIQPSIENDEDENGEPRKSATEEKISAIQKAYAKETQLSWRTISYVWIALARAMRRIQGKGSPTDGGLREVFTDARKKGRLTSDVYVAVALLECVVYKDPVGQKIFERGARLFPTDENYMIEYLKYLHSKDDTTNARVVFETCVNKLVANPETLPKAKPLYQYFHKHESQYGELSQISKLEARMAELFPEDPKLKSFAARFETDTFDPIAAPVIISKAAQMRPKQLVPIIEQPTATRNSPLPSSRQEQSPRPNYPRATASPKRPLGALDDDDLNPPKRFQRGPSPLKGAAGRRLDQQRRNQTSALNRDITFLLGILPPSHTYDGPRVNDAPLVALLQSTHVPDQVPSRSQPAGHGRQVSGDYAQRGASPFGRVVSGGTGYRNSPLRTEAPAGYQSGGYGQGAATPQAGWPPTAYGAQPPAGLPTQTNLALMKRKPSADAPGAPIVPQTIASSALCISQATAIFSLISRSEHIFAVTTRNRTLPSLFRSKLTYSIKSSSSQRTSSPSRSGRYPSYEMSDRGRSPAPSGLSSHPGSRQGSQSPRPPPGSRSPSEAPADQPGWAPPMGRDPAKPLETERKFNRVELPADAYSLDRPDLFAARPKAPTVGQPARLEVNQYKVQSYNFDVKVHQYDVALSPNPSKPVPVLKKIWKHPKFVAAFPPGVHEHFIFDGRKLAWSTTLIPREELRVAVDLDEGKSQPRKGGESQFYIILRKTTEINPKVLDAYLSHQCSLNNAVIETMTFLDHLLRAWPSERLLSIKRNFYNTSRPGRPLMDGSVVEVSKGLYWSARISASQGSIGLAIAADVANTAFFVGNQDYVQLAINFLATQDQKLRGLNPLRLQEELKPVFHRGIYVPSEAFKQLRKLSKMKITVKHANRPAHLTSPIGVDSFSFDARNGVEGTHAQNTFFEHDGKKTSVADYFQQKYKVTLRFPRLPLIKTGKGAFIPMEIAYLEKFQRYPFKLNPSQTQSMIKIAVTRPNQRRADIQSNVADLQIQNDPFLRHYGIRIDPHFTKTDGRVLPPPLIHFQNGAIDPKTSGRWIVQGKRLWRQNTAPLDSWGFLVLQNCVDKPTLENFSKVFTSVFREHGGKCTRDPMLLHPPGNVQHNAAEAIMWAHQQLISRSGYPQMLFVIVRQKGDPSYERIKKSADCRFGIGSQVLASQGVQAAQKQYASNIALKINAKLGGTTARTDPPWGPSKAKTYFPPDRPTMIVGCDISHAAPGAPNGSVAAMTMSVDPDANRYAAAFKAYFSRKAPNMPMPRFTVICATKRHHIRFFPERGDRNGNPLPGTIVDRDVTHPRLWDFFLCSHVAIQGTSRPCHYHVLLDEMKAPPADLQAMLYGQCYSYARSTTPVSQHPAIYYAHLAGNRARAHENLATSEGPVSGGKGHQAAQINLAKGASTTSQSGEVLQLLPLGGRPQGEPAPGEIRQRNFWRSTAWFM

SEQ ID NO: 1951 - protein, 811 aa, Unknown
  Kingdom: Fungi, Phylum: Ascomycota
MAAPSTFSYAQAAKGQGATPSNTQSEQELQVQPGESKAANGHPAPEAAEHNSATETRPSVTEKSEQEVTPAVENIAISESTRNSSRAESRRDEEVSRLDRPWRRADKGPTRSSSATTRSVDDGEHRRPRKGRKSKPSDKANGDDAATSDKKSEPEPEPQPKIELSEAPIPTVNIWLQRKESLLSKPKAPASTAPEAKVNGAAQHTEISAKPSAEATETVTTRETPATNGVKAPRKAADGARPERNASRGNRVAEKTSKTEIPPPVGDAVAWPTPETAVKDVKKTAETTDKSEKDAQEDAAHKPRSKDKWVTYDYVPTVTFETQIQRPSGGKPRGGGRGTGSGRGGHSGAQVADKAAASSSAPANKTNETKDRAREQTNGVPRNSSVPPATKQPATETAQVSKEAKKPSVQPSTEKKEASIPSTVSLRASSRREASGVLTVSQEAPVQREPRSERGRGGYRGRGNHHNTNAHGQPHAGPAMSGPNFAPNGMGPRGQPYSPPPRQGAHGQMFPPPPQRGGRGGRNAGGNHYNRMSLPNSASRLPPVQTQFASYEYPMAPMTAIPFQPAPYWDNMVMTMLKQQIEYYFSIDNLCKDLFLRQRMDSQGFVPLHFILAFQRIRDMQAELAMVRAVCEESNEIDYVVGEDDCERLRRRHGWETFVLPMEDRDTGARNHGPMHPSFKSRSYNMGSPFNGMGSPPMHFPMASPHGYSAPPDQTFQPYGNGQMGIPNGQEQMNGKRTNSNGATQLSANVPDFSPSGAFAAGEHGAGAPNGDLPVKADSSAMTNGHLESGLPNGVANGVHGTEQPQAAGQA

SEQ ID NO: 1952 - protein, 735 aa, Unknown
  Kingdom: Fungi, Phylum: Ascomycota
MLPSAIFAAERIDAQRAQGRYYNPPRGRRASEVSSTSTSAPAAAPPDLIIRDPRQPALNLVYGLPATSPSKSRSHSFNMSSSFEKSVKGATKIKNAPPKTKYIEHILVATHSGEAGIAEVFRALQYRLRDSTWTVVFKGLITVHLMIREGSPDVTLQFLARHRNMLAISSFTDAQTQGRNIRHYANYLAERARSYRDTSTDWVRAHEMRLEKISVDKGLLRETESVQNQLTALLKCDVLDTEPENEITIFVFRLLVLDLLALFQVLNQGLINILGHFFEMSKPDAERAMAIYRNFAKQTDFVVAYLSVARQHEHHTRVEVPKLKHAPVNLGRQLEEYLNDPDFEIHRRQYIAEQDAKRKGGFANRSKSKSPRPPIDNKPKTDADFPEPASNNPFPRTTNGASSGTGANAPQANKGPDPDLIDFFDSIEQNQTPMQMQPPQQQQQQLGMQPQFQTSNPFPTQATGMQGFQQQPQQQPNGGFMQTQQTGFASNSPFQQQPQNNMFIQQQQMPQQQQQPQPLQPNFTGAGFGGYTPQPSFQPGTLGSIPQDSVAAFQNTGTLSPPAQQQLPFQPMQTGQQSTNPFRQSMLMTQQTGMMQPQQTGMPSSTMSSPVGGIQPLQRQSTNPFARSANSSPFGTTTTGQPSPFQSAAPIQAQPTGTNPFARASTMPTEQRPQTAGPMAPQPTGTNPFRQGAFVNHATGMGWQHSQAPIGGGLDQLGTTPVFPRPAQQTPWQQQ

SEQ ID NO: 1953 - protein, 380 aa, Unknown
  Kingdom: Fungi, Phylum: Ascomycota
MASSFFDLKARKAAAANGTTEVKPEKPSDGRTQPWVEKYRPKTLSDVTAQDHTVTVLQRTLQASNLPHMLFHGPPGTGKTSTILALAKELYGPEMMKSRVLELNASDERGISIVREKVKNFARMQLTNAPPGYNKKYPCPPFKIIILDEADSMTQDAQSALRRTMETYSKITRFCLICNYVTRIIDPLASRCSKFRFKSLDQGNAKKRLEEIAEKEGVAVEDDVIDTLINCSEGDLRKAITFLQSAARLVGAGSKDNDGDDSMDVDKRPVTKKIIEDIAGVIPDKTIAELVQAMRPRSSGSTYSAISKTVEEMVADGWSAGQVVTQLYQALTLDETIPDVQKNKIVLVFSEVDKRLVDGSDEHLTILDLTMRISSILTGR

SEQ ID NO: 1954 - protein, 655 aa, Unknown
  Kingdom: Fungi, Phylum: Ascomycota
MHCASAFNLLLVAVAAPVGALGSALATQGRWLRMPELSPPPQHMSNSGHRVQLNQQVTVVTGNFSDEPTLKLIQGIVSSAGGQVTTASSSAKGRGTQIVVGTIKDNAAAAVAAEKLTGKSADGLGPEGYALAVGKHDGRPTIVLNGVDARGTFYAAQSLRQLAQGRRGVQGVEIRDWPLMAVRGSVEGFYGIPWSHQARLDHFAFYGKHKMNTYIYTPKDDVLLRRKWRDLYEGSHLEEIQELVNTANANHVDFTFALSPGNDLCYSSDEDFEVTVNKFSQIRDLGVRRFYLALDDIPTDAFHCDADERKWHFTDDWLPLAEAQTFYLNRLQKEFAEKNNLDDLETVPTSYIGSRPTPYKERFGSTLDKKVRIQWTGEDTMSPNITSESAMRASESYVTDNLFVWDNFPVNDMAFDRLFLNPMTERASDLYKHLLGFTSNPMQQPYASMLALINYADYTWNTAEYDATKSTKGALEELAGPSNTVRDALVAFVDLNQHWPYRQPEIFAPQLSKDVQAFWVSRQLKSWITRQRGTQPLLKRLDLLARLPDTLSRMEERKFAPDVKPWTTAAVQWAEACRDLISMLDLLDEGEKELAGERLESAQQWVEKTKEKTVHTLDRDGNPDVYAPKIGDGVFEQFLKNATAIYERGGTEDEH

SEQ ID NO: 1955 - protein, 528 aa, Unknown
  Kingdom: Fungi, Phylum: Ascomycota
MASATETQQPAVVDPQITAADNQVNPTEKYAQINDQKEGDDAKKPETDVEVASVDEEAGKAYYSKKSVWVMILFSGLAIGSDGYNAAVIGNVQILMKYVYPDALTDTIYSRLSNAFLIGMILGMLFFGVIVDQLGRKTGAVATTILLVLGIAMSAAANGADATGLLWMLIIARGVAGVGAGGEYPVSGAGAAEATDESGKYRKHRGFMFAMLADLSASLGYVWAGLVPLLLLLCVGRREDKYEIVWRTAFALGAIPPLGIFWFRLRMAVATAYRKSAMRKQRVPYLLAVKRYYRPLIGVSTCWALYNWVSIPFGIFSATIISRTNTSGDLVKDLGWGVVINCFYLPGPFLGGYLSDKIGRRKTMALGFTLQAIIGFILGGATRQIQSVFPLFVVLYGLFLTFGEVGPGSTVVLTASECFPTSIRGQMMGFISACSKAGAAIGTQVFTAILNSYADKPAQGDRAVFLIGSAFAVLGAVVAFFVIPDVSRRLEDDDAAWKVYLADHGWEAKWGDNETKDPGAVIMNRAVS

SEQ ID NO: 1956 - protein, 167 aa, Unknown
  Kingdom: Fungi, Phylum: Ascomycota
MPPKISRRATPDLPIVTTSPNAVPFTRTFRSRSVIRTQSEHTRILSSNSPPSADRPNPATLDTMRPTQVLSVGRYRHLKLTTKDVNKGFYKGNRTGSMGRHTKYGGYVIEWDKVRTYAVPQNLKEFKLTPFVSRQVRAESGDYKGLEKGPQDPYFYVEQWKRYNGVD

SEQ ID NO: 1957 - protein, 790 aa, Unknown
  Kingdom: Fungi, Phylum: Ascomycota
MTPQPSHSRSSSYSSDNARPYRPNNPSSLRQAITASRAGQPVDNFNRPATPPSPGPARSETAPLMQQGPNGRRPSVHPAHAGYCNHGTFSPRPSSPTAQSFDGYRDEDESLGTGEETPESGTTIAVLDNAISHIVGHEDWKKWVKRRMRTKKMGHSSQLAEQAGLQDTTLMYLSYYIPCLTWMSQYKASYIKGDLIAALTMASFYLPMALSIASNLAHVPPIHGLYAFVFNPFVYALLGSCPQMVVGPEAAGSLLVGTVIKSNVDSGDGSSEDNDLLHAQLCGVVAGMAGAMVFIAGLARLGFLDSVLSKPFLRGFISAIGFVIAVDQLIPELGLARLAEGTGATHGSSVEKIEFIVENIRRTHVPTFLVASISFAIIMFCRETKSRLSKRFPSIVFIPDRFIIVVVSAILCYQLRWDELGVEILGSVKAANGGLFTFRWPFQPSQMTQGMSTSFLIALLGFFESSVAAKSLGGSDAMQGIQLSANRELIALGAANLVGASFMSLPAFGGYGRSKVNRTTGGKTPMSSIFLSLIALLSILFLLPYFYYLPKPVLSAMISVVAYSLIEEAPHDIAFFLKIRGWTELGLMAMIFVATIFYSLTLGMALGVGVSLLLVIKHSTRPRIQILGRIPGTHRFENAEAAPNLEFIDGCLIVKIPEPLTFANTGELRSRLRRLELYGSSRAHPALPRLRSHEANRNIIFDIHGVTSIDGSGTQVLEELVRDYRERGVRIFFSRVPSRRDSPVWRKMESSGIVELCGGETHFVNDVEEALRWTEYEESVEMGSGEADGS

SEQ ID NO: 1958 - protein, 548 aa, Unknown
  Kingdom: Fungi, Phylum: Ascomycota
MGLGVLPDKHLDHVPGTSFMTEKGVVASVEEVPAEHSNLKHDPTGKIVLVPQPSDDPNDPLNWPRWKKEMFTVSIIIGCGAVGAVGPLLSSAIVPLAMEFDVPIQRFTLGFNGSSLIGVAVGNLFCNSLAMMIGKRPVYLITALGLFLTTLWSAVTKDFISLAVSRAIQGVCISPMEALIPASIGEIWFVHERGFRNAIFNLGVLGGINLASPIAGPIIDKAGYKAALWGMTGAFALQVLLTIFFMPESTYDRSTQGVPAGTATMVSSGDEKSPEDIKSTSVPETAPVMQAHSYLYTLRPWSGQFKADKFWYNVFAPFKMLGSPLVVWGCFELTICMSWLVMLVITLSQIFSGPPYNFSVTSVGLASLASSGGILIATALAGFMVDGLVKFMSRKNKGVYEPEFRLPIIALLTTLSGAGFFAWGQSLANVDPWPIPVIVCLGMINLGVQFGIVGVVSYVVDSHRHEAVEAYAMMSFCKNIFAFAMTFYVNDWIASQGVKETFYVVGGITIAVSLLTVPMYIYGKRARSYAFRHGFMVEVVNDSIDESK

SEQ ID NO: 1959 - protein, 902 aa, Unknown
  Kingdom: Fungi, Phylum: Ascomycota
MPRVNRQHLVTTQIISWVASLGSVTLAVLVDLALCEHLKERTETTGRSCPRRHCTEYQQPPLHSSCTAPPISFASPSFFFLLLILPSSPNNDTSFSSRNFFSADNRSHYQRFRRPTRLHPPPRVRRGSLSGQMSTPTTAVALPHYHHNHAHGHSHRYHHPPYSPYQQGSGSSHHHQQHQNHPSSSSATVASTTTGAAAAAANIASSNSNAVSSRSITSGSLLNHHPQSLSSPSATNPPRLLPLYPSASAGYSTVTDGVTQPRHHPQPQSPVPPPHAAGHYTHHALQNAATASSSSSSRLAIDDGYPSSKMATTGTATIAASNSVHHDTAVDDQPSRKRRRSREPDWNNFYRNGLPKEIIVIDDSPEPEANTGRKLANTGPAPAYEASPAHQQQPVKRRRRDDAPPAGYHVQYLSHTSTPNGGTNSSDRTNSAITTTAPTSLSSNGQYEEPALPLKRKRTTRQQTANDAKRRDADGLGGQFLTYKPPPFPPKKVPEVPVRVIRDDHYNKNVKVDDDDGHFIVVPDAHLTDNYQINRLLGQGTFGKVVQARDRKRNRAVAIKIIRSVQKYRDASRIELRVLATLKANDHENRNRCIHLRDCFDYRGHICIVMDLLGQSVFDFLKGNGFVPFPNSQIQNFARQLFTSVAFLHDLNLIHTDLKPENILLRSDQYQTFTYNRKIPSSSTTISRSATQRRVLLDTEIRLIDFGSATFQDEYHSSVVSTRHYRAPEIILGLGWSYPCDIWSIGCILVEFYTGDALFQTHDNLEHLAMMEAVVGHRIDPHLVAAVNKGTGGRNGGANPAAKYFKRLKLDYPQTSTLRGSRRFVKAMKHLHDIIPSNNSFFKHFLDLLNKIFVYDPAQRITAKQALNHPWFREIAHPDDGTEAAKIRMENEEKARQAHYVG

SEQ ID NO: 1960 - protein, 1081 aa, Unknown
  Kingdom: Fungi, Phylum: Ascomycota
MDKDKLAQLLKGSQVPNTEQVKAITADLQKNYYSRAESLLLLIEIAITNEDGGVRQLASVQGSRLVVKHWEKIPQDKRHLARNHLVEGALKESTPTIRHSLARLVATIVSADMDLGEGDDFLKQLVQLNTNDSVVAREVGSYILYAILEDDPTHFSDHTHQLLQLFQNRIEDPESKEVRINIVRAVGAILMIVEPDEDPQALKLMQSFIPSMVNILKATVEAEDEENYKAVFEVFHSFIAYDSALLGNHLRELLEFMMNMAANTDVEEDARSQALAFLIQCVRYRRMKIQAMKDMASQLMVKAMHIVTELDSDDDEDISPARTAISLIDQLASELPPRQAVVPLLEQFPSFASSQNPKFRMAGMLALGNAAEGAPDFISTQLKQLLPTIIGLLLDPDNEVRHASLVGLIHLAEEMADEMSSHHEQIIDAVLKNLEAASQGGADKKNVSIIRCACGALDTFGDGIDTKIMAQYGPNLLGPMVRLLEHSDYGVKAAAASAIGAIASSMEEGFKPYFKDVMKTLGNFVTIKDSEEAMELRSATCDSLGRIALAVGGEEFQPYVMDLMTASEEALGLDNPRLKETSFLLWSNLSKVYKDQFAHFLPGTFKGLFTSLELEEEEIDLPGVDLSQLGEGSVVVGGKRVKVKAPDSQDDLTIATNGEDEWDDIEDLDDLDDLGAVTAVAMEQEIALDVLGDLISNSCNQQNLESYVEKTIETVVPFAEHTYEGCRKTAISTLWRTYTRVFQIWEEGAGVKWQPGMPAKPEPPASINSIGQALQKATMSIWAEDSERSVVTDINSNVAATLKACGPAVLGSKDGMLQEIVTVVGLILTRSHPCQQDLGDEQEEQDAEGGSSEYDWLVIDTALDVVVGLGAALGSDFAELWKILEKPVLKLASSTEDLHRSTAVGGIAEIIKYTGSAITPFTDSLGQALVRRLGDNDALAKSNAAYALGLLILHSGETGKTFPMYGPLWEKLEPLLSVNESRMTDNVAGCICRMMTKNPDNGFVAEALPAVIRVLPLTEDYEENAPIYECIVKLYQLSNPTVQQATTQLLPIFEKVLSPPEEQLEPETRQLLQQTVRSLKG

SEQ ID NO: 1961 - protein, 856 aa, Unknown
  Kingdom: Fungi, Phylum: Ascomycota
  misc_feature (471)..(475): Xaa can be any naturally occurring amino acid
MATNMDDIAHLVITPFQEVVEKGKTAVENAGDSQPMAKAALSLVKEGERALKKIEPLCKKYVADFGVNFRDALRENDEIAEYRTQLNDLLWEFDDFIDDADCFDAEKFAELQAASRKAAPKIYDILMRMKLEAPYDDLSPVGSLPHSIGTQQSYASRPSTAFLTHMDQIQQPASPAPAIEPRPDSGIYTIEDATSQLKRLMAFEDGFEERPAPLQPSPQRQPPAIPITNPWDVNVLPPVDETRSMSDAGFERRPEVSRDGAESPIDPSISPVPGPPDAQQRQVITPVQQEPANDVGNESAMSEDDDRNYLPSSGSQPSSPGRERRYSPFPPPSARPRTVAKLSQLATSIPEDSVINGTGGLSISQPPASAASSQEPNSPEHTGHGIGYAVSSNFAGFEHTYRPTIISHHTEASTSETVASSQISPRIRPVQDESEGLQVAPSNNRLDQEMLIPVDADLKQEHTNSSPLPVXXXXXDGAKEVSRGGIGIKKTKKPVGLTTSATVARCTGCMCELDFKDIENDVNKLESGTFSRGSISYRIRFLQKSHIAAKRVDDVQYGCLFCLQQGHTLDESDATVFFSPRALMDHIARHPRPLPDVPGVVTIDGPEVPPNLANDFDIHLKKPSVPHPVIEVRSEIISLPSGMTKEPARRLFGQRLLFDRTPALELAQGARITGLTWPARYNGEWAFGWHDGVYATVPTDLLKLDTPPSQHVKLGGTSMIRARARWRFNPGKDKGSDWLKFDKNDVIKNIAWSYFDHWCWSGTNAKGKWGIFPQAFIDTNTLEEPTGLNRAISLSDEKNRSTSLIARFSRRRSGSHNSSPQQGMRPPSVAGSTSSHESRGVQPHMGRGSYGDVHAS

SEQ ID NO: 1962 - protein, 375 aa, Unknown
  Kingdom: Fungi, Phylum: Ascomycota
MGDDRGPKALLIMWVMTSLTWAFVGLRFLTRIFVVRIVGADDYVYVLSAVLMLLYNVFLQISLQHGFGQNVMSLEVDQVAKAIKTEMIGQTFAVIGMAVAKVSMGLFLLRLVAVRWHKIAIWTMIIALMSVSVLTAIMFWVQCLPSKGIWDPRERPNSKCNIQITPFAVTLGVACILADLFFAVFPMIFVWQLNMKRREKITIAGSMSLGIIAGVAGIVRTYEVASGFTQNYTQDTVPLIIWSSVEIAVTLICIGIPTTMPLWRRVLGLGNSSADRNYQQYERHEGNSSSNTGAFQLDGVQRHNGKPPAYVRGASKLGLHCTMTTDVTATVNNNSDEDMLRGVNRDAPGLGESTSNGSTLTGVHVKDEVRVEWNR

SEQ ID NO: 1963 - protein, 421 aa, Unknown
  Kingdom: Fungi, Phylum: Ascomycota
MELKPTHLIYSHSQIEMGSIPKTLSVEELLTQSLDRHRETLSKVCADIHAHPELAYEEYRAHDTICDALTALGYKVTRHAYNLKTAFEVESGQGGAVLAYNAEYDALPGIGHACGHNLIATSSLAAFLATAEALAESGQPGRVRLLGTPAEEDGGGKVDLIHAGAYKDVDACLMGHPGPAGSELNNVILPRLMARSSVTITFKGKSAHAGNAPWQGLNALDAAVASYTGISMLRQQTPPSQRIHAIITKGGERPNIIPYLTEIYLYARAEADAELQKTLKRIVECCEGGAKAAGCEVSFKWDNQYKELECSETLADIFDEKATSFGQAYARELPAVSGASTDQGNVSFEVPTLHPVFGIPTDSTEVGPHHPGFEHAAGQPSGFQAALEYAKTMSATGLEILSNQKLRQKMWAEHHKRFGSA

SEQ ID NO: 1964 - protein, 211 aa, Unknown
  Kingdom: Fungi, Phylum: Ascomycota
MTETTSEQHQYKSATDDPLVWIDCEMTGLDPDTEEILEIYCILTTGGLDIIDEEGFHAIIHWPASRLEQMDEWCTTTHAKSGLTEAVLSSTTTPEQAASQLYEYITKHIPEKRVALLAGNTVHADRAFLRHEPYAKVTDHLHYRILDVSAIKEAARRWSAPRVTKKAPSKKGLHKARDDILESIEEARYYRDTIFRLTFEDGNKVSKGKKK

SEQ ID NO: 1965 - protein, 1695 aa, Unknown
  Kingdom: Fungi, Phylum: Ascomycota
MAVTNSARQADYVLASLPTRPPTPPKEHLSRVTSAPLKPVARQSLAQQQSLQTPPNIHSLISPATTESNTNSGRLRKRVEWSAHTEYKEAPQYLDGERLAKSSPVAASTASRPIKGILKATSSPCQPTATLNTRLGSLSEQISISEMLDSTIKQLSGADRDSKVDAYMSLARALKTSNNLPDRVALQGKLSLLTQFIQRDITLKNSHGALDRSLVNHALLLLTTFLHFNAIASTISSDFAIFITDHAIRSFEDARMPKEVIRYLMQVMAFQSFAPKVMSHDRVGRLVAAIHRLEGQLSGKSIVMSRIQLYKRLVKQCPHHMVAHANWLQDLFTDMLSLTKDIRAEAISLGMEAGFQFRHDKQVSRHVLEILKTETDEGSFIQYYIEKLQEMLKHRDRSAAVPQIWAVVNLFMRYPLERWELYGPWLTVVQTAFNTADGATKLEANHAWSRYVYLCLSEGKLSSKSVTTLCQPLLSQLRKKANPKNPDEVTKLRRAAIGGTCNLFYYSFRPGNDKLPPDMIWDVAVQPIISQLIALGDNNDAPGDWALQAARLLNGLLDGGTPRVWREDRIKDNTLIRPDELPPLDSKWIRRNSQKVFVILDAILERKALDLANQDSLVYRLWQSLVGAIAAASAKDIKVSDDTVKFFASSFGLLYKIWSKGAPSGSGNSSRLLKAVSHMVQIMVNGLGVLPFTEKKLSMTTPNFFEAITTPSARVERQDKTREVVRSPLLHLLNLFCTIPEGVEDNEEFSDFILSTFESFFAGKAERARVDQARDLLLSLPRNVVCPYGIWILASQSLLLPFTRPGKDDDKGDKVLGPEYRELISFLERGLTCHPNLPIDRWLSAFKTVDDHVVHHFGQAGRVLVMIEPMAKFLIDLIHCEHPQIADRDFIVITTNLLATAQFPKDRQAMDAARRYLWGAAPPASQHGPFKPFDSLYKAADLAMHKAYKGVTADETQIIKLLESTTNFVAASSQHGDSVLPALQHGVCSWIEDQDGRISFDSESYIGHAVKTLWHEICKLLITIGTAQSGRLDTLEPTLSSGLGSKHQLILMMTAETWNRLVGEADEPQCSDSFKSVLSSVNLKLDVEVAGTANPSDRSGAQLPISLGISGSSGQLKANPQSSSELSKRGTPVATPSPPKTNLASRAQRKKRDEATPRLTRSRVKRRAGTPRLRHDNSQIEFTAVPSSPSREESQHLTERQEDVRERQKTGITAWPMSASEVATTSMPSLAKSDSSTAGLVRVMLTQRVETTPEPRTSYEDLISSTPTPRRGQVLQMDDLNDPPSSPPELRPYPLLSEIQTRSKAGSSLEGWEFSSPPSSPGLGGLRPAQSITQSEGAEAQFLDPSTEPDDLSDVLPAIDLATKESSPPNEPRADESATSALIKSPQMQARTRCQKRKSLKSKDVEEEIPRSIGPSRRTLRSHSQDDATQVNPPREGDTSFSLSEEAESNMMQVTVALESGSNGVAQHASPMTRRRARSSPTPSDYKFGSDASLRVQTGHTKKRRHEEAKEEGARKKRVKSKRQNYESQQADISSSQHTSSPTTDRMPTRRSKRVRRELEQRGSDSRKDDNVDEVTIDCTEATRVSDDAGDTDEELLSQLMADSQAASQSQSQSRQARTSSTDLEVAKKETQPRADEKLLSSTTTNAASAVMSLLCSSKEMLRGEAISRQQVDELEVMIMDLKREIYQAEYRGRE

SEQ ID NO: 1966 - protein, 1097 aa, Unknown
  Kingdom: Fungi, Phylum: Ascomycota
MSDTHAHHFSERNIPFGIATSAVHPQPQAVTRLYDWVIFLGDCQSAGVFDGIPALTRDAFSHTTLNTFAALGPLVRRQVRDVLQLNFHDNENQNSLVTSKLPAGSYERVDKVALHMPFTVCDFVDFSCSLDHVKNAGRIIINDERPPPAFFNLPIGYQGRAGSIVVSGTDIQRPAGQYRDRTAKDVPEGSQPPVVYGPSAACDYEMEFAAIIGKPLPMNSPINATDVDEHIFGFALLNDWSARDIQGFEMMPLGPLNGKNFGTTISPWIVTPEALEPFKTAGQKSTLSIPQHLQDPDSQTYDIRMEVQISTGTHSTVAGRSQLQSLYWSVRQMIAHVASAGSALRTGDVMATGTVTGPGEGAMGCLLEVTEGGKRPFKLHDGTERRFLQDGDTVRITAMAGGEESGVGSKINQYRVYISSTPQTGRAVHPSPWRWNHSSPSKTNSENNNAIHVARPPSLATRLSGHAEAGGSGMGNLPQPNRDVDNPLQSLGGQPLIRQRKMPNPVQDLHTVDESTFPYVFEQNATVQIRNGGGLVRCNIYRPKTADPVPVLVTYGPYGKDLHYKDFIPKFAEVNPAHKSDHSAWETPDPGFWTSNGYAVVRADERGLGQSPGLLDTMSRGTSDAFFDVIEWAAEQPWSSGKVGLLGISYYAGSQWRVAARKPKGLCAIIPWEGMSDYYRDRCRHGGILSNNFIRFWWNRQVITNQYGRPGRKASNWGPDTIEGDLSEEELRANRRDQTEDNQAYRYRDEPYYASREYDMSDIEVPLLSVGNWGGILLHLRGNVEGYIHASSKFKYLRMITGRHDLPFYYDEEVEVQRSFLDAFLKGDDRVGWSQPGKVSPVSLVLRKGNVGFDNAKAEAAYERREESEWPIARTQYTKLFLNSNDLSLSTSALEAQALKRKLSYRALGTMEKPELLQFSTPPFETETEITGHVVARLNVSVTADPGEMTPSDIDLFVTLRYIGPDGKEVFYTGTAGDPVPLTKGWLRVSMRKVNTEHHKHRPWLPHRDYTSKDVLPVIPGEVYPVDIEIWPTNVVAEKGGRLVFEVSSGDTQGSGIFLHNDEKDRSPEVFKGVNNLHFGPKFDNYLTIPIIPPKTE

SEQ ID NO: 1967 - protein, 1363 aa, Unknown
  Kingdom: Fungi, Phylum: Ascomycota
MEQQQQQQQPQQQAQQPQQAQQSQQPQVQQQTPQGPHAGGVQGPAGRRLHIAHRRSPSELTPLMSMFQNPGMEQLAIQQQIDLLQQQQQQIHAMQQQQMNMGIMPTQQGVGAGFNPMQPMGNMQTAFQFPSQMPQQQQMVPPTQPLSHRRNQSALPNMGMGPPPAPSSGASGSQFGNFEAPPSTNRENMGGRGGRGGGAAGGGHQRRHSLALADAKKAAELAQQKRTTSGFQFPASPANPEEENKTANPDASQPTAPSRGRGGHGRSQSMAVNGRGGSSGRGGLEGSNDFQRRGSGAGHARTGSRNFEGNWRNQSQAQDQVGNPAQAQPFQPGHRSRGSMNQSVSSIGAFQYNPNQPQVMQIPNQMMMPQMYGGQLNPMQISQLQALQAAQMGGQQFQGLQGSQHAPLGGQQQQQQRKTLFTPYLPQATLPALLGDGQLVSGILRVNKKNRSDAYVTTQDGLLDADIFICGSKDRNRALEGDLVAVELLDVDEVWGQKREKEEKKKRKDITDTRSGSTNQGNQSSGNADDNNTGEGGLRRRGSLRQRPTQKKNDDVEVEGQSLLLVEEEEINDEQKPLYAGHVVAVVERVAGQMFSGTLGLLRPSSQATKEKQEAERAARDGGNSRHHDSRQQEKPKIVWFKPTDKRVPLIAIPTEQAPRDFVEKHQDYADRIFVACIKRWPITSLHPFGTLVEQLGRMGDLKVETDALLRDNNFSSDEFSDAVLRSVGLQDWSLAKEDEAALSARRDYREENVFTIDYNGAAELGNAIHVKSRPDGKIDIAVHVPDVAHFIKANSLVDREAKKRGTSVQLLNRFCALLPPKLAGEVCSLAPNEERLTVSVVFSVNPHNGAVAEGDSWVGRSIVKSSTKISLKEIDAALTDASAYKNEAVPVKTIQILNAVAQKFKETRLGAGGELIAPLRLIQQLDDENNPVQENLFDSTPALELVEELMHKTNAYVAQRLAEGLPEQAILRRQAAPNPRRLQTFTERMNALGYEIDSSSSGALQNSLFKVDDADLRKGMETLLVKSMQRAKYFIAGKTAKQLWPNYALNLPLYTHFTSPTRRYPDIIAHRQLEAILSEGKIEFSDDLENLVKTVESCNTKKDSAQNAQDQSIHIESCRTMDKKRLEANGDLIAEGIVVCVYESAFDVLIPEWGFEKRVHCDQLPLKKAEFRKEKRVLELYWEKGVPSSAYVPEDERPKAAASQRMNNAMAAARQKEEAERARKERDEAARKQTETGTMSTDDVDALFDDDEDNTSDVTEAMAGASLAERPTQSVPGSPSRAGSTAGDLHRARSDSKVHATEAPEARLSNKEKYLSFFKLREEGGDYIQDVTEMTRVPVILKTDLSKSPPCLTIRSLNPYAL

SEQ ID NO: 1968 - protein, 651 aa, Unknown
  Kingdom: Fungi, Phylum: Ascomycota
MSGNDSIPATPEDMVDHTKELEAPGSPGSESSSAASTPLDGGLESPTEIPKRVPSLRSVSDPRTLNPNSTALGILGAARKPIQSTSSFAGSSNMALDNNSAMAKARALHQQRMQKGLTPTSSSPTSPNPTQSGSPMNGFPGNLRIPGAGRQRPGPPAHPNSSPAAPTSLQLRRQKMMGGMTLSDMSSAGASPRLSRPGAPKLSDITGAKLDDQQQNGGKHRSKMDDFKQYIDTEKGWITFDGAATITREGVNFSNGQTFSISLDEVEKMDELGKGNYGTVYKVKHSRPRVPRFGHGLSSKGPPLLHAQSDPSPVRKGDVSEDNSTDDGTTGKVMAMKEIRLELDDAKFTTILKELVILHECVSPYIIDFYGAFFQEGAVYICIEYMDGGSIDKLYKGGIPENVLQKITYSTVQGLKSLKDEHNIIHRDVKPTNILVNTRGQVKICDFGVSGNLVASIAKTNIGCQSYMAPERISGGSMAQSGNADGTYSVQSDIWSLGLTIIECAKGAYPYPPEVSQSIFSQLNAIVEGEPPALPEEGYSDAARDFVASCLNKIPKLRPPYAMLLKHPWLKPLSKPQTITEEAEEGEEADQVAEAVGKMNLGSGTEDEEVAEWAKAALTRLASGDVEVVDTRPALHAAPLDSMSPLGSPVM

SEQ ID NO: 1969 - protein, 635 aa, Unknown
  Kingdom: Fungi, Phylum: Ascomycota
MASKPQRHAPRDKRKIENDLNDFAEYVEQQQNLRYPTSRAATTSADAPAETEHHAELDELFDNLDLGDSTPKILLKQLLLATDEDALHKLQTVVSERIEEGFGETVFEIGFENNGDSMKLTLDEWNKAYARLAEAAKGVSADCQLLLTKHVGGEVEAPSTADSQEKGKHCSGKVLVRRKPQNIEDVIETRIAVVGNGKITCYTALCDTGLTVAQSMLAKVQCLGHKHEIETGRTSSVGMEIMGFDSVGSVITSDIPGRKLSWEEIGKRSAKVITFTDLAGHEKYLRTTVFGLLSSSPNYCLLMVAANNGLVGMSKEHLGLALALNVPVMVVVTKIDICPPNILEETITQIKKILKSPGARKMPTFIKNREDCINTATQFVSQRICPVFLVSNVTGENLDLVRTFLNILPHHGRYNSDAPFEFHVNDTFSVPFTGTVVSGIVQSGVAHEGDNILIGPDSLGQFTPTFIRSIERKRIRVPAVSAGQSASFALKKVKRKDVRKGMIILPKVEGQPAPKVHREFIAEVLILSHATTIKPRYQAMLHVGPVAQTCAIIDIDRELIRTGDRATVAFRFVQRPEYLAPGDRLLFREGRTKGLGIVKSVGYDPTKPLSKQIPGGDVGAAGAAQGDTQEIQVRA

SEQ ID NO: 1970 - protein, 208 aa, Unknown
  Kingdom: Fungi, Phylum: Ascomycota
MHCYQLIALSSVVQQCLAAASTEAASCRHIWQQPPGKDIRIKFLDVPNTYDDELVKHADLVGMIDLFTDGQTWLMMDGKRLFRIPSDGTADPTAVQHSTEVELMTPEELREVLKTRISYDEAYAKLTKIMQDYQASGQLKQRDQLHCGLIWCHGNHDCFDATDSDGACNSCRSHDCTWNSRVHINAIRPSPYEVGEGGNKDQTESEST

SEQ ID NO: 1971 - protein, 270 aa, Unknown
  Kingdom: Fungi, Phylum: Ascomycota
MAAKQASASAAAQSQSVPGHLPKTQGGFSASQLVELDPQWQNDNSRPRTAPSLASGGVPDPSTQYLAQTLSPSVPLATPRRILVIMDLNGTLLYRPSRRRPFDFVLRPHACDFLSYCLDTFYVAIWSSARPDNVRKMVAQLLTPEQINRCVIVWARDRFGLDAQDYDARVQCYKRLTRVWADPSIQASCPADMGKWDQSNTVLVDDSLEKGRSEPYNILPLPEFSGIENETAEVLPQVHDYLNTLCGQSDISSYMRRNQFRLNPSYVLPP

SEQ ID NO: 1972 - protein, 1044 aa, Unknown
  Kingdom: Fungi, Phylum: Ascomycota
MAQHPPAAARQTQPPEHPRYNESAPRGMAPSQSSTSLMFPHSVTMQNLGAGHGVQSRSSRTWTASSGDLGLLSDTDELGDRAVFVMEYNRLAKKHSVRILVLDDFEGRNGLVRKIPEKRGWLQRLLRSASNDTPAPRKAIAGTYPRHKRSVSDVPIHTILGRRDATLKVDLQAMVRVSGKSVLYLPAEYAPGAVVLPTCIRATAHHLAHNAMTRGIFRIPGSIKVVNALFDYYCYVEGGGIGLSSTVRCVNLPMHIQCSVHDVASTFKKMLSALPGGILGSLAVFDAMVAIHSQLHGSPEFPRTKQTRIRARLIALAIGTIQSQFRRELVCAVFGLLSLIGRIAKVTPREDEEGRSLPTSDLMGYNALGIVFGPLLVGELLDQYTMKITNPGSGLMLFPVSPQKSRRHRRKAKSTDGVPPAQTNVDKVLVANSIAEMLITNWRDIVRQMKALGTHSSKIGPLNGGVRTGSLRPSASETFVIKKPQDWDSKTSSNTGQRDQSVSVDPCTPTMLLPRERPRHQRSVEWDSESTSQQVGYLENSLKTTGNQKGLREVYEYLYLSPNGHVERISHEQSPDQVSRATGSAIPLTFADKLGKFGDSAGSKSQISKPIENHVRSTLPSVSAAANNPGAVLTMKAFFESDLVPGIDASGSPRESRMVSKSSQASLGKTIRSSKSAILDTPSDADDQLLAFEPRQSGHKFPENGLGQSVDINQRSSIPAVPANKAVAPISDAKQEECSKESRGMPSLRELSLTKGRTHPDESRRPDTRQPGTLGRMILPQSQPPVAQHLNLARPPSTKPGTPNLELSSFEDTETTAPFHRPGSTTMLHAQIRNLQRLLQAKTEEASQFRRQLEAQDDSDIGTLSEQLREAKREAIMWKERAEAAERRVQVFEKFTAKLRGIREASAVAKKQEREAVHRQSSIGGSSRCSDGSNDENVSPAQHMKPRKGKRAVRSTETCGSGGSGQTEDAGVVTARIRRCLHDGPTGSDGAKDSLDPQGGIVTKALIDMSLTTSELSRRNVSESAMEVWAAAQELLSAEVDAER

SEQ ID NO: 1973 - protein, 764 aa, Unknown
  Kingdom: Fungi, Phylum: Ascomycota
MAPTIPASAQGGMFHTFQGVTPRKPTTEAHDGTKPAGSTGSKRITTPHACAECKRRKIRCDGQQPCGQCLSSRAPKRCFYDKHRQRVIPSRKTLEALSQSLEECRSILKRLYPNHEVSSLLPLSRQELLNMLDHSGDAVVALPSPPLNTSPTKTESGSPLGLDSEGSLASLEPLSSRDMDWEEDNRCHESLPTETDDTNGFSFHPDRQASYLGASSIKAALVVMLKVQPQLRSSLAPPLNSVEMANNLPIIRQRSATPKDSSRIPWSWKGQTLIDAYFKRIHVFIPMLDEAVFRADYLEGQRFDSPWLALLNMVFAMGSIVAMKSDDFNHINYYNRAMEHITLDAFGSSNIEMVQALTIIGGYYLHYINRPNMANAVIGAAIRMASALGLHRESLAQGGSDMAAAETRRRTWWSLFCLDTWATTTLGRPSFGRWGPAVNIHPPEFGVNQARDSAQHAGILPLIENIKFCKIATQVQDMLAITPLLRTEDRCNMDGQLVAWYSSLPWLLRTTDPCAEPLYIARCIMKWRYQNLRMLLHRPILLSMASSASGHQLLEQDVAAVETCREVAKQTIEDIAREWSRNQMSGWNAVWFLYQAAMIPLVSVFWEWNSPRVPEWQKQIETTLELLDAMEEWSLAARRSREVVWRMYEASRQPSVVNGTGGSTTTSGASITPTNLVTTMGPDMLALAESDLHMSPIGLETDDMMSLLDQHGLWDLDGMQWGHQSHDSIPVDSGLCGLGEGIMQMDYGPISGQPANLDPAFFVN

SEQ ID NO: 1974 - protein, 353 aa, Unknown
  Kingdom: Fungi, Phylum: Ascomycota
MIVTMDTSSLKPNDPRVSYKTANVNGKTYSYILGMPPQGQEPIDTVFLCHGFPDMAWGWRCQIPVLMSLGFRVICPDMVGYAGSDAPKELEAYSGKSVAADVKELSAQIIGEGKQIILGGHDWGGQVVFRVALFYPELVKAVFSVCTPYVPPNPKWISLEDIVRTHLPQFSYQLQFAGPDVEKIVQGPEKIRQFLIAITGGKTQDGEYAIDVKSGGVDFKRLDSMTKSPAMSDADLDHYVSEYMKHEAPQLRGPLNWYRVRKINYDDEKKLLDERGPEASILNMPVLYIGATYDTALPPIMSKGMDAVVAEGKLTRGEVKATHWALWQAADDVNRIMGEWLGKVLERQLKPSL

SEQ ID NO: 1975 - protein, 353 aa, Unknown
  Kingdom: Fungi, Phylum: Ascomycota
MLAFLLSLFAIAFVAARMQPFVNRLRGLRTGPQLPQPARPLPSPDSANTEGEDDGTAYKPTPVDVVVVRALLSHGRKIPPDVVDVIFDFAEYWAHSSTEIDYRLERKSNMTIHGRSSQEDRLLLRSFPVGLTSTEGRADVAEVQRLARYPTPTLVHPVRKIVFTMRSRDQGAGITRTRDIYGQGWTWFEAGLERFDADHECDDQCITDGRFLSPDSPGPTLPMCSLRPIYPTFSKRQREEPVEPSGTEEGPPEADYVYDHGYLPVEERLIQRNRTRERAMMTHVVQWSWTDDTDPESAAGEELNSKGRGRSTGDGQFVRDLKVGDVVTVWGKAKFRAWVNHIEKVKIDIYWAV

SEQ ID NO: 1976 - protein, 541 aa, Unknown
  Kingdom: Fungi, Phylum: Ascomycota
MATSSGTRFLCNLTIQAHRQRKEQSHRIARHPTTELALSSTTNDQASVGHSEDYVTLIPDPADWDAFDEDLNPRNWALKKKLMATILVTQISWLVQFASAIDASVLDGIEAKFNIGPYNLSADDSWGGETGLFLIGFALGAPIAGPMSEATGRNPVYVMSLFCFLISTLISAVSTDLFWFLLARFAAGFFGSTPLVCAGGTISDLWSPRDQLIAFPLYAAGGFSGLASGPAAGGVIAQGAGRGLPQMTEWSTLITGTGLFLMTILFQPETYAPILLKWKTCLIIDNMKDDERNLLFPHRTYTSIGHDIKALSQALWHAFSRPILMAIAEPIVYILSINLSVVYLIVFTILPGYHTIFVGIYHFSPALCGATFYSLAVGMLFGVCLAMGLARYWSKRHAGPTLAGFDPEGRLDYAFLGAPAIAISLFWMGFTAREDITPWSPILASGLLGFGVLCVFLSSYMYIIHAFGRHAASGLVFITLVRYLVAGGMVVAGVGMFEHLGVRTTFAILGAVATLLIPVPFCLFSYGCKLRMMSVRSVGNL

SEQ ID NO: 1977 - protein, 144 aa, Unknown
  Kingdom: Fungi, Phylum: Ascomycota
MCRHCRSEWTAADFLELCPEGDKCVLKHGYCAPVIQILGESGHHVSIGRSILPPPPQQQQQQQQNHNVVPPILAYPLHQRNPSESADMGGPGILEDMCEDCKEKHYREWAIEARVRQEQQLQQQQQQQQQQQQQQQAQQHMNSV

SEQ ID NO: 1978 - protein, 247 aa, Unknown
  Kingdom: Fungi, Phylum: Ascomycota
MSSTEPTEPKVEETKPAETTEAPAADAGAASTPAAEENKPVTSSSVFSMFGGGAKKEKKEDEDRGDTSGSAKAQRDAAAEEDQAPESEDVHFEPVIKLTEKVETKTNEESEEQLFKMRAKLFKFVKESSEWKERGTGDVRLLKHKENGKTRLVMRRDKTLKVCANHYIVPEMKLSPNVGSDRSWVWNAAADVSEGEPEALTLAIRFANSENANLFKDAFIKAQSENEVLFKKESGDAEPEAAPAPAA

SEQ ID NO: 1979 - protein, 538 aa, Unknown
  Kingdom: Fungi, Phylum: Ascomycota
MITAAQWVRRGFAAPFPTKYDLNETEYERIAELAKLQLDDAEEDLREAQEENDGVKKEPSTDGAEEMEVGGTKKSKVKSKSTSFADDEDLKEYDLDNYDDDEDDGAPKDGPTSIFGNVKSLAYYNSNKDDPYITLHADDDEEDREDLQILATDNLILSAKVEDEMAHLEVYVYEDEADNLYVHHDIMLPAIPLAVEWLDIPVNKGAEASEQVGNYVAIGTMEPDIEIWDLDMIDCMYPSAILGQGSNPQSGEKKKKKKKSKKTSDEYHVDAVLSLAANRKHRNLLASASADKTIKLWDLNTATCAKSYTYHTDKVCSVAWHNVEATVLLSGSYDRTVVAADMRAPDAKAPRWGVESDVENVRWDPHNENNFFVSTEGGAVHYHDVRNAPSDPTGTKSVWTLQAHDESVSSFDINSVIPGYMATGSTDRTVKLWNISATGPSMVVSRNLDVGKVFATNFAPDPEVAFRLAVAGSAGTMHVWDTSTNAAVRKAFAQRVPEQSDKVEDRLVGVDEDESSSDSEEGDDDEEDKESDDSMDED

SEQ ID NO: 1980 - protein, 466 aa, Unknown
  Kingdom: Fungi, Phylum: Ascomycota
MAQQPLSSAAQPTDVYGGDEVSALVLDPGYCHTRAGFAGEDVPKSILPSFYGHIASDPPRNLFGDEYLVPREKLEVRNYMNKDSVVEDWDVAAKIWEDVLVKRLQPEKQTPPSKNGLNDDPKEDGEGDVAMDDAEQQEKPLSENPLLITEAPWNSPKSREKAIEIIMENWGCPAFWLSRTPVLAAFAAGKATALVIDVGGANTSVAAIHDGMVLKRSIQRSPAGGLWLSSQIRNMWENSDPRVELTPTFMVENKTPVDDRAPPQFRPRKYGFEISPSFRAYEEERVLTEFKESVVEIWRGPGRYSAPGNEDYVKTQPGRVFEMPNGYNQMWREQRMRVSEGLWDENAGFPVPESERLTKAQTIPELIRASLGAVDVDLRGNLLANIVVTGSTTLINGFNDRLNNELMMMYPGLKIKIHAAGLTSERRFGAWIGGSILASLGTFHQMWISRKEYEEHGSNIVEKRCK

SEQ ID NO: 1981 - protein, 296 aa, Unknown
  Kingdom: Fungi, Phylum: Ascomycota
MPGWISKVAGLAAVPALLAVAWSYIYADSNNAILPLANVVSHLQTRLFPSETSYTCDRSHTYTTQIISLSPLVIYIHNFLPDSDIASLLETATPKFKPSVVTRAGRTSQDPDRTSITAFLPANDSAVSCVLNRARDFAGTLLEGKEDDEMGMPQVVRYMGGQKFNLHYDWYNLPQRLTDQDGTHRFWNRIGSFFAILEDDCEAGETWFPNVTAITGPSSSQSYASRGEGDPEYGKPLWRAHERGGLAFRPVKGNALFWMNLDDEGKGDPRVKHAGLPVRSGRKTAMNIWPRKYFYK

SEQ ID NO: 1982 - protein, 340 aa, Unknown
  Kingdom: Fungi, Phylum: Ascomycota
MSSMKRPVRKGSLTGPRTIRIVSSSKPPKPEASAGPTAVKQKSEPAKDDKDDLPFALDIRDIEFVDDVAQLPIAALTLDVPLIPFKRKILQPPAPFPFLELPSELRIKVYEYYFADVDDVLDLDPTNYKRYHKLLGFMRVCRQVHAEATHLFYSTHSFRIFPVHPARQKHKRTILYRLKPRQRELLSTLDLRFGPNWGSPPRSWVVNDSLGLQDCVNVTQLNIFVECDPSDKIFKGWVRSEGFYETFTRDLLAEVISKLPSLRVVQFDAWSSVKKRGAMMSGLMDVVTKSELAITWGPERGWTNAVDDDDDDVRPATLDMWRAIISNPASYNYDNLLVTA

SEQ ID NO: 1983 - protein, 405 aa, Unknown
  Kingdom: Fungi, Phylum: Ascomycota
MLFKRLVTAVASLTAVRRDDEPQDLGSVLAGHKNLTTYYSLIKKYPDILLQLPSYSGVTIIAPSNSAFENIPYTALNEVWDPEDKEVTVPLLQYHILQGTVAAGGLEAGPSYVKSTLLKDSTYTNVTSGQNVVINKSGDDVVVLTTSMGTRCTVLETDIVFQGGLIHIVDNLLIPPARLDRTTDAFKLPSFLGALHAADLMPGIAEHKNVTIFAPQDKALGLVGGTLENLDQEALRRVMNYHVVPNQVLVSSSLLNNSLLDTLAEDAAGQALPLRVFSEGNSKYINSAQIVQPDILIANGILHIISNVVNPEAFAVTPNPAIGTQAPVFPVSEEAGVFTSDLPCTTNCPVTTTPTPQSSSADASTTTSDIFTSESEDAARPARPTGVFSGAAIGALGLGAGMVLL

SEQ ID NO: 1984 - protein, 545 aa, Unknown
  Kingdom: Fungi, Phylum: Ascomycota
  misc_feature (342)..(345): Xaa can be any naturally occurring amino acid
MANTENILQGVSVLGKVDDAHRKILTPDALAFLALLHRSFDTTRRGLLERRKQRQADIDRGQLPDFLPETKHIRDNDTWKGAPPAPGLVDRRVEITGPTDRKMVVNALNSDVWTYMADFEDSSAPTWDNMINGQVNLYDANRRQVDFKQGAKEYKLRTDRPLPTLIVRPRGWHLDEKHVTVDGTPMSASLFDFGLYFYHNAFQTVKNGHGPYFYLPKMESHLEARLWNDAFNLAQDHIGMPRGTIRGTVLIETIMAAFEMDEIIYELRDHSSGLNCGRWDYIFSVIKKLRQNPRYVLPDRSAVTMTVPFMDAYVKLLIKTCHRRGVHAMGGMAAQIPIKDDXXXXAANDKAMDGVRADKLREVKAGHDGTWVAHPALASIATEVFHKHMPTANQLFNRREDVQIYQKDLLNVDFPGEITEDGIKKNLNIGLGYMEAWVRGVGCVPINFLMEDAATAEVSRSQLWQWVKHGVKTAEGKKVDKAYALQLLKEVADDLAAKGPKGNKYQLAAQYFAGQVTGEDYADFLTTLLYDEITQVGSPKPASKL

SEQ ID NO: 1985 - protein, 180 aa, Unknown
  Kingdom: Fungi, Phylum: Ascomycota
MATSPVPFTFPPEYNFPPFFTRQPNTTTHHAQLSKWSSLVLAYCRHHRIFRLNLLDLESPLFCNTIIDRRLSQRDVRDVALFMHKEGRVEFVSGGVNGDIVFVYWKKLEEWAAAVEQWVDDTGQKGAVVTIYELTQGDATAGTELHGIDTDVLLKALNIVVKRGKAQIFGQEESQGVKFF

SEQ ID NO: 1986 - protein, 173 aa, Unknown
  Kingdom: Fungi, Phylum: Ascomycota
MSTRRPQFDQERLVDLTPLPDSVPAVKEIGASSAPLLSAAFFIGARCRDYNDDYMQCKTEKPGQGEIECMKEGRRVTRCATSVLKDINTHCLAEFRKHWECLDDRNHQLWQCRPAEWKLNECVYNKIGLQKKIPDQPANVTPVELRTKQIFADVRIGPGDGKPFVASQNEAKQ

SEQ ID NO: 1987 - protein, 263 aa, Unknown
  Kingdom: Fungi, Phylum: Ascomycota
MHFSKIAASVALATLASAQTFTSCNPTLQTCPSDKGLNVGYYHVDFASGADADWPMVLGEAAYDGQGVAYSLAGPSPGPTMESDFYFFFGTVSVIAKAASGAGIVSCVVLESDDLDELDWEWLGGDASQVQSNYFGKGNTTTYDRGAFHPVADAQNAWHNYTLEWTPYYTNWIIDGQVVRTLNFADAVGGQNYPQTPMRVKLGIWAAEGTGNAGTVAWAGGPTNWSQGPFAMHVQSVTIVNHNPATSYTYSDLSGSWQSIKMA

SEQ ID NO: 1988 - protein, 377 aa, Unknown
  Kingdom: Fungi, Phylum: Ascomycota
MSATMNRANKVPIAIVGGGSIARAHAGFISKSPTCYLQAVVDPFESGKELAAAQSVPHYESLEQMLADACRPDIYLVSVPNGIHVEVATEILTGSALPKVILIEKPLCTDSSSGSALLHLAREKGCAVVVGHHRRFQPPIQAAKAAIASGALGRLTAVSGLWMCKKHEGYYTEAPWRASRAAGGGPVWTNLVHDVDLLAYLVGAKVVRLWAQPTLRRREHPAVTDPVEEGASVMLHFANGVVGTLILCDNTPSPYSFESATGENPLLARAELPVDCYRFFGSEGSLSVPDLLLWSYKQEVADLKGLPIGWNIPISHETLQCTKSQPPLSEQIEHLGRVARGEEDPVCSGQDGLEAVKVCEAIIKAIEKGDGLPVDIE

SEQ ID NO: 1989 - protein, 614 aa, Unknown
  Kingdom: Fungi, Phylum: Ascomycota
MFIPNHPPPIRPPKRAGTQAAADSTLGIIDNDGPYSHLKYAGVQDAILQIELPTRIIKRESIDGNSPNGSWSSSSDGPTDHGSPDPWRPFKPQTSTRQTVVASKTMNQAIRKIMLEQSMRVNSMRGENWDSSAALAMRTARHSMPPAKPIGSYLDALRSLPMASTRLNQELVRTHLQLLSRFKVSIDGNPGPENAFMRHWIPLTIQDPLMLHVILYTSACFLKELGHVPKTLTMAYKGTVYQMLNKSLCTDKTQCSDAVVLAVSQLVIDEWYWGATSDLKAHMLGLKMIIRMRGGLQELGMHGFLAKLVLLNDIGIALAHETETEIFDQPGFEFEDPIMVPFQTSLNSPFVSGWPTFASSLPARMHPSTAAILDDMRILTETVLSGLDHNFEHTSPAKLFSTVSWVQQRLDSLPQELSQLPERPSREPSEDRTCSSSSPARDSTSSSSHSSPVEHVLQPSDPIYSWIRRVAMIYCRAIAQRQPLSTACSPSDFQYLWQFSWRIQSDASWTTVGILFWVITAIIPSSHGHAASRFIKTVMIPALMNMGVDNWHVATDAARRALKLQRWLRGGKAAVGQGVLGGEQTIEKFGFALKDKLVNIGLTEHYEDGEDEGG

SEQ ID NO: 1990 - protein, 417 aa, Unknown
  Kingdom: Fungi, Phylum: Ascomycota
MAITNDNSVHIGEDKREGLFATSSPLSLAERFYNTYVYHLKVEKLRPSELQQPSNTTRQHGASPLPDDASELVMRLTSLNTDLNRDIQVQSEAAAMCLFKEALQPLNASLVPTLYGWASNSKGQGWLLTELLPGENLRDKFDALESEPKRSIIKQIAQILKRIQDYTLPSTAKGYGGLGFADDGAIVVGGTPFPGGGPSPTHSDLYAQYLKTQRVRAQQCEVIKGWEGTDIPSRIAKLEDTFSGVREWEKDLRPTLVHGDFDVHNLLFDPQTNRITGIVDFDLAHIGCQGEEYMWSLFSLGHLLLPADKNSEDITVHRQFLLHGLDDAATTLGSRAKSFIDWHVTLVADEEFSKAGVVRPRDVPALEHIQTRYLATQAISPPVFFQAKTLTYEPEVLQKMKQGEQRELENCLEVLGC

SEQ ID NO: 1991 - protein, 556 aa, Unknown
  Kingdom: Fungi, Phylum: Ascomycota
MKMTAETFETHGVRVAVEGCGHGTLNAIYASVAESCKVRGWDGVDLLIIGGDFQSCRNASDLTVMSCPVKYRHLGDFPSYYSGDLQAPYLTIFIAGNHEASSHLWELFYGGWVAPNIYYLGAANVLRLGPLRIAGMSGIWKGFDYNKTHHERVPFNADDVKSFYHVREVDVRKLLLLQSQVDVGLSHDWPRNVEDHGDSNWLFKKKPDFRADARDGRLGNLAAKYVMDRLRPPYWFSAHMHIKFPALVKYGDEESKDKTAQAQAGSQAPPIAQPSTAGAPQETNPDEIDLDDDDDETSSTVPQPVQPPASESNTVSDELRAQLPASFAAPPPRTRTTPGQPVPEAITNKEVRFLALDKCLPGRHFLQLCEVQPFDPGSSKEHPPLSSPPADSASSASSAFVPRYRLQYDPEWLSITRVFHPSLIIGDRTASPPRDLGEAEYLPLIAEERKWIDENIVSKNLLDVPFNFEQTAPPHVPGSPEIVQEGPTEWTNPQTAAFCKLLGVKNLWDARAVEEDLEGEGGEEEVVEEEAEVEGEEADGNNILGAPNMSRWKGSS

SEQ ID NO: 1992 - protein, 265 aa, Unknown
  Kingdom: Fungi, Phylum: Ascomycota
MISYVWTAVITALFLAQQSMQNPHQGRTHTRVAVYRGPGTIDGTPESAAELFTSAWKDSRVTYVGPKEHVKITRAALGEFDVYIQPGGGDLDPAWKTMKEFNDTIRDFVSNGGHYLGFCLGAYLAGQGPGFDLFPPGVDTDQEIPQVRNHDESDTVIQVDWTFSTGEKRGRTEKNRWLYFQDGAAILGSLGRPGDRGKVLGRYSKSGDAAAYVVRYGEGVVGVVGPHPEATKDWYDEYGIKNPTGYDLDVGRDFIRAVMEYKGCD

SEQ ID NO: 1993 - protein, 593 aa, Unknown
  Kingdom: Fungi, Phylum: Ascomycota
MAPRVRIVEVGPRDGLQNIPDQLPVQTKLELVQRLHRTGLGTIELTSVVSPKAVPQLRDYSQLLADQRIQTLLSDRSRRCPVLVPNLKGLELARKHGVRDIAVFISATEGFSKANTNRTVAQGIAISAQVAEAAIKSNIAVRGYLSCIFADPYDGPTPPSAVLDGVKALLAMGCYEVSLGDTLGVGSPQQVRELLHFLLSSGIPAEKLAGHFHDTYGQALGNVWEAYQCGIRVFDSSVAGLGGCPFAPGAKGNVATEDVVYMFQQAGVETGVDLTAVVQVGHWISAQLRKPNGSRAGMALASKMTTKTMTTTAGSLVWQLVDQLSGVLVHRSGVNLKLTMNRPKNGNCLTAPMIDDLTSQFRRAAQDPTISRVALTGQGRFFCTGMDLSKDTTAVGSSDTASDAQFNRLHALFEAIDRCPKVTIACLNGPAFGGGVGLAFACDVRIATRSADITLSEVKLGICAATISKYIVREWGVAFAREAMLTARTVRPEELLRKGIIMRVADNVAELGSLLDSTLTSLRVASPAGSSMSKELVRLGWAEAGQDAQDHGIKQIFDTMMKPGSDGAFGVKEFQQGRKVNWDERRTQVPSKL

SEQ ID NO: 1994 - protein, 503 aa, Unknown
  Kingdom: Fungi, Phylum: Ascomycota
  misc_feature (254)..(255): Xaa can be any naturally occurring amino acid
MAASEASVPAAVTGKADGRRSPPATTAQSKRDRRRQALMERLSSMNDKFQRERDMTYRDQLQKIQFDTSLVQRFDPYDPRALEVIADLQAEHRQSQGPAVNHERARSLLDMAGIRFSDFIEEVEDLIEIRDFQLAQSKNEYERKVQEYKNTYIYKVETAKREHRALTSTLRDRLINTLTQKKNRLNREKEVLEINDSNALLLNPNQFSLTNPSSPGGTHSKRATRLRKDADDLQMYGDAKKRKRNPGEDDGSPXXRCDERSILTTQPALAAHQYILRNQKNANGSSPDDSDSGNIDDLAEDAESLPSAPMMERQVSHATRSTRGANQNYVDDKILGIEAIANFDPANLNLVHAQEPPKMPPYVPQQYLKPYPRSADQNFPTMLSADDISSDLAIIGHFKSYDQTQRKPGAHLDTATGMRKMLENVAIPYQKGRFVAYTSAARDDPETIRDGLGLPSLSSVRDASPPPSTGNAATAMSRTSSVGGVAMSRQGTGGSNRGRSRRG

SEQ ID NO: 1995 - protein, 376 aa, Unknown
  Kingdom: Fungi, Phylum: Ascomycota
MAANFPVQPIGRFAGSSQPVKRPKEFACFSYDAKHQFRLDDSSLKYYYTPCLGADLSQGFDTFIKNDDSKAEHLDSLLKTIAAHEQKTGQKIDANVVTWRGMMTKIMAAPFERFDGFEMNVTLYDDCLFIEEDHDSKMHSRRNEAPAKPRRGPPLELMQFWGYKFETLSTLPAPWAETSREFIENREKEVVNNKEQYCSVVRTGVGSTTLCLGGEVDAIWDSKPRVPGSPINWVELKTSQEIRGQGDMDAFNRKLMKFWIQSFLLGVPKIIVGFRTREGILAEVKEIETHTIPEMVNAGPNPQWNADMCVNFAAAFLDWLRSTITEDGVWRIRRAPQAPVIEVFRIEETGHGEILTEEFKNWRIKLMLGPGPSSEA

SEQ ID NO: 1996 - protein, 203 aa, Unknown
  Kingdom: Fungi, Phylum: Ascomycota
MGALKYVEELQKKKQSDVMQFLLRVRCWEFRQLNVIHRASRPSRPDKARRLGYKAKQGYVIYRVRVRRGGRKRPAPKGATYGKPTNQGINQLKYQRSLKATAEERVGRRCANLRVLNSYWINQDSTYKYYEVILVDPQHAAIRRDPRINWIVNPVHKHREARGLTATGKKSRGLNKGHRYNKTKAGRRKTWKRHNSLSLWRYR

SEQ ID NO: 1997 - protein, 629 aa, Unknown
  Kingdom: Fungi, Phylum: Ascomycota
MRKLSLAMPPSTISSKASVCSRVLLRRCICRHRPITYSRSASCSVTSTRTASALNPNPLTPQRFFSTAITDRGVRPRVSRRVTTKRSTAGQPPTASSSSIAPPKFNDPQSLNFGSHHHTLSRRDYTTSSLSTTVSSSLGPDDDYSPNTTDTMSAPEPKSKENAKGKTVLKIPKGTREWVGPEMMLRDHVFNTLSDVFNRHGATPLDTPVFELKEILAGKYGEDSKLIYDLADQGGEICALRYDLTVPFARFLAMNNIKNIKRYQIAKVYRRDQPAVARGRMREFYQCDFDIAGEYDAMIPDSEILRIMVEAFRGLGLAQDVTIKINHRKILDGLFQVAGVPEDKIRSISSAVDKLDKMSWEEVKKEMIEKGLTAEVADEIGSYTQKSGGRDVLEFLKSNERVAANETVKEGLADMELLYNYLDAYQIADKVSFDLSLARGLDYYTHIIYEAVIELKSEKSTETRIGSIAAGGRYDNLVGMYGKTKIPCVGVSFGVDRIFTILKQRKEDEKLKQRSVDAFVMAFGAKNGLLVERMAVARELWDAGIKAEFSPKAKPKLPQQFKAAESAGVPVAVILGEDELAEGKLKLKVLGLPDGHPEKEGRLVEKTKLVEEVKKLLEEHGGPKALPLR

SEQ ID NO: 1998 - protein, 677 aa, Unknown
  Kingdom: Fungi, Phylum: Ascomycota
MSSKRQQARNEKALQDLVHKVAGNNICADCHTRNPAWASWSLGVFLCMRCAAIHRKLGTHISKVKSLSMDSWTNEQVDNMRKVGNVVSNQIYNPENKKPPVPVDADEADSAMERFIRQKYTNNVAKKSSNPSSPRSDEGTPPPLPPKNSKFGFRSATSSLFQRPKKDRAPEVHGPPSPRLTNKPSKVFGTTVGYDNPDEREKNMIRLRDMGFHDFQRNAMVLKGVNGDLEKAIEALVRLGEGDRRSPGALPPANPPTLRTTKSMTPLSTNPAGISIGLTVGGRADSDRPYTPSSVTTSNNPFDAFPTAQPQTAQSTGSLQNNNPYNQQSTNPFGPVRQSTDPLSQAFQGLTVNAPQALFPHHTGGPAAQQAPQQVIYQQSQAPSYSSSSHTPQGVPFSTMPSMTFPQPSQQPIQQQPTGYNPFFPNNLAAPQQPQMPQMPQNPHMPQSFSQPNLSLNTAQSQLGGGSNPFARSPTRIASPSVLGQIPEQSQSNFQNMAPIYQQQMQAPSTNNPFLAGAPVQSPAQTGQQQQYFAPQRADKASIMALYGQAAVTSSQPTMSPAQQQPYQQQPPASPNYATYAQQPTSPAAPEPSMHLQRAQTAPIAPVAHASMNPAQSVNSKNPFLNATSVVSPAAPTDPFASGRHITRESIILGNDMAWANGRHSPDAFASLSARHV

SEQ ID NO: 1999 - protein, 84 aa, Unknown
  Kingdom: Fungi, Phylum: Ascomycota
MEQTTQQQPSSPETAPIIMNESPVADNKGHRRMSDEWDAAKTPPSRFQKRKGSIYATPSSRDGHIDRNYADKYHAKIAEMSKSK

SEQ ID NO: 2000 - protein, 313 aa, Unknown
  Kingdom: Fungi, Phylum: Ascomycota
MPSTEYFGYLVTNFGPLTTTFTAAPSCETQNIALGEDIATPPVLWRSECDFPSLANDCMPSASKYDALYHSYKNGDLDHQGWVNYYSPASICPSGWETVGVASISSGSDSISKAGAFTTGGRPGPTDIPGGWPLLLSDVLLGALEEGEKVVWCCPRNHTVDANGVCLSAIGPWVPEDYPQFSTICNYGAVSQDVVTITSYDSTTWDPPLVSLDGDQGYTTFKETLTASVANPQFQVMHSMAALALVNKDDRNHNDNDSKDDDDDSNHDDDKKDDAGSKGDDGDAAASIHALALLPFTVVGLSFLAGIGLLMPW

SEQ ID NO: 2001 - protein, 250 aa, Unknown
  Kingdom: Fungi, Phylum: Ascomycota
MGPKTIIAFDLYGTLLSTDSIASTLAKILSDEETAQTVATHARRLQLEYSWRATCMGIYKGFSDLTRASFRQAAREQAGYRLTALDEARLMQAYNGLDTFKDVDEAMKLLRDAQKKGLDVEAFVFSNGTPEMLAASLNTSPALSSASAVLPDSRLISVEAVGCYKPDPKTYRHLVEVSGAASAENVWLVSSNPFDAMGAVAAGLNSAWVDRQGEGWRDGLGAALEIRPTVTARGVDGAVRDLLAMSSPGN

SEQ ID NO: 2002 - protein, 386 aa, Unknown
  Kingdom: Fungi, Phylum: Ascomycota
MRDPPRRVELLPTANTFFDLTTRSGRAKVNDNSQQPRTYHIGKRTPLRETAIAASQLLEYRRAPLLSPAGGRLQGTLSMAAPRAAGLTEAMGLLRIGAKSAAVSHSFTRGMATEASRAQSLVTSWKPISTVPLTIHSFPSLEPASLEQWSTQHLYLPLRRDLLHLAVVYEGDNTRQGTASSKTRWEVHGSHRKIRPQKGSGRARLGTRQSPLLRGGGKTFGPHPRDFGTKLNRKVYDKAWRTALSYRYRRGELIVCEDGMELPVPEDLLLAPTKYLKDGLQEAYLEKYMAGLLKNLGLSRKDGRTLFVTGDKREMLFKAMAEVPDHGRALDLEDVDVKDLLETGRVVMERSVLKEMIEQHQSDLIAKVFVAGAPSSGPAMGQKVLG

SEQ ID NO: 2003 - protein, 1189 aa, Unknown
  Kingdom: Fungi, Phylum: Ascomycota
MPHAQLTHLHRTVTGPTVPVNITAQQRDRAFTPPSPCQALFPPRSFSLPAFGSLRGSRCSSPENQPSQRPRGSSNTHPISALSSTHVPIQPPELLLHSVTTTHHTLPRPQSSVLTSPRHTPTRPWPGLVCKARLISDSSLSRCHHDFFSTHSGRPGATAKAVTPPPARNLFSPSAAHARKLALDRDVIVSVLESSATRRDAKGYLQKYASKKEAATPTSKPDSPQFFQGLQPSPQQPEGLSSGQGTEQLGVDEELTKVAIVKLREPQQLPDDTLAGIAKTLSQLRALGLLAIVIVDCGIRQCRKTFEHEALRLCEAIDSSFGQPVARFADGVFIRQPRNGPPKDTYLPSPIFSGSVRVDDQGMLSRALRRNKIVVLPSVARPDDLSSPRPTNAHDTLLALAKYLIGMQFAPSEGLSNEGHGSRPSRTASVERVILLDPLGGIPMLGKANVAHRFINLEQEYTTLMGQLNDAHGSSTGPGEQAMSLKLSHAENLTLAKDALSLLPSSSSALITTPLAAANKKQPSDSTSLQLDDMVATRNRRNPLLHNLLTDRPAFSPSLPLQRIKDESHGGLRTVDVSAATLVKRGMPVTILPEPRDRPWRPPEPGSPRLRLTDTSVDLPRLVHLIEDSFGRKLDVQDYLNRVNENLAGIIIAGEYEGGAILTWEQPDGLSEQQAFEQGRFVPYLDKFAVLKSRQGSAGVADIVFNAMVQDCFPEGVCWRSRKNNPVNKWYSERSAGVLQLPDSNWTMFWTTAGLSVEHPMFQDYKASCVLRQPEKTSPGKFREFGGIAAWYIWLQGIDKVVDAGGSPTIHLHCKRAGVPSRTPGGNAHAGPLQRSAVGPPQARQEGTYFAQSPRRSERPHEQNPNRRRIAKMDFKGFGKNLSNFGAQFTPFASRTIQFTKEQFGQTQLPDEYLELEKRADALKQAHQKMLAVTSPYQNETYDYPPNIKETFQDLGRTVSEKVHLLSSATSTSEAQAALVAPPSAKPQPKTFSHAIARASLSSSQLLHQSHTGAGEDPLATALEKYALTMERVGEARLAQDSQIQSRFLAGWSTTLNTNLNFATRARKNVEKSRLSLDAVKAHAKGTTFKLGGHGAQAEGQEEQELSPEAQEEIEKAEDEFVTQTEEAVGVMKNVLDSPEPLRNLCELLAAQIEYHKKAYEVLSELAPFVDGLQAEQEASYRKSREEAS

SEQ ID NO: 2004 - protein, 510 aa, Unknown
  Kingdom: Fungi, Phylum: Ascomycota
MALLQLDLQVALILLSVILLLFLIQTSRGPRITRDGKPLRHPPNTLPLVGNGILFLQARQKLFAWFTRCIHLTGPETLSISVPSLPPGVIISSPANLDYIFRHEGVFQKGHFFTHRSNDLFGAGIINVDGELWRLQRRAGLQFLNRENLRVLTEVALPALINESVDSLDLAAERRTVVDLQEVLHEITTQVMGKMAYDMEMHVHDEFTRAFEYASGATAERFQNPLWQLTELITPAGFKLRRAITTIRSHGKRIVSSAVAARQQNTGQRPDTAGKGALDQVSGSLIHSLLDSIGDEKLVADSALNYLSAGRDTVAQALTWTFYLLMRHPHIFQNLRQAVLGHKGDMSIEELLSPQRLSPTNMPYVLAVFYETLRLYPPIPFEIKQAQQDTTLPDGTFLPATSVVVWCPWAMGRSFDIWGPDACDYRPERWLTTDGQVQHRSAAEFPVFNGGQRLCLGKKMAEAVAVQVIATFAAKFNFEPAYEGERESVSSLTLPMRDGLPVLVHPRSYK

SEQ ID NO: 2005 - protein, 398 aa, Unknown
  Kingdom: Fungi, Phylum: Ascomycota
MSYYDNNPQWSGQPQNNWEHQGTTTPVRAGSSPALTRLRNDAATDRAAGASGPQPQDEYAFSYQFDEVDRAYENLQKSGKGYGMGGGRRKFSPMHGPGSARRTPDFEGGRMPHGPGPRSHSMNSFDEARGPQGANLHSFYASQRHQPSRGSNEAEQVMQAKRRMAAQRERELRNLHTEQQYQRNVLTDMTTASSSTPPAAAGNAGNKHMSEEETRELIARQRSALYGEGPFADQGGYVDENGSVRTGAPGPSGPPSLRGHSPMTFDGIARAPTGGDAGTPGSAADPSALPNDPSPRPASTTSPQTAGPTNKVFDNAVSRTNTSSPTGGSPPRDLAPGSKPGQSGASVAPIGTRPSGTSAGTSSAKRSTTPGSTGGGWGRGNGVWGQPSGLGTQASVWG

SEQ ID NO: 2006 - protein, 150 aa, Unknown
  Kingdom: Fungi, Phylum: Ascomycota
MQLITLLSAATLASAAALPKSLEARNKDVLPGHCCFTLKDSSGNTVQQASSGQVQIASSQPNGWYCLDLSSSSAKVLRDDPNNACIVDSRGQFMCVDPIPGNVAWTLGSGGELKYGGNNKFSNCNGKVFGGSRSGCKTTTLKASGKKGSC

SEQ ID NO: 2007 - protein, 510 aa, Unknown
  Kingdom: Fungi, Phylum: Ascomycota
MNQIRTPEASPLLASPPARREFGTHVGHYVEPLREATYDEEYDSFPDPRPSRAVEDDVLPETSALGRTLTWRSCFILVISRVIGSGIFATPGTIIKEVGSPGLSLLLWLIGGVVAACSLAVCLEYGSMLPRSGGDKVYLEFTYRRPRLLASIVIAVHALLLGLTASNCIIFSQYVLFALGRAEASAFERKGLAAGLLVVVTFIHVVFPRFGVRTQNLFGWLKIAVTGFMILSGLYVILFHQQTGSDVSALKQTGSTWDNAWEGSVWSWSALSTAIFKVFYSYAGLDNMVNVMNEVKNPIRTLKSVGTTALATACAMYLLINVAYLSVVPLDEIKSSGELIAALFFERLFGPRLGRTILPLAVALSAAGNVMVVSFAMARLKQEIARQGIIPYGDFLSSTRPFGSPLGGFLLHIVPSFLVIVLPPSKRVYSFILELEQYPAQILSLALAFGLLILRYKRPDLKRPFKAWLFAVAVKIAMSLTLLVTALVPPHDMFEGGIFYATYAIAGTSV

SEQ ID NO: 2008 - protein, 239 aa, Unknown
  Kingdom: Fungi, Phylum: Ascomycota
MRTTSRSHCELSLLTILLRHWSSVGMSFFKILWGISLHFLQAVASQTIPEFDWASVRCPQSALETLPTPTYGSSGGLFTVCTELIFNAPAVEIYHALLDFQAYSSFSSFVIDIELPPQIRKTPDDVFLGLEMTFTTRDIFPIINTTSLEIVTVMENSTDGEYMMTSWRYDDKLGGMFSRSEHPSILVEQSDGATRYISFETYYNDPGTYLLLPVRKQLQEGYARHGADLKAYVEGLWRG

SEQ ID NO: 2009 - protein, 855 aa, Unknown
  Kingdom: Fungi, Phylum: Ascomycota
MAGPAIQDASVTEPLLGNGAAPSSSRRDRDTSPAAGEAQQGTFRKNLGALEAFGIIISIVIGSGVFTSPGSIDTNVPSPGLALIIWLVGGILAWTGAVTFAELGTAIPGEGGLQPYLQRIYGDAVGFLAAWTWVVAVMPATLAILSIVFVESAYSAAGVTGEADRIEHKLFSVLILVVMSVANSVSTKASTSLNNFFVLVKFLAILGVVVAGLAVVVTHLAHPHREAGGVDWYERSWFGYRTSLNPDGSKTHWEQLSQWEIFGHYSAALYAALWAYSGWDKAVYVSEELSKPERQLPLAINSALSITIVSFLVANAAFYVLLPWNVIATTDSVAVTAITRLMGRASGVIAAVLICVVVAGSLLGNSFVASRMTVAAANRNWLPTIFSVIGRFGKQPSPSEDTERDAKSASDAPINAVFLSAVLAALYILLGSFRALLTLNGLGEYSFFFLAVLGALILRYREPELRRPYKAFIGFPIVFIVSRHKGEMEQVALKDASTGNAIPTTLSTKRRPACVACHNRKIRCTGSASCCDRCENRRITCLPVKKRSPAASVARNTTERPVADQGTISSDIFFGTINVNPMVPDLTPLPSGEPGLLLGSYTSPTDTSSQEIMQQLMSGLDQPELTTTPSSADPSSTGSAAACSCTQNVVQVLSNIEEDQFKLAQLALDQVIQLQKWLMFQCCTVLECPRCHREQPVHSILVLICERILLMYECSAGRLAKAALAQSAESSWSEPRKGADDHASYHLPNKMGALFCGISGVPLETATCEGGICSPEQGSQYSLEEQVCMVHALIKLHMKSFRNLLDWISGVSEEFGNEARRGRIEALGTRLSTAAEQIDASAGRVMNRPEMGQPS

SEQ ID NO: 2010 - protein, 688 aa, Unknown
  Kingdom: Fungi, Phylum: Ascomycota
MSTLPPDHHRSTLMRTSSAAGNMAAPSAKPKPAAAAAAAKAANNGAAKSKSQMHRRSRTGCYTCRLRRKKCDEGNPMCTACRHLGLECEYKRPMWWSNNEHRRKHKDNIKMIIKRKKLTEKSAHSASTSVNSPPGLSHSLPTSATFTDPLDRNRSASIDSHFSTAFNFNSPPTEFGHFNGQVPHEFMFGTYSPYEIDVKTERQMFVNDVPTLRESHVSTFSTFHTPPPPGTVLSQGPINAEWSEQAQHEHRRASLPEEALDVNFFDFSRGHSAEASQFKVELNENDQRLLDHFIQHVIPTIFPILESNQHGSVTSSMILPALQSNTIYLHCCLSIAGQHLKAGRGDDGSSIDAEIMNHRYATILGLCEALKRDEDHQQILEVTLAVIFFQSVVGRLDDGLLDVPWHQHFQAAISLVQKLDLPRLVSNPAEPMAQTPFNMSLTAWIDILGGSIQGASPAFAHTYREKHLSKANPYLGLRELMGCDDRVMYLISEIACLESLKKDGMDDFTLCQHVSSLGQEISLTELPEAPKVPYNANGTLSPKQLSRNITQAFRLATRVYLCSLVPGFSPSQSSPVALIEKLVGVLQHIPSGPDGFDRSLVWVYLIAGSMSLPGSSFRAFFEGRVAQLGEQANCGSFCRMTTLLRETWVQNDALASVSPPSSPSSDAPRPYIHWRDVMQSKGWELLII

SEQ ID NO: 2011 - protein, 118 aa, Unknown
  Kingdom: Fungi, Phylum: Ascomycota
MSSGTTFEYLVIVPDKPGAQAKRLEVRAPPNSIQHLAGIEPARAAGKWQMGGALFHETPQGSDPTKWDFMGSTLVCTAESKQEIIDGLSKDIYATTGVWDLDKVQIYPFKCAFREQLN

SEQ ID NO: 2012 - protein, 546 aa, Unknown
  Kingdom: Fungi, Phylum: Ascomycota
  misc_feature (68)..(69): Xaa can be any naturally occurring amino acid
MADAEEKARQEKIAAAKKRVEQMKKKKGKSGASKKSKEETKEAPKDESQEGTSDAAAAEEPEPTDTTXXETPADDPKSEDTSPSETPSLAQQSKLRSTSFRAASGAGPLSPGPFTPDGDTAPDIYRKNVARIEELEKENKRLAREAADSEKRWQKAEGELADLREAEGDATGGGDEQLKSEIASLKRQNAQLQQQASRSGHGHRASVSLAAPPADLKAELESKSATIESMEIEISKLRARVDRQENGASSEKEQIAALEEKVARAEAAAGKAQRELQDLKKNLERTTEKAVREGSERSSAETKVKTLEHELAQIKEAKSELDAKADALEKKTATLTTLHKEQDSRSQALRKEKEKLETEVKDLQAKVDKLESENIKLRARKSGEGSGGLDDEGMEELENEERIRLKKQIRSLEAEVHELRSGAWIEKRREMEGASPGFQDVDLGGGGLLGTPGGKKHSASHGGIGDFFTSGLNALAGGGGDDELLEDDDMDFDEDAFRKAQEEEQKRRIERIKDIKRSLKHWEGWRLDIVDIRRGGGEGIGDIFDV

SEQ ID NO: 2013 - protein, 584 aa, Unknown
  Kingdom: Fungi, Phylum: Ascomycota
  misc_feature (566)..(567): Xaa can be any naturally occurring amino acid
MPIESRFSVDVPRCSIQQWIFGSPTAPLPDCKAWIDADDPSHFLSLPDARLLAKRIAVGLKEHGVLPGDRVMVYSGNSIYFPVLVLGIWMAGCIFTGANPGFTARELAFQLRDSDASVLLATTQNGKTALEAAQSCGMEMKDIFWIDSSSDHGPFPSFDEPRCDQLITSPRLWTRLMASESKAVMFQWEEPETPEDAVCTLNYSSGTTGLPKGVEITHFNHVANSIAVEAFDELGAERETDDVAKASLCILPMYHAYCQLFYMCNLPRASTPVYVMPHFDFPRFLQHIARYRITSVMAVPTVLNLVAKHPLASKVDLSSILAFGSGAAPLAAQTQIAVLNMLRPGAMVRQGWGMSELTSTGLVWDPTREMDTAIGELIPGNQARLVDIATGMEITKANTPGELWISSPTLMRGYWRNPQATASAISVDESGRRWLRTGDIVFVDKYGPGALFYIVGRAKELIKVKGFQVAPAELEALLLQRPDIADAAVVGVAANGTERPRAYVVRAPDTNATAVDIEAWVAERVARYKQLEGGVCFVDSIPKNSAGKILRNTLREMARLDKSMAXXASSVMAITGPLRAWLIG

SEQ ID NO: 2014 - protein, 601 aa, Unknown
  Kingdom: Fungi, Phylum: Ascomycota
  misc_feature (201)..(205): Xaa can be any naturally occurring amino acid
MPATMAPHQDIELNTLNTLKLKEDSLAHGSSFSMREPDYNDNGAQHPTYFERIIDSFRRDPNSVLFPSDHLGHVESGGRVHNGAHYYDLHQASLETAHTPLARKLKGRHLQMIAIGGSIGTGLFVASGRALNAGGPASLLLAFSIVGAMLYCTCQALGELAVIFPIAGSFSSWATRFLDPSWGFAMGWNYAMQWLTILPLXXXXXRAVFVTVFLIFILAINMFGVKGYGEAEFIFSIIKVIAVIGFILLGIVLNCGGTPERGYIGGEYWHTPGAFNHGFKGLCSVFVTAAFSFTGTELVGLAAAETANPRKSLPTAIKQVFWRITLFYVVALTLVGLLVPYNDRRLLKGDNTNTDARASPFVIAIVNAQITVLPDVMNAVILIAVLSVGNSAVFGSSRTLAALANLNQAPKILAYIDRRGRPLVAIMLAAIFGLLSYLADLPRQGDVLDWLLAISGLSSIFTWGSICLCHIRFRRAWHARGRHPSELPFQSQVGVAGSYLGLGLNVCVLAAQFWVGAFPIGWRSMTSPQVVQNFFLRWVGAPIVLSFYLGHKLFYRTTYVRIRDLDVDTGRRDFNVPILKAQEQEEQATWPRWKKVYKFMC

SEQ ID NO: 2015 - protein, 410 aa, Unknown
  Kingdom: Fungi, Phylum: Ascomycota
MLFSAGRRLSMPSRRRGPVLLACIVPLFILYYLVCLRYDTRAGSSRSRLAYPSPFLNSGSNSASASDLGLDTSVPDKNLTVNLVIASRRRDDTSWTRHLSAAIPNLKVIRYISDYLPDEPLPEYHPPVPKKGREATIYHTYMYDFYHDLPDISIFVHADEQPWHIDGVLQQSLPFALTHLDLTRIAARGGYANLRVSWFESCPAWINTTHSLKDAVHKEEPYMRSTFQANFLEDAVPEEFAGPCCAQFAVTREAIRRNHRGQYLRSRSWLVNTQFKSSIAGRTWEYMWPWLFLHNAPEGFRDHAAKHCPAEWNAYCSMYGICFGDSRSGTDDHGAGGKYNERWIEKEALRRDHLEEWWNRLLHPFNAAAAARRIARLENDLERELMAALERGRDQDLRDRAFLGLFSGEQ

SEQ ID NO: 2016 - protein, 422 aa, Unknown
  Kingdom: Fungi, Phylum: Ascomycota
MAATGDSLTLEWQASSLLHFTSLEPSLYSTFTIEAAHTSRYLVFSAPHTFHCPFFFRSNLIQHFTQLVMSTADKPTLRWGIVATGFISSWFAADLLVERADAKANHVIQAVASSSLEKGKAFVAKHLPGTSPSVYGSYQEAYTDPQVDIIYIGTPHSFHKQNCLDAIAHGKHILCEKAFTLNAREASEVLAAADAKGVFVMEAMWTRFFPLVLSLQDLLHKQKAIGSIQRVICDFSLEQGLDKLGPDSRLKNPALGAGTLLDMGIYPLTWTLLGLEAPLDGGAALEKPEVVAAQSLKDGVDVATSIILKYPDGRQGIATTNASFRSIPPCCRIEGTKGTILVNGVAPQPNNFVLVTPDGGEEKYEFERVGKGFYWEADAVALDIAAGRKQNALMPWSETLRVMELMDEVRRQGGARFPQDEH

SEQ ID NO: 2017 - protein, 456 aa, Unknown
  Kingdom: Fungi, Phylum: Ascomycota
MGFDDDDAPNAAPPVPNGEDGPPTGEDAMEEGMPDYKLFNSLFNKKNVSSKSIRKGEKDFESHGTMAQDNTLEASRQAMEDVLSYTRIHREETWVRGWLFPDTCADWPDDDAQAKLSMRERVVVVEHEKGAWTRDAGRVMPGNRQEPGVGRLWLLPEEALYLVERGTLDLWWPTKSLEELLPAVGSDSDVKPPGPDDYDSGLPLSLEAAYSMLIGEEGDRSKVSLPKYQVYTHLKRAGFSILRAPSNFLQDNIATPTTPIWQWLFSLLSRESPIQHEPSGPLVKPGLYRAYAPIYRRLAIIPRHKPSPTPPTPSEPEEPFRVFYHIWKPSPTPFSKKNPPAPDFRIAVSDTLNTFVPSLDEITTLLDSQPYEPPPESMQANGKLYQRLKHGHRNVLVAVVDSGLVNFIRFGEGAFGEEELFRRFDIQGGHRGGKKGGRGGGRGRGRGRGRGGRGRA

SEQ ID NO: 2018 - protein, 917 aa, Unknown
  Kingdom: Fungi, Phylum: Ascomycota
MASPPPSAPITEPEVRGSDATPEVKPETNGHLPTDSKPKVSDTSAVEKVETGKPLLNGSADDAVKDIVITKTEPDATKTEDKPVEAATETAEPRTSGEVPEPASLPKPTELPKPSATNEDEVMKDASQPESSEPVPPAETTVEKPLQSVEKSPEAATKPGDEAKPASTLNEEVTASTAAPASPKPTAEAQIDVTMGGTNAEGNAEALPTSEADLGPAGMSQLAIDGTDIETSPVAAAESASDAPVKVAREREDDAGEEPAPKRARTEPKEDDVTAPVTAADAMDTTPADSAPLESIEALPANTSGEAPSLSSLKWDDAEKDKAALSPYQRREIRKSLGKAKKTKNGAHFRDSVQRLWPGLWDNYVARIEKPMDLGKIDRDLREPEGPYATFGDVKADLGLIFTNTLAFNGPTHDVTAAALNAVKTIWNEVKTIPAEEPAKPKPFPKAKPVRESRVAAVSTPEPNRRQSAGPTVAAPTPSSAKPAADSRRDSIADADRPKRTVRAPKSKDIDYTSKSRKKLKPELQFCDEVLTELTSTKHFTINQFFLEPVDPVALAIPQYYSVIKKPMDLGQVSRMLHGGEISSVKEFDKNVRLIFDNCFQFNGPPSQGNPVSLFAKQLQDLYTAEMKKKDAWLAKHAKANAPASNPSDDEDDEDEEEDLEAAAAINEMTSNIRVLEGKMREESTKLTELFAADSPDQIMIQVQQNIVSVVQTTLLNKKAQLAELRERGDKPGKKAKGGKSKPSGSKKSAAGAAPKKSGGSKKATKKSLTAAEKDQIANAINDLEGKHLDRAIDIIKNDTGQNENPDGELELDIDQLSPAALLKLWELCKKVLPGFAKDSSSAGPTDDGPKHKSQGAQPKGKKNKPMSAQEQEARIAQLEALSSMYKGRPSEGADVEVTQAPTPTNESSDESSSEEE

SEQ ID NO: 2019 - protein, 449 aa, Unknown
  Kingdom: Fungi, Phylum: Ascomycota
METPGIPPPHDEREQAILDKFILIRDQLLLLKQDRTTYIRSQDVIPLYDQMIEQVSQLNAIRADAGVKEETRVDRVMDSCFQLLSLFYLTIGRNNEAPAAYSLTSTIKRLLDHLIEADLYSAKDLGSIGATLERLSHSVKQATSGTVGNQHSPVVITLIANRVALCQTLLDKLQERLKRLGQPLLETYEKLVSILRCIALANTRPKFSASEVQKFKNQLRDIGEKRIDGKFCAPDGSVPPGGEEVCDLYQRCTLWADLVLERKGVMPEPFRPTYETLISIRNDLEKLSLTQAWSLRETDLYDFQRKLDKIDESRGPDGNFYDEKGRPADLWVQRTMLYLIRRSYAYIYSFMISSEPVSEALLPIYNQLQTLKRCLVEVKKSGGVSSVRELYPYSMKLNSLDNMRVDGKFIVNGDIPEGQGSVSELLAECFDLNYELRVSAEEGDVANGD

SEQ ID NO: 2020 - protein, 121 aa, Unknown
  Kingdom: Fungi, Phylum: Ascomycota
MAVRSLESEGSHVAYARGFHITSHRPAARDDLPASVVEKLAKEEEADSKTGVPKTKAQEATEILDLKCMTMDEMVKDTVERILEPQLAIYLTGEAAGSGLVHKSPKNATRRGNALRRMRIF

SEQ ID NO: 2021 - protein, 326 aa, Unknown
  Kingdom: Fungi, Phylum: Ascomycota
MKLTIAAAALMATSAMAAPNAEPWCYRKGQSCWKRDALANPKAEPWCYRKGQSCWKAKRDAEAEADPWCYRKGQSCWKRAAAADAFAEAIFTSGGLQDRSPEANYSNAPGGAAFNAKRQINELAGLIALAEADPEGYYASLGLEDEFDGDTEADADATVDADATKEKRDASPWCYRKGQSCWKRDALPEPVAAPEADAEAEPWCGRKGQSCWKVKRAEEHDKRWCYRKGQSCWKAKRAAEAVLEAIAGPDAEAFDTKPFDPAHFAKRNAEPWCYRKGQSCWKRDAQPEAEADPEPWCTRPGASCWAAKRDIQAMASVARSIIASAD

SEQ ID NO: 2022 - protein, 268 aa, Unknown
  Kingdom: Fungi, Phylum: Ascomycota
MSWMDSWSRPGKSQPVPPPYYLTSPQTKYCHSCGRIISDRKSHKAAEATSTPPKYCSSRCRSLKPREKDRRFEAAFLALLNGETEFEGEEIPKAVLDARQKPKAKGEKRLTIPCSAVEMLIYGDRSDPTKVFGRRKNRASRAIATPDDSDAEEATLVYHVEDGDGPAPTAFAGKVRPPQHLTSVNGSIGGEKGRAEREVESAEAAGKRMEGQKMADEKEGIKRAARRLCIFGLEEKAGEEKRMCEAVMGGTIVEPSFAKGDWGVRWRD

SEQ ID NO: 2023 - protein, 637 aa, Unknown
  Kingdom: Fungi, Phylum: Ascomycota
MPMLKEPWKKYKQFKPLNLPDRQWPSKTINKAPRWLSTDLRDGNQSLVDPMNSETKWKYFKMLVELGYKEIEVSFPSASQTDFDFTRRLIETPGVVPDDVWLQTLSPCREELIHRTVEASVGAKKAIIHIYLATNACFQRVVFGVSQEESIELATRCAKLVRSLTKDDPSRQETEWAFEFSPEFFSDSDPDYVLRMCESVKAAWGPTKENPIIFNLPATVEMATPNVFADQVEYFCRHISEREKVCVSLHPHNDRGCAVAAAELAQMAGADRVEGCLFGNGERTGNVDLVTLGLNLYTQGIPPNVDFSDLESVIDVVASSNKIPVHDRAPYGGSLVVCAFSGSHQDAIKKGFQAREKDGLGYEDPWEVPYLPLDPQDIGRTYEAVIRVNSQSGKGGAAWVILQHLQLDLPRGLQVAFSQVVQAKADELGRELQPKEITQMFESTYFLDSNPRFNIVDYSIRPDRSSSPAPPEPGRTQDTKNLKRLFEGVVAIDGKEYHLKGRGNGPISSLANAMKSVGINLDVADYKEHAIGKGRHVKAATYILCTVAADTKQSVWGVGIHEDVVQSSMLALLSAASNFAASRPDSAFVPKLAEGQPVSGLSPDAPPVPAVPAAHTNGAPQPISDVVSNLEAKVANM

SEQ ID NO: 2024 - protein, 597 aa, Unknown
  Kingdom: Fungi, Phylum: Ascomycota
MDAPRPWTRGSPAPSTAGPSHLAPRPHQLRPSRSATNLMASAHRPQEQGVIDQRGDLLVDFVVDELPSPGGAGLLMPPHSAHQQVRRVKSSSELASESTTDEPKAKDESKWKNALGEAQYFAGGLISHPAESTRHYSIIRHSSALVWYRGPATSVSITILADTPLPPTRTMWLQQKGFSGNMGMSLKALVGTTSDWIDVTPASKAAPEHIDPLDERGIQRDIKRFIKKASGKTQTHIPRETHIVRIPASAADGYFRLVLCCGDEGQKKVLCGSPVFRIASTSTDPTVVRGASLSTMPLEMGVRVASTVGQQVAKKYTGVVGAVVQSKAARAIPNAAVKKAANAAYQRSGLGSVVSDSWKAGKAGRYSPLVEVNSIDGPVEVVGLESGPEKPFPVTFEGKVVRGTGWSTGELAIPTANLREVSDEIKMRMRGVFAAWACILPKKGFEEISHDWHEAIVTIAPYRNAAPGVILKNKVAVHFIHDFESANFFDTRVKVILMAHLHQPNRDDDPDELIKEHAQDLMVTMASLGRENWGPTEAVTRIQTLKSERSFQERLDSATGKVQKGVDRIPLHWAGVRSESNTSRDYVYGIGGLWIPR

SEQ ID NO: 2025 - protein, 212 aa, Unknown
  Kingdom: Fungi, Phylum: Ascomycota
MAPGTYSLPALPYAYDALEPSISAQIMELHHSKHHQAYVTNLNNALGSYAAAVSSNDVPAQIALQPAIRFNGGGHINHSLFWANLSPASSPDADPKSAPTLVAEIERTWGSLEDFRAALGKTLLGLQGSGWGWLVKDGPALRIVTTKDQDPVVGGEVPILGVDMWEHAYYLQYLNGKAAYVENIWKVINWKTAETRFTGGRDDVFKVLKASI

SEQ ID NO: 2026 - protein, 431 aa, Unknown
  Kingdom: Fungi, Phylum: Ascomycota
MNYPSPRTPGHYPDNSYEYWDAGPSPTPTPPYQPMATPRRTSTAWGHARGTSYSSPRPSKDSPRFNSQGYYSTATDPRPSVSEKHFYRPSGATQRSSPKRDRRHSCTYVRTSTPYGESDEDEIFEAWGHTYVLPAQSKSRRSKQPFHPSHPHGYWYEDGVWFADHDYLQSTAPIFSAEFQDPLPPYPGLRSPTAVPPVSTPGRPPTVQAHRRQASAAAGPVPFRPGTAVPRSTRRPSVSTSAKQQPPRRRQATEKDREKYAIREDYSVKNWDPEEVPILLLGSVFDANSLGKWIYDWTVYKMGPTTPISDMAGDLWLLLIKLYGKVKKAEDTVIMVRTPEAEETLDYFINVGNKLQEKWLSLLKHCEKPMLAAGKKKDSNSLGHNSGVKFVETLFGRDKRLEDTEKFMAKVREFILRFDNNCESIIRNPTR

SEQ ID NO: 2027 - protein, 232 aa, Unknown
  Kingdom: Fungi, Phylum: Ascomycota
MPAQTFNGTNGANGHQAKTKPTANTDIIRPTPIFTPSTGPESAAVQSTINSLSLSEHIEGGYFVLTDLSPTSLPSPYPPYPLSPRTMAITSAFHNNTVSPTRLLSTTIFYYLTPNRPMGSFHKNRSRIIHTLHRGRGQYVLIHEDGRVETFVVGNNVEQGEKLSWVVEGGAYKASFLLEDEQGKGSSEGLLISETVVPGFDYADHEFLELSKLRRLVPDYQADALRWLVREH

SEQ ID NO: 2028 - protein, 1106 aa, Unknown
  Kingdom: Fungi, Phylum: Ascomycota
MSNRYGVTYQNGGADGGGGPGDPGATERRRDRGGSERIAGGYGGFGRSNNDDYDPYGEGYGGGSGGSTRYGTPPQAASRAPPPAQSLRAPPSDRSMNSRSRSRGETNAERQITQVLEHIKSEWPAMYDSDCVPVQLALQLLDNSSVGRAHEYRKFQQTHDYLQDSLKGIVHEHHQGFNSSIGTFHKIQSSIQLSQKRVRALKESLAGSKTSLCATDPELKKLSKTSQSYDELLQTLNELDDLRAVPDQLEARISEKRFLSAVEVLQNALRKLRRPELDSIGALNDLRSYLANQETSLMDILVEELHEHLYLKSPYCQERWQSLSKAHSSGAEAYSDTNTITPFHAVLDGLEVDKPVTEDPMRNPEADTFYYISLLVEALNKLGRLQDAVDTLKQRFPVELFGIVNETINDVDQRHPSSLRGGTAKPEGLHVYTTRETQMRADVIYDLLWSLYGKFEAIAECHRIFHESIKALIRREGAGNNSALLGTFKELWNLYQNEIRSLLHNYVTTDADLYQFDKLGSGPSMNGKDGNRENLFKFAEADNKSVDMVTEYDALESIIQATVPGLTSTSRKQAIDKKNRSTLDEGSSRKAVGSTYGAAQQPMGSYKSLVEPSVFNMSLLLPPTLVFLQRLKGIVPPGSDLATSTLTSFLDNFLVNVFQPQLDETLGKLSETVFGETDAFLQDPKWSSAARRPVFKGTTAFFEVVTAFCRMLGTIPPDQALSSLIVTQMMRYYDRCFSWYKSLVTKTQDTASSEMKLRASARFALDTADLQDAMKRSWATDASDLGLVKKEIQLLIEKTDGWRLEANDVIQDRDTISSLCLLYTSMKWLAVKIASLRSITTNDADSSRQLNRPGTRRWTLLNDPSKVSSEQGPVTLPLTQETAQAFDSIVSSLEELAGTALLTLHMEIRCQIVRSLQIALSPDIAPYLLDQEVREPDPQILTLNSELINFDETTARYLRDKEAFFIRTGLGLLINGYLVHNARSASPMNSKGSGRMQLNILVLQQNLKNVEQGVDLARAANYFALFDQGADAIIEKARRDKERAEKGSSEGDAQVEDEKFTFEELKALVELCYSEQVANPERGIASAAKRQLADKLLELSEHAWQT

SEQ ID NO: 2029 - protein, 575 aa, Unknown
  Kingdom: Fungi, Phylum: Ascomycota
MFKKMKQQEYEMVPIRWRSRSRTHASGADIWVGALLTGLSVLLLWLRLSPPSTNVISESDAHWKWSKITPSTTLRWHRCYNGRYECARLELPMDWQDAKSPDRVVIAVARLPAKNLTDYRGSVFFNPGGPGGSGVWALRDHGHLIQEIVGDNHDIVTFDPRGIGASVPRVECWDRPQQRWAWDAQDACEANANGTNIMSHLSTASHARDMLEILDQLGEDQLKFWGFSYGTILGGTFAALYPDRVGRLVSDGNVDYKEWHLGTHINFLRDTDKVMEGFYSMCHQAGAIGCAFYEDSPEKIRRRLDMLLDNLRLSPVIAMVTTDGHSVPELITYSKVRKLISAALYRPIEKFGPLADALAALETGDGLAYLDIVDAGASALPDACHLEPTPPTTPLDALFEGTDDAFPAIMCSDAEPLTETVAEFEKYADILQEISAAAGAVNVLFRISCAGRTIRPKWRFNGPFTGNTSMPILFIANVADNVTPLVSARNNSQGFNGSVVLVQNSLGHTSLAAPSTCTALHLRSYFQDGILPPPGTECEPDRLPFALEPSASRDFDDRITPAIRALSERVGGAAR

SEQ ID NO: 2030 - protein, 193 aa, Unknown
  Kingdom: Fungi, Phylum: Ascomycota
  misc_feature (187)..(190): Xaa can be any naturally occurring amino acid
MATSDLLPTLLSTITTHILPLTTTAISQGSKVFGASILSAKDLTPFTTSTNNERISPLLHGEVNCIQEFFTKSFPDPSTRPNPRTDCIFLATHEPCSLCLSAIAWSGFKEVYFLFTHEDSKQRFSIPHDINILEEVFRVKAKGETEEELKERPLYNRDNKFFKAKPFIELAEEIESEAEREKLVAEXXXXLSA

SEQ ID NO: 2031 - protein, 757 aa, Unknown
  Kingdom: Fungi, Phylum: Ascomycota
MERNSKLMGTDASSSQVSRAGGAGAVESFFDLSIGASEQACKECRRRKARCNRALPTCDLCVKYRRHCLYEKHARTPLTRKHLTEVETRLERTEALLRQMRTLVPPHLRSWEQQAIAAPALHGPLSDESFNFSSKPQRENGGDVSQMALGPRTPAPSMHSSYPPNNNDMNNDSQRMLERPPETDFEWSEKDPIYPHALSPTGTVEGKEEDSPISDGMASLAVSEREAGYLGVASGAALLRLLESGARRQPSPRSQADQHDVYGLAAQPNPNRHVAESMIDAYFQKYHISYPIIHEPTFRAQYSEVIPRPNGPCWTVLAYVVAAIGVWTSATTTTDTLDLALFSQARSMLTFNYLEVGNLTLVQALTLASNYQQKRDKPNSGYNYLGLATRMAMGLGLHKEFQGWKISPLNMEIRRRVWWTLGIFDIGASITFGRPNVWPYQGVEVAFPLNVEDRDLTAASKSVPRESSQVTPYSAVTTQARFHMITYECYDRVISKHLPTAEQLLRLDAETIGEWQASVPGYFSEQAILPPKYAMSQAVMAWRCRNLRVIMYRPFVIRKALRKREETDEASIKAYERCLGEAKATIHMIAKFWSTNTHDRLAAWYGLYFLFQAALIPCICLRNDPAHELSPDWRAQITTTLKTIAAMVPFNTSSIRCHQTILELCGRFLDEQQLEEGSLSSRVNPPADEGPVGAAMDTTNTASWTGDGPVGESPQTQINGVFGMMWANGDISMENDAGWMEFLRAGSDEPFAGFTGP

SEQ ID NO: 2032 - protein, 749 aa, Unknown
  Kingdom: Fungi, Phylum: Ascomycota
MEKKRKLPARAAARAEQVKRRNVTPRQRSVTPAAPAPEPPVEEAPPPPPPLPKSVQAGEPLPVVDEPQPEDLSAEEYQSVTESGVLAESLSRSRHKWIHEGLFEKYWTKPHKRKGVLQEDPKNPPKDSMTKVGHVTINIEPHLIEATMYVVKAPKPPPSQQPASQSQQPQTQQSPAASLPKIPAQPPQAAPTRPVLQYGPPNGAMPPPKPQSPAVTTPSTPVAAAAQLQSADSEASLNNERATPSTGQAATQDTAIKTESPRPPPALVSASSYPSTTTNLAPPASGPSTPAAGPSQTPPQPPKSGLSMPPGLSSGRAPTAGPATVAARPPGAGVSGSTAKPAAPAPKAAASDPVIALLAQKASRDAELRDLMKRVAMGQAKPGELSHFQQIIDQLNQEYKRSGGQQGPSADRLLVDGKTVKWFAGEVRTILDIVLASNPNQKSSELKPPPRSDPLVVLLVKTALEDQRTRDTIRRIAEDRPGPYDAQSLKDTLDRLQSNTRAAAQPPAGTQPRPGVPNGHIQGHPKLQTQHQPNQPNPQSLRSKGPPPAPKPDISAVVFDFGTGDRYLFPKYSILDTLTTPSGQQVVASFLIVRKGSTSEYGGDPKLDYYQPVTIRLQTQSGRQLENLTRVVAPVEEVRRYMDDVMDNMTRAEYVLLAMRLPRRSPEEGAADSSGDAAKSKPATPIPQPSVETSAAPARPAVLWSSAATKSASGSPAQRPLRIPDPEEETELRYQRLIQAVTAKDVVHV

SEQ ID NO: 2033 - protein, 632 aa, Unknown
  Kingdom: Fungi, Phylum: Ascomycota
MASSSLNHDETTDVVICGCGPTGAMLSAYLGRANIANIVLEKEPDITTDPRGIALDEDGIRFLQGLGLYEHVFSDIGTCIPKVRFVSGVHNDLNKQPFLNFDISSTAGHTGHVAMLSHKQPALEERLRSKIREASSCELRSGCTVTSISEDDEWVYTRYLGANGVERCIRSRFLVGADGKTGFTRKQYLEPRGVHMQWAEKMRYQETWVALNWKLSLPTPKTHPSFPLWKLGYSSEDVFDLFFPLDFRFLCNPQRPAVCGRFGPPSDRLWRFEFLVNAGESDAEMATPAMIRKVVYPYLRHPGARYGLPDPVEFPHDCIEVLRCRPFRFSARSCDRWALGRVILCGDAAHVFPPFGGQGIASGFRDAISLNWRLAVACRSQAANHEQLFTGWFLERKQQLESSLATTIRNGDMVNSRNPFKIFVRDWTLWFLQLLPGWKSWLELGPRIDGPTTYKYEPGMAFIPELGGGVLFSQTYCVALGGQAEVPRVQFSDDAIFAKTKESPFQIVVLLDNLDELQAARQELKVLDGASSESLSVREATFFVPRLPVSAHQQKQPSELDGVYRAASAEEFAASSLCKGRPAPRGYHEDDLWKSAKGRRFVIVRPDRFIFAMCDAGCELERICSGLAKLSH

SEQ ID NO: 2034 - protein, 368 aa, Unknown
  Kingdom: Fungi, Phylum: Ascomycota
  misc_feature (245)..(253): Xaa can be any naturally occurring amino acid
MPYSVPERRLCLHRIDPLWPHNSAVATSLAPPLHVKVAQTAVTNIISIDGLVEDYITNIKSFRRIKDLCCRKPVRVCILPSSHSQHHFKMTSNPASSVSLPDSRSLSYALDTSPANAPVVLLSNSLTAPFTVWDHVVKVLNAKGFRTLRYDQPGHGDSSVPQPLEANTFDSMATDVYHLLEDLSIEKLHGWIGVSMGAATGIQFVTKYPGIVERLVICDTISSSPINAGIDDAFGPRVAAAREAXXXXXXXXXESNTDEAGRMRNLMRRTTIDGFETCCHALRSPSFDLRPLFGKVGAGVEKALCVVGENDANLPQTMETMRAGIEKGFEAAGKPQKVELKVIKNAGHVCFIDGFDQFCKDVLPFLET

SEQ ID NO: 2035 - protein, 511 aa, Unknown
  Kingdom: Fungi, Phylum: Ascomycota
MKQTAILALVGASVVSAAIPSDCPAYDTYAAERHAPYSCGKFKYPYQRPEPRCRTYAVPEVEDTLKKVKKAVKDQDLYRLFLNAWPNTVDTTILWRGAAADNKDEELAFVTTGDIHAMWLRDSANQLQSYKPILNVTSHNETNNIATLYRGAINLQARYIRKFPYCNSFEPPPESGIPVVHNSKRGLYKRGDTVSPPYDPNVVFECKYELDSLSAFLQLSWDYYDVTRDAEFFGKFHWAEAVKTILQLAKDMMISTYTEDGHVQKPVYNWLRDANSATEVVSNGGTGNPVAGNIGLVRSFFRPSDDSTIYQYFIPANMMFSRYLKACVPIMETIDKDTAAQMDTLSDSIAKAHPKYGDIYAFEVDGFGSFNLMDDANVPSLLSIPHLGFKPASDAVYKRTRDFVLSKSNPYFGFGPVLNSTGGPHLGPGMAWPMGVIMRTMTSTDDDEIVYGIKQLMGSTSGLGLIHESVNTHDDTRWTRSWFAWANGLFGQMILDILDKKPHLLERSYQN

SEQ ID NO: 2036 - protein, 234 aa, Unknown
  Kingdom: Fungi, Phylum: Ascomycota
MAETNGTTAKPVLFVDIDNCLYSRSTKVQDLMAKLIDEYFAKHLDLAWEDAVRLHKDYYTNYGLALEGLVRHHQIDPLDYNTKVDDALPLDGIIKPNPELRALFQDIDKSKVKLWLFTNAYVTHAKRVVKLLGIDDLFDGLTYCDYSKQPLICKPHFDMFRKGMKEAGVEKTEDCYFVDDSGLNCRKATEFGWSVAHLVEEGLTPPPTQAARFQISHLEELRTVFPQFFKSTSS

SEQ ID NO: 2037 - protein, 647 aa, Unknown
  Kingdom: Fungi, Phylum: Ascomycota
  misc_feature (631)..(637): Xaa can be any naturally occurring amino acid
MPDANTPPPPPPPEAAPMPTTFTIYNLPPSPARWDRIGIAFMTFCLAWTTLIVASMAFCLYHRNSTPALRVRCLPLTFTAIAFLHCYWILAWLVYPIGGTMPVVLAFDIQYFFMGIWFPLGIAVFHAGNLRFLRVARRQRRWAVDGIDEKDVCNGRDSSLLCRLRSWGYTQRVMMFIGIGMIAQVLLTIGMWLACKKYHPTFGIPGTDIKGDTLPEQMIDLGRGWEWWPSVLWQFIWTWMVAPYLIWKAWSIRDTMGWRTQTIGCCLANLHATPMFLVASYVPAFYPINAYFPPSQWIHLSIMMIEIFAVFIPLFQLLKHRHLARKTAHRNAEWDTSSQTNSTAGSGSELLASNPFLDHASARRTHHQLNPSSSLSFAEKASADEGTLTGHDARQLDSLDVDDDDENRLLTMSALERVLAENPIPLQDFSALNDFSGENIAFLRRVRAWKLEWQDCAAASIPHTQRLSLYNRAVDIYTDFISPAEAEFPLNLSSQHHASLTPVFQPALASSSSCSSSSSGGGPGTLTGPSAATPFDFFPSSHCSNASSSSMRDLYTGPVPASFDMSIFDSSVGHVKYLVLTNTWPKFVAEMHARRRRRSAETTRSSGAGTTRSGFSFVSRVSDALSSLLKXXXXXXXVGGMLLIWSV

SEQ ID NO: 2038 - protein, 453 aa, Unknown
  Kingdom: Fungi, Phylum: Ascomycota
MSLSRNDTSSVAPQDRFPSGVLLPVIPPDDLPERAPRSNAATAASAAGVRALSAQVVAFYFRAPAKAFFRTRVDYLSYARTIHHAQTDRLFKAMAEDASGGRFGSLMRHTWLWMRSTTPGVLTSAIKQEGWSIVPNQILPPLIANIGVGAVLYTSYLSILGVLHEGSGKASKRVYPPPPPSATFTAGFLAGSLQSVLAAPLDALQARYDHRDLMPNDGSGRPRSLWSFGAEKLREIGLRGIFSGWSLSFLKDSLGSAMFFSAFEYVKAQGYYRFVTWYYGGLGEEIVDLLAMKRPTERPRKEHEQTVIRPHYAIEPMFLLAAGTSASFAQQLLLHPLTHFQVKYWDHLEELDDKAAKYRATYAVEGKKPRRRFRMLRAYYHAYQDSLAVCSAEAKSEGLTLTRWLYRGFWWNAIRQVPSTSAGLIIFELIRRKYGFGTEEVRITKDGYDILLN

SEQ ID NO: 2039 - protein, 522 aa, Unknown
  Kingdom: Fungi, Phylum: Ascomycota
MPDKTKTKTTQSKLRDNESVIAEPSAPTNSTFAMNPHGSGLQKNFSLLSLLGIALVVSNTWAAVGGSILVAIFNGGPPGVLYEFLVVAVFYCFVAASLAELASAIPSSAGVYHWATITPGKGYGRLNGFFAGWWNYLAWVFASASMAFVWSNTILQIYRVTHPSFMPQPWHVFLIYVISTWTACLLVCFFNSAMPHLNTVGMFLGLFGFLATVISLAVLPGRDTGSGYASHDFVWKDWKADLGYPAGFVFVAGMLNGAYGVGVPDVVSHLAEEIPNPKRNVPLAMALQMAIAVVTGFIYLVVLMYAITDYDTLFESTFPLAEIYLQGTGSTGGCIGLLLVLLLTIGLGMIGLYVTAGRTLWTLSRDHATPFHSRLSKIHVQFHMPLWSTLFTAVLVTVLGCIYVGSTTAFNAFVGTYVLMSSSSYLAAILPHLLTSRRNIVFGPFQMSTAVGFFVNTVACGYMAIWFVIYCFPFSLPVTAANMNYSSLIWGGLTLILGIWWVVVGSKCYRGPDAEVLALLSR

SEQ ID NO: 2040 - protein, 1238 aa, Unknown
  Kingdom: Fungi, Phylum: Ascomycota
MAAVQTWSSSETKGSYSKVQTRVTTAASLGHDEGRAERGCLSWAASVGHSSKGWKPLSMSTPILSALVVLTLLIAAAIEILAQRSAQYGGLALSPSLDAIPRYAMWSYLYGPNVLAVLYSLIWSWVDLDVKRMQPWFEMSREGGATADGSIFLDYPYDFVATAPVRAFKRRHWPVFLAGTAMMIVFWTITPLQSAILGTGTVTLTEPAVVYARSRLAPVEEQVNILDPEFLNNGYAVGWLGQAMPSFMTTEYGNLPFYVNDTRFDSRNITWAANTTRYSTELDCWPADIDGPNLAGQWYFLNGQGCNVTVSINQFSNYTMLYVGYYSSPYANYALDSPDCPLSSKSTHQFLAVWAEPYNVTKAKFGFYGNFSITALFCEPKYYKERVRLQVDKNSLQPTAHGAYQILGGKEALGEDEFNSTAFEFLLHSGVVERPPPRDYPFLNVVEQHPRLRDANFTMPVSNMVGYAYSRDRRPSGEFGDPKLLHEAYSSAHEYLFSLAVSQLLVNDTSSGLDAEGQITVVQAAITVSRPLSAAVESLLLLVAMMTAFLAWSCRKAPSNLRANPSSLSRLAEAFRTNPALTKRFSRFDSYDAKSLRAALQHVKFMLTEDSVLVASGMATSKDPEGLKLGESHVVAKMSEVERYYDPVRPWALRTDFGVLFVIILAAGIAVLSYFKHLEMSNTGLVRPSTNFEVLQLLENYLPTMFATLMEPLWVLLTRLLCVLQPFRELWEGKAKARSSIDATYTSIPPQLVFWRALRARHWLLSIICTVAFLANLLTVGLGAVFNEAPVVIGTTTDSKLARAAEFQNETLYNFGTEMRRDLITTSSYLDHLYIVLSNMSYSTPLPPWTTRDFFFQPYDLSTASHDERSIYTFQTRGFGAHANCTPTGPLELPVTFPDDITSPNTSEACPDLIQTAAMRMRETGFGRPSSPSAVEFCGTITSSSAYEVCDRPLTLAWGRTKRAQDMNGTSDASFLTCWPTFRTAMFEVEVDSKGVVLSYEMKSKEKDRLDYPGAAVHADVLLTLVNQNLNSVTTRWHNNTFSVDWVNYLLTLSRNSRVHLDPNSPTPDAKEMMPSVEDIYRRQFAILLSLHQDIFKQASTKSESSGIRSQEETRIFMNLTAFVVSLSVMTLNLVVAACFYIRSSAFVLPRMPTTLGSTLAYIAPSRWVLMAPARPERIGATYSFGRFIGYDQQAHVGVEMDPNVIPIDPASIGRREAGSRWGTIWRRRGHHTGGDWL

SEQ ID NO: 2041 - protein, 194 aa, Unknown
  Kingdom: Fungi, Phylum: Ascomycota
MSGSPPSPSKEADQPVHSPDADNQDMDSGDPHAGLGGGFDYDGVKEQDRWLPIANVARIMKNALPENAKIAKEAKECMQECVSEFISFITSEASEKCQQEKRKTVNGEDILFAMTSLGFENYAEALKVYLSKYREQQNQSNRERVMDSNTSWQGGMMQGEKGENTGESVEGAGDPNYMYTAQAGHNGNGTGEGY

SEQ ID NO: 2042 - protein, 647 aa, Unknown
  Kingdom: Fungi, Phylum: Ascomycota
MPERPAVVSYAAGASLAAVALIYVFGPTFTLDGAEGTSSKKKTIVGLRNQANDCFINSVLQSLAGLPDLRLYLIRETHRRRIEDPKVYTNIVPPGEDDAGGSVRQMPQWKLQGMQEGLVTQGLKEMLDALNERPIAKKSISPHPFIRVLEVAFKQRISRQQQDAQEFLQIVAERLKDEYHAGQRARAQARRLGLTPGTQVDTNTTTSPRISTPDIALPPEEKQSDGEDSGNDLAASTTATDTTLATSASVSTEKVQIPLELEEGFPMEGRYESQIECQTCRYKTKPREESFCTLTLAVPQVSSTTLSACFDGIFKTEYIDEFKCEMCRLVQTATSLEHEIDRSTSESFREATRAKLERLRTAIETDPENPPEDIELGDIRYAPKRKIAKTTRLTVFPKVLAVHLSRSIYGAGAITQKNMARVSFPERLPMGSLADQRKYKLLGTVSHKGGHNSGHYEAFRRQNPPPRPFLHGNTFQRSDVYSRTPTPAGTPVISAMNGTAGSPAVSTPDLLSASSGDSFSAISVDSATTTGVAPTSAPRSVPRDPETSSLRSVAASTKSAFSRLASPRSESNNGHLAAPVRASTPRNGSPSPASPAKAAKPRPRKRQSDKWWRVSDEKVREAKTSEVLGMQKEVYLLFYELERGEDA

SEQ ID NO: 2043 - protein, 473 aa, Unknown
  Kingdom: Fungi, Phylum: Ascomycota
MRLINCKADPLLLEEFEERDAPPFAILSHTWGQGWTKVLKACAVARDHGFHYAWVDSCCIDKTNMSELAESINSMFRWYNIAAWTLQELVAPREVFFYDKDWTLFGTRSSLVAQLSSITAISGSVLSPPGGLFIRDLLDEIPVARRMSWASKRQTTKKEDIAYSLLGIFGVNMPMLYGEGSHAFVRLQEEIIKDNNDLTIFAWLSEDGQPYRGIFATSPAEFGLRIQTLLYPTTNGEVIMPLFCRPAGTNVDQVGIVLKHQGASVYTRTNARILGRIRENTPASSNSNVFLTKRLKSTVATTIASSHRQAFRFNFKFKEPETVRLVQAGPEELWDAANQVFLTSGRTEFAAFLRFQVQGKNSGEFVLACGSSRSGGPWVCCGDMAGQLFQVAVGGDYRTLAEMGKSRCLKRDKETSHDLMVRMEINRSHALRFGVAKLKWSVEQVNGEVGVVVDLSVGKNNALMPHRLGSSWE

SEQ ID NO: 2044 - protein, 362 aa, Unknown
  Kingdom: Fungi, Phylum: Ascomycota
MANPTTRRTRIVCISDTHNATFKLPKGDVLIHAGDLTNQGSYSELSKTVKWLEEADFEAKIVIAVIERRQGNHDIALDEKFYSEYGLYFHSQKPESPTACQALLGKSPSISYLCHETTRVRLKSPDGPHTEFTIFGSPYSPRHGMWAFYYDAPQSSSVMTDLPDLWRDIPLDADVVVTHTPPWTHRDETDERRARGCEALRQALWRVRPRLAVCGHIHVGRGAERVEWDLESRNVAFAEKAVTPWSDPGEGNNKLSLVDLTGRKGPTLVNDGSHPDSLTEVKVTNVTFSSDVEASSGASTSIGKGGDPSSQRSDVQALFGRLGRRETCIVNAAIMKSRYPHIGGKQFYKPIVVDLDLPVWSE

SEQ ID NO: 2045 - protein, 818 aa, Unknown
  Kingdom: Fungi, Phylum: Ascomycota
MPRRSQDSGQEAGLLPGASSQLSLTEDLPHHRKHRESAWRDETRISHDDDMYGANTAEHHRLMDEPGIPDAFEMRERTGDEYHPGHSDDDEETVKLSVEEEDSPYPEVRAAVRNFDEDVPCNTVRAWTIGLSLTVLGASMNTLFSLRAPSIAIGPLLAQIIAWPLGHGWAAVMPTRQFNTFGIRWSLNPGPFNVKEHSIIAVMASVSFSVAYATDIILAQLVFYKQDFGITFQLLLAITTQSLGYGIAGMMRKFLVYPASMIWPGNLVAVALMNAMYESHEHMDPSVLGGTIPRYKWFAMMTILAFFYYFIPGFLAQCLSMFAFMTWIFPQSPVVNQLFGGLTGLSFLPITFDWAQITGYIGSPLVPPWHAIANTTIGVVTIFMMLSSVLHYYGAWGSQFLPMSDTHTYDNTGQRYDINRILTPEFTLDEEAYKNYSPLFISTTFALAYGASFAAISSLVVYTYLHNGKTIWRQYRNSSTEKPDIHMKLMRKYKEAPTWWYMSLFSIVLVLALFTVTAYPTNLTWWAFLLAVAISFGFALPVGIIQAVTANQIGLNVLTEFVYGYIQPGRPLALMIFKTFGYITMSQALRFVSDLKFGHYMKIPPRTMFMAQVVATTFSCFIQIFVLNLALNHIPNVCEDHQENKFTCPGGHVFFAASVIWGLIGPARMFSPGSVYFGLFSFFIVGAIVPVIIYFAIKRWPKSPVRWLMAPLIFGGCGAIPPATPLNYLSWGAVGFVFQFWIKRRFYGWWSRLNYMTSNGLDLGLALATLFIFFAFTMQGIGAPDWWGNNIVETTMDVQGTAVQDHVKEGARFGPSSW

SEQ ID NO: 2046 - protein, 902 aa, Unknown
  Kingdom: Fungi, Phylum: Ascomycota
MAHMGFQMPGMPPPQLHQPPQIFGMYGPDGLPQMQHLPPDLAAQMFPDAHLYADDPHDAKKRRIARACDMCRKKKIKCDGKMPACTHCTTYKTDCVFTQVEKKRTPPKGAKYIEGLENRLGRMEHILRLSGILGEDDEDDLGEIERRLSEKHRESAGAASSPNSPSQAPSGHGTPQTGFTSPEPGAKDKDKDKEEKRRSIDPAAAEEEKQDSEEVSALSEMMSSLVTNQFGETRYIGSSSGFSIFSPKGVSWVNERTGDDSFQRMISSVSVDDHKWTNWKPEVFGDLFQRPVFRPLPPKAEAMSLLKDYFENFNCMFPLFHQPTFMHLVERQYSSDPYQGSGWWASLNIALAIAHRLRVMSNLVGPDEDDKAWDYLKNAMGVFSELTMRNTDLLSVQALLGMASFMQGTPNPQPAFQLVAVAIRLAHSIGLHKRGTGFNLNPIEVEQRKRVFWIAYMLDKDLCLRAGRPPAQDDDDMNVELPDADPEDQIGNIPLADGKGKMNLFRVMCEFTVIESNVYKKLYSTKATKQSTGELLKTIGELDEQLEEWKDRIPIDFRPEHEIKASHTPLILHVVMLHFTYYNCLTTIHRMSIHRGYWTSRLSDYAIKGLNSGPVNPRIFSSAALCTAAARASISLLKYIPQGDFSCVWMILYFPVSALVTLFGNILQNPLDARAKSDTKLMALVVSFLSMLGQEAEQGGVHRMLAICAEFERIAKLVIERAEKEQSSRRKRKTTESKPSSITPGSTAITTPRQSSASMTPGTGPGASHASHTKRESSQQLSPHNHGFGSDRAQSHSPMNTAINEPSPSMASVGWPQEFPVPQPGGDYDSFNGMDFTHTGLSGAPGVGGIPSAPFHPGNPLLPQDLFSLPMTLDWSWAEMSGGAYPTVENGNFDPNVHQTNM

SEQ ID NO: 2047 - protein, 938 aa, Unknown
  Kingdom: Fungi, Phylum: Ascomycota
MHQQTRAGPRVSSPASSPQTNPNRTNNPREAALPTRPRAASNVSGRDSVQSPTIEQTPAFPGPPAESVKKLDQIIQNFFVKIAVIVLDSRIKVKAARGANGARKVNKWFQLETDDLDDFKEELRTWKISGSLENRPPPLIIELYLDTSTLKENQSLVIVDDDGKRWDVMEKLNSSGSSADDDIRRISKKNCEVIIERWRVELTPLPNMPTDDFGPLLPTIYKKAIVFFRSLFVTTRLLPAWKFASSGPSRNANPALIPRCRIRTSDSSTSPTDTLRHPIDGRSDPVTEYMFGDLDVPVGRLSTSVTYRNDCSFRIDDSESLLSSRFMGVDENFFKPSLPQRVESTRTAEIGSLRDRPQRPDLTDLQQTYGSLSTFHGEGHIGTSPLSALRSVKAPGSDTDSPPRSIPSHTAPEPPHSLPVSSRTISSRPPMRVGEGSSRRPSVSFQPFKAGSLSQSPGLRMTEQESPSSPHSLTRPGLSALQQPRNRSSLTAGMPASLRGGPPPSTSGGEHAIVGSPRPASTSGSRYSSSFTHRRGRLSFGGASRAGDDEQGSSGRQSLASSVAQPGSGLLAETGGTSSGSFQAEDDNISEFLKALDSKKTLKSFDQPKRGDSATNRTVAQLSKFHNMRESNNALTESMTSSMQLQRSSSSSSRQLTSVPGMAAPASLSASSSPGKPLSPHTPHTPAIPSRLSENSVASYSQGQGRTSAREGRTSGQVPSTSRQSTITQEGTATAIDIPLSPRLGSYQRRSSSVAQQSRNTADDDENELAFARRGTSLDTDTREPPTMTVLHDMHLQLEEDSTVREGRPSSLQPAAEIQADESGRRLHHISSEEAPPEGLMTASPSSSPFGRRRYTGLAGRQQRPTPSHSSRGSFTGSINRTGRDEDSVSEEPLVFDFSEMDAQGRRSIEESHGGSSSGPGGCTRGSYEQRGVTRRGW

SEQ ID NO: 2048 - protein, 778 aa, Unknown
  Kingdom: Fungi, Phylum: Ascomycota
MGPSKKNLKATKKFEKNHLKGVLDKRKAQAKLKQRHQILDKKKARKAKDAEFLKGSDESAARKTNGVVPGKGKNVADMSVDDFFKGGFDDIIEKQPAKLGKRKRVAPKEEAEEEDDEDDDGSESELSATEQPVVSDSDEGDDDEEEDGAMSKKTMEDLAQKDPEFYKFLKENDPDALDFDDDADLAEVDDLSADEEQADQDEEEQPKKKRKKAQAKEEEDEPESNVLTRDIIARWRESMAESYSLRAARQVVLAFRCAARLQEDEQEEEMPRWVINSPEVFNDILMLALKEIPTVMNHHLPVKESTAGRAYVSTESKKFKTLSLLLRSHTTSIMQLLGTLSDEKTLKLTLSSLTPLLPYLLSFKKLVRALAKTVIGFWAQPASTETTRLTAFLVLRRLVNIADRSIREMVLKATYQGLIQGCRITNYNTIQGINLMKNSAAELWGVDPAVGYTTAFTFIRQLAIHLRNSIVHNKNDAFRMVYNWQYTHSLDFWSCVLAEHCSPAKEAEAGKENQLKLLIYPLVQVTLGALRLIPTSIYFPLRFHLIRSLLRISRATGTYIPLASPLLEVLNSAEMRKPPKPSTLKAFDFAVSYKAPKSYLRTRVYQDGVGDQVIELFSEYFLLWSTSIAFPELALPVTIQLKRWLKHSRSRTQGNKNNKFSSQLALLVQKLEANGKFIEEKRARVEFAPRDRTQVAAFLRDFDVAKTPLGAFVVAQRKLRAEKAKLMEEARQDEEKRRKEDEAAEVEGMDEDEDEEEDEELDMGDEMAEDEEDDEDDE

SEQ ID NO: 2049 - protein, 283 aa, Unknown
  Kingdom: Fungi, Phylum: Ascomycota
MANDHILTLSCPDKPGIVHAVTSVFAERQHNVLDLQQFSDPAFKRFFMRVHFGPIEEADTTHLTAPFDELATRYEMKYDLRPVAKKTRVLIMVSKIGHCLNDLLFRMKTGQLRIEVPLIVSNHPEYAALAQSYGIEFRHLPVTKDSKAEQEAQILELIDEHKIELVVLARYMQVLSPKLCSAMSGRIINIHHSFLPSFKGAKPYHQAYERGVKIIGATAHFVTADLDEGPIIEQGVARVDHAVEPKDLVEAGSNVESQVLAQAVKLYAEKKVFLNGVKTVVFH

SEQ ID NO: 2050 - protein, 352 aa, Unknown
  Kingdom: Fungi, Phylum: Ascomycota
MEALPLLDVPPEQTGSSYIIDQLEGERISIPGSKGTFRILASSKQTDGGIAVFSSGAVLSDAPGFHWHAEAHDVFLPTKGFMRLWNGDQCKVLGAGDFAYIPPKVIHNPELIGPHTEQLGLIAPGDWVDFFRYVSETYSGVVVPEHDDRDLKSLLIPKVMAAKDRFDVNFVRDYNPPAESEWDGTENKLPGPLEPYFLRANTGPRWMLGGVMSRPFIHADQCSGKFAISSIESSKVYAKSPFTLKRLRFDKVAHCFCVQEGVFKVRLGEDDAGAWSQVREGQTVLIAAGQAFSIDFGSRYVRAISFTNGTGIEEVIRCAGKPYAGFVLPDQLDPWDESGFTEACEKAGAVVV

SEQ ID NO: 2051 - protein, 447 aa, Unknown
  Kingdom: Fungi, Phylum: Ascomycota
MAGPRKQKLAPSSRPTNTLVVDNGGSTIKAGLVKGTAVPEPSVIPNCIARDRGRKIYVASELNKCRDFGEIQFRRPVEKGFIVNWDAQRAIWDAELIGPSSTLKCDPAETRLILGEPPNSLPALQLNCDQMVFEEYGFSSYFRGISPAFNAYHDVQSLFRTPQDAAIVSNSPAEIILVVDSGFSHTTVTPVLRGQPLQSAIRRVDIGGKMLTSYLTRLLSLRHFDMRNDSYTVNHMKESAGYVSSDFNRDLELSWKGTRGRVNPDWKSGGGIAKDYVLPDFHTRTAGVIREFDPARHVKARQMAAVGYAEEDAVTLRNERFTVPELIFSPSDIGLQQPGLADIIRESLDELPIGLWPGLLANIVVVGGNALLDGFIQRLQKEVVRRFPDDCVVRVARPENPITSSVVGGMHLANHANIENLVVTKKEYEERGASWVAHKFAAGLYGT

SEQ ID NO: 2052 - protein, 449 aa, Unknown
  Kingdom: Fungi, Phylum: Ascomycota
MVMATAAVECYTHHVNNNVLIKKSHLVEPLQNHHHGPIDPKQLIGEALQRRAEAVDHELCEPGDEDTFFVADLGEVYRQHLRWKKNLPRVKPFYAVKCNPDPRVLRLLAELGTGFDCASKGEIEQVLGQGTSPDRIIYAQPCKTNSYVRYVKAAGVKQMTFDNADELYKIAKLFPAAELFLRIMTDDTSSLCRLSMKFGAAMDTTESLLSTAKDLGLNVVGVSFHVGSGASDPLAFYQAVRDAHTVFQQARTYGFTMRTLDVGGGFSGDTFETMASVLDRALDEYFPAGSGVDIIAEPGRFYVSSAFTIACNVIARRTVEDPTLDGKGYMLYVNDGVYGNFSSIMFDHQNPEARILRAGGHSMYDTIGSRPCPSGEGVEYSIWGPTCDGIDRISESTRFDRVLDVGDWLYFEDMGAYTKCSATQFNGFSNSHEVIYVCSEPGAKALLNL

SEQ ID NO: 2053 - protein, 429 aa, Unknown
  Kingdom: Fungi, Phylum: Ascomycota
MTGQDTVPTMLFVSWHRPFVLLFEQTLVQHAKRIAKEYPEMYRYAYLRAAETLRAPYWDWGFDSNVPNATTVDTMVVNMPFGEQLVPTTIPNPLSTYHFPKAALDGRWGAFDIENRSQIYRPYKSWVYDVFTLSRDFSEFASTGDEGLSLEQVHNGVHWDAGCGGQFLAAEFSAFDPLFWLHHCNIDRLWAYWQAIKPRHKIFRRPYKGGSRFSTPSETIITPDSPLKPFREANGRFHTTKSVADIKDLGYSYYGLEYWTKTERQMSKAATQLINRLYGENDSAGAKLMTQGSEGRRYLASIRLNVTQIERPASVNIFVAGEKAGSMVVVAQPSQGIAYGTVPLDDALAAAGIIGTDADSAIDSIQTSITVTITKLSGDSIPLSQIPGLRIDIKDVNVIAGRTRDELPILGMTQRQAAWFPEGRDNSRD

SEQ ID NO: 2054 - protein, 217 aa, Unknown
  Kingdom: Fungi, Phylum: Ascomycota
MFSFLRAAHPPRTNNTANNPIAYDDGRSSVHFAKPGSDYVMTHRIPPTTKEHGTSIVAPPFHYHIHQDEFFQVQSGKGNFYRGVDPKPFAVLSDEAGGQRTASVKAGRYHRFENATEDRDLVVDIHLAPESYEAEQRFFRNFFGYLDDCRAAGQAPSFFQLMVFLHDGDTPLAVPAPWEGLGKVLSRLLLWGASFWGRFILGYKTTYPEYYEEGKSR

SEQ ID NO: 2055 - protein, 734 aa, Unknown
  Kingdom: Fungi, Phylum: Ascomycota
MGLSTAFTVGILALRLFASPVSAIPAESPAPVVAASNQVKAVASDWWFANIERNGAVPFGSGGAGYKVFRNVADYGATGDGSTDDTEAINAAITDGGNRCGLGCDSSTTTPALVYFPPGTYVVSAPIIPYYYTHMVGDLHDLPVLKAAPSFQGMAVIDANPYNEGTNWFTNQNNFFRQIRNFRIDLRDVPKTTGTGIHWQVAQATSLQNIIFDMVEDSSEDNKQQGIFMENGSGGYLIDLVFNGGNYGAFFGSQQFTAKNLVFNNCKTGIYQIWNWVWAYHNLTFNGCNVGIDLTSGESQQTVGSITLQDSTFANTAVGIASHYSPEQGPWTNGTVILDNVDMSGARIAIQNPGSGRTILEGGSLVNSFVQGREYTGSRGEAVQGIRDSIQKPEALLDSQGRMVSKEKPQYPDVPASKFVSVKAAGAKGDGVTDDTAAIQAVFDKVAADEIVYFDHGAYMLTDTVNIPSSVRIPGAILMEWNVAGETKGSAGLFDVHFRVGGSAGTELQSDKCSKTPEQTTPADPQCIGAFMLMHVTADASIIMENDWLWVSDHELDRSDFNQINIYNGRGILIESTKGAWLWGTAAEHNTLYNYQIDKADNVFMSCIQTETAYYQGNPNALVPFAPQEKWNDPTFADCSAENCARTWGMRVLDSRNVLLYGGGLYSFFNNYNQDCLDTEDCQQNMVEVNNSQATLLALATKASVNMLNVDGKVVALHADNDNNFCATLAFFQS

SEQ ID NO: 2056 - protein, 432 aa, Unknown
  Kingdom: Fungi, Phylum: Ascomycota
MSYFNNNHYVSLTSLPTEILLDIFQSLDLQSISELSLACKQLHDVFTRRKSTILLPVLIRDFSPLNELLQVYTASADDITIGQRTYVPQKIIFKRDVGDSGVVLASGGGDKVSSNFTRVAKGGRAGQQVRPEPTTTVLTEKDLESILKHCQLVRSWEGLFPQMRWFHEPENCRMLRPHECHRFRRAFYRWWLYSIHFHGDAPRPRVGLPADFVEDVRTSQLRYHSTSELLELMDLMVAVKDVVFHYICPRLDPTQGDSLEQSPLMAEMDRSEVILRTWMDQSQWGRIVKTYSKLGPKELMHYFDNICSYPRKRLIADVHVHLPNFTADQESILGAIWVVLNERMSMRDMPSLAEHSCGGVVDFEDERDLERLAFGADGSPDGGLPSGKSYRRETSQWSPRGDDGRYLEDHCQQRQYGSGRMVPLSHWEMVRQ

SEQ ID NO: 2057 - protein, 466 aa, Unknown
  Kingdom: Fungi, Phylum: Ascomycota
MASESSPRDVLPVDATTPLLSDAERRDSIAEEHAPRNSSSNVSPRITRRLYVSHFLSTWNSRVFEFGAVLYLATIFPGTLLPMSVYALVRGISAIVFAPAVGQYIDSQNRLKVVRASIVYQRVAVAISCLAFVSFMLDEKLGEKWKPGMLAMVSLLACVEKLCSIMNLVSVEKDWVVVVAGDDQEALKILNAQMRRIDLMCKLFGPLFIALIDGFSTKIAILVNLGMNLASVVIEYFAIAQVYHDVPGLRSTKRNAGRRAVDSDRPWYRNIRTRARELARTTIADHGFFFHHTAFQASMAGALLYLTVLSFNGQMVTYLLTAGYTSTQVGVARTVSVGFEVLATWAAPWLMGRIGPVRSGLWMSCWQVTALGLGVTVFWKFEDSWAVVGATGLVIGTILSRLGLFGFDLCVQVIVQEEVEPENRGAFSSVEAAWQNAFELLCLRERVVLELRPVKKGTPVASGSAK

SEQ ID NO: 2058 - protein, 87 aa, Unknown
  Kingdom: Fungi, Phylum: Ascomycota
MSFFRITLLRSAIGLPERTRGVLAALGLRRRTQTVFHPVEPQFAGMILKVKELVRVEEVPVALSKREVKAARTPEKGFYLEKAVPRM

SEQ ID NO: 2059 - protein, 545 aa, Unknown
  Kingdom: Fungi, Phylum: Ascomycota
MAEYKLKDVTSLHLGPGVKREVEVEGIEGGKVLLLNAGGKVQAVGAKCTHYGAPLVKGILTTNGRLTCPWHGACFNAKTGDVEDAPALDSLPIFKAVERDGAVYITGDESAIKSSKRKPNFRCNASGGAQKEKVVIIGGGSGTIGVVEGLRENGFDGPLTIISKEGYLPIDRPKLSKALMTDADKLALRDKAWFESGAVEWVDGEVNAVDFADKSVTTSNGDKFVYTKLVLATGGTPRNLPLQGFKVLGNIFTLRSVHDTKKIVEAIGDKGKKIVVVGSSFIGMEVAAATSADNDVTVIGMEKVPLERVLGEQVGGGIQKILEGKGVKFHMNAGVDKAEPSGSDPSKVGAVYLKDGTKLEADLVILGVGVSPATEFLRDNKIIRLEDDGSLKTDENFSVTGVRDVYAIGDIATFPYHGPGGEGRTTRIEHWNVAQNAGRTVARHITNPTATPEKQFIPVFWSALGSQLRYTGNTVGGWDDVVVQGNPAEAKFIAYYTKGETVLAMASMGWDPAMSQSMELMRLGKMPGKSQFQDGLDVTTLGPPE

SEQ ID NO: 2060 - protein, 442 aa, Unknown
  Kingdom: Fungi, Phylum: Ascomycota
MSTVLVDWALQNGATLHPSIEVYDDVTTGLSFRVKPSAVDGLVATSGASRDERADAGPIVSIPTSLSLSYLNALDSLPSEFLNAVKPHVVGRFFLIQQFLLGKDSFWYPYIQALPQPADQEAWELPPFWPDDDAELLDGTNVEVGIQKIRRDVQSEFKDAQHALSRIDHPLANVRLNLYQWAYCIFSSRSFRPSLVLSDAALPERVAIDDFSVLLPLFDIGNHDMTAPARWVREGQICSLHVDQAYRPGEQVFNNYSMKSNAELLLGYGFMIPATEDLHNDYTHVRKRTDTAEASEEYFISLRPMRHPSSLLGRSKQSFSSPTVLSSFHHVQPDMVWDIFCTVAASAPNGSIPETNITPQDVLSGQVPEAYRVFLQQTIAIIQHKVLQELERLDETDVEVDEEQKADLTKNQRLALNYREQCRRVLENTLESIAGDETMESS

SEQ ID NO: 2061 - protein, 1288 aa, Unknown
  Kingdom: Fungi, Phylum: Ascomycota
MQPDISISIDRGGTFCDVIALVQGKEPIIFKLLSEDPANYADAPTEAIRRVLELVEGRPIPKGEKLDGSRIMSCRVGTTVATNALLTGNGERFALATTEGFKDVCVIGDSARPKLFDLNIRLPEPLHAQVIEIEERVTIEDYDLNPSPTVFDDTSFSDPTLLRTESGEVIRILKRPDPIRVKEQLEQLRTQGYSSLAISFMHAYVYPEHEKLVAELAREVGFEHVTTSSETSPSIKFLNRSNSTCSEAYLYPVIKRYVSGFESGFSVLPQRVEFMGSDGGLRTSQKFRGNEALVSGPAGGVVGIAKSCFDEEDATPLIGFDMGGTSTDISRYDGRYDYLTHTKIAGRTINVPMLNISTVAAGGGSILFARNGLLVVGPESAGAHPGPACYRKGGPLTVTDANLFLGRLVLSSFPCIFGEAADEPLDTEIVSKKFKEITDDFNAQTSQRLTPEEVAYGFLDIANETMSRPIRNTTEARGFAPEKHNLVSFGGAGGQHACAIATKLGIRRVMIHRWSSLLSAYGISHADLQKEVTLPLAARLHGDLIPEIDRRLASLRSAVESDLTSQGAAPGSVTLEESLVLKYFGTDTSLTISKPCDGNYEAAFTREHLREFAFSMPRAIIVEAVKVRGTGSSGAREAERSAWQEKASIQDFHTPEPSSSQKVFVSGQWADAAVFPLDKLSIGSVVRGPALVIDETQTILVEAEFDAYVLSNHVILERNSSSEDASRNSPNPGTATNGSLNPIQLSVFAHRFMSIAEQMGNTLQRTSISPSIKERLDFSCAMFSPEGKLVANAPHIPIHLGSMQFAIQAQHKHWAGRLKDGDVLMTNHPQWGGTHLPDITVVTPVFVDGRIAFYVASRGHHTDIGGKGITSMMPESRALWEEGVNVKSMKIVSEGEFLEDEVRAAFEKAGSYPGCSVSRRLPDNMSDLKAQTSANQRGTLLLRRLCEEYSLEEVHRYMDGIQKNAEDAVREVFREIARTHPQPLRATDYFDDGTPIAVTITIDPQTGSAIYDFSGTGPQTWGNYNCPISITHSAIIYTVRCLVDSDIPLNEGCLSPMEIRVPPGSILNPTPAVAICGSTLASQRVVDTILRAFGKYGASQGCASSFGWGMGGKDAEGKILPGWNYGESLGGGSGAGHGFHGADAVCVHSTNTRATDPEVVEKLTAVLVQRHEIRHGSGGEGLWKGGNGIRREIQARVPLKFSILSDRRVYRPYGMRGGGPGAKGYNVAYKFNEEQVLEPVNLGGKAVINLEPGEYIQINTPGGGAFGRTEEGVEGSQEESDEFHRAFV

SEQ ID NO: 2062 - protein, 570 aa, Unknown
  Kingdom: Fungi, Phylum: Ascomycota
MSQSKPASLVDTFVPIRIRRPDSTMTNKSVTSAIPASMDPSNAGYPSSVEEIRRKEYPNLQQEVYLDHSGTTIYARSLIEGFSQAMISNLWGNPHSENLAAKLSGDMVDKTRRRALDFFGADPERFDLVFVANATAGVKLVAETFRDLGEKTTKKSFWYGYHSEVHSSILGVREITEGRYHCFSSDEEVERFLDDTKQCTIRGPEDSELGLFAYPGQSNLSGRRLSKTWPRRIRKNPALRNTYSLFDAAALAMTCPLDSLFADPDAAPDFTCLSLYKIFGFPDLGALIVRRDSGHILNLRKYFGGGTIAQVFPLNGYSHTVKKGPGLGDPHGLWSIHDAVEDGTLPLHSILALSLAIDTHLRLYGSMAAVSRHCTNLAVLLYRKLAEIRYPDGSLVVELYTDPVTGYEDPSVQGATFAFNVLRQDRSYVSWLEVERAANSAGVFIRAGGVCCPGGVLKALRYEEWEWSRMFSSGHACGFGETAIINRRPTGIVRASIGAMSTEGDINALVRFLHGTFVQTSGRTSLQDKSGHSTDEVGRQPSRAATLGGIPGIDARLNCTDSLLAPAAGS

SEQ ID NO: 2063 - protein, 111 aa, Unknown
  Kingdom: Fungi, Phylum: Ascomycota
MPSVKNPNGPSKNRLAARASKSKAKRQQRESFARNKISKPDVARGARPGLLPNSGPNAKLSSKKQRKLEKKMGYALKRKMEREGEVLMQDAAEAAPDGEKKTEEVDMDDVQ

SEQ ID NO: 2064 - protein, 650 aa, Unknown
  Kingdom: Fungi, Phylum: Ascomycota
MVPFTAMNAVHPGSADAPPALLPASAPTPASPRAIAPAPAIHHSPSLSPTSAVGIPHGVRGDHAAQSQHQQQNDSHYVHHPPPQSPASSNHGHALHHSPHQQHRQHHHQLLQSTAAAAAASSLSAHPGSPPLRQDTSSSVSTQATAATQASAETSNTSYSADTSPNLHQSIFSLKDGCDVSYSNIRRTSRRRTGPLSQASRERAALIRKLGACNECRKRRVACHPGHHNMTWEELQGKFRKSMSPPVAQELARPFAPSHSLGQTNGMPQPYFTHDAQEMDIDSNPSDEPQQPQQQQQQQQQQQQHVGLPSLSDARNRTPLPGGRLEKSLSLPGIESLKNDLQSNVSRMLSTGARTRYQSVEALLIFWEHDDDFSTVNGAVKELADVFDQFYHYTFKTLLIPSPSESCKSSGRWLSRKLNDFVEDRDQRDVLKIVFYAGHSYLDGNRDMTLASSKDTDKASTIRWSAIQQILEEACSDVLILMDAAYYPSSKMVRNRGVLELIAASVSEEHHDVLDRCSYTRALAGLLRTRATRLSPLSAAELHAALLAAYPKLVQERHPEKETITSFPAPLHIMMSGNPRLPSIFLAPVYQGSPLRNSSLGGYDNNPQLHLSIRLNDDNVDVETWNEWLRLMPEGIKDVRVEGPFRPTYR

SEQ ID NO: 2065 - protein, 490 aa, Unknown
  Kingdom: Fungi, Phylum: Ascomycota
MTSSTVYVASGAVTLVWLVYSVLEPLVLSPLAKIPGPKLFALTRWRLAYEDWKGTRTQKIDDLHRQYGTAVRIGPNEVSFNSQSALRTIYGPGSRYGRTGFYRMFDVYGRQNLFTFHSSVAHGRRKKLLSFAYSKTNILNETVAGMVEGKVDKFMKLIDTEPDHISDVFSTLHYYSLDNITAFLYGKYGSTSAMEGTQAHRALIGDILDPARRTLSWLVRATGIRAFALEAYNRFRQDMEDGKFDGNEGSILARLWKHSQEQTSDRLDDLDIASECADHFLAGIDTTSDTLMFLVWALSQPGSVGFQEKLRQEVLSIPDESLTQTGTPRAAESDKCTYLHAVIKETLRLYAPLPSSEPRSLEVDSEIDGFLIPADTVVGMSPFSLHRNPDVFHHPLDFNPDRWLGPDAKELNRWFWAFSSGGRMCIGMHLAMAEMTTLTAAIYRKYQTVVAPGFEDTTPGITARVEVFYDPRFPKMVVNIAPSELGLCRY

SEQ ID NO: 2066 - protein, 373 aa, Unknown
  Kingdom: Fungi, Phylum: Ascomycota
MQKLAKRAAQAQRQAVRRAARIADENRRTEQNRARRYLKEANAEIRTNLHDARRARKEDWELGPLAPKRDLGFNGYGEVSTSRRDWSQNGQYKINPELAVKRCAWAGGVKQFCLAPGDRVVIVDGQEKGKIDRVKSVHPEDGFVLLEKLNRALETPPFPNMPLMSNPYPLAADAVRLVYPLKHPETGVIRDVIVNELKPIAPNMASRHMTLERWEHGNKWDRVALGVNVVIPWPEVEAPEYKTYDVDTARDLVEDRTFYYNLTTAPLPNGVIDELRGPYSRFRTRHEAWYIEKKEAEEAARKGLHRMHESMRTPLEELHAKRRARNLAEGEPELSETMLEKIGQIMARNKAEALERAGMQEANSTTQPPSSAA

SEQ ID NO: 2067 - protein, 116 aa, Unknown
  Kingdom: Fungi, Phylum: Ascomycota
MAPQRVTYRRRNPYNTRSNRTRVVKTPGGELRLLHIKKRGTVPKCGDCGSKLSGVPALRPREYSQISKPKKTVQRAYGGSRCGNCVRDRIVRAFLIEEQKIVKKVLKEQESSQKKK

SEQ ID NO: 2068 - protein, 1183 aa, Unknown
  Kingdom: Fungi, Phylum: Ascomycota
  misc_feature (764)..(768): Xaa can be any naturally occurring amino acid
MNIDEHIAPSGGQHYSGRNRVPNIQEFMEQLDKEKKDRDAEIDQQLKQNKAYGEVQDHHNDRQRRKAKHRTVRDPVTGKDVEIRDTQLSYEEAVENPQLSIPNENLGKPTTAKVDSHMSGEEYRRNQDILAPPDPVQEGATSDVPIRSEKTSVLFYKTPSVSYEPMFAILEQRANILCAGIFFAIIFVGKSFGGRLLGLVPLAICIASGVFLWAKDLIRQGRDMEWASEQERGETATVNLIPESVEWLNTALGIVWGLINPEMFAGVADTLEDVMAASVPGIIEHVRVADISQGNNPIRILNMRALPDSHVQDIKDEIHKENEKNTDPNELAAIEQAGQFYNLEVSIAYHAKPSGGDIASKARNMGMQLVFYLGIKGLFGVPLPVWVELIGLVATARVRVQLTPDPPFLKTVTFTLMGLPKVQAGCTPMIEKGVNILNLPLISNFVNWAIGAAASMYVAPKSMTLDMSKMLQGDDIKKETLALGVMFVRIHKATGLSKQDTRGSKGGGSDPYITISWSKFSKPQFCTRVIQDDLNPLFEECAGLLVTSDLIKADEQLSMELWDSDRSSADDVVGKVELSIQKLIQHPGKMFPQVSKLQGVKAESTMPGELHWEVGFFGKTQFRKALRTDGRDINLPKELADKPEFQDEKGAIDSKEEDAVIHTPPDPLWPSGILSVVVHQIVGLELANIKGTSGSRKGKEFEPGRPEAGEVKEEQSKNLPSSYCTILLNDDLIYKTRTKVVSSQPIFNAGTEKFIRDWRSAIVXXXXXPLKISDILQTSSEATRWYPLDGGVGFGRIRISLLFRSVDLKLPPPQLGWDIGTFEFLDSQILTSGYAPSNHVKLRLRTGGSSASIKKNASTKEEHGMRFDISGNDGHEKIRLPVRHRYSSPVFFEFWPSGKRHADAYASVWLHELVDGEEREFDLPIWKCDNSTRLSQNYITEKNYREIPDMDIQEVGRVKFKGRFSPGTDSDHIKFVSDNDSRETIEAWEACFAEGVREEEVATEVPPIIQKLHDESLTHGRDVLAQASEKDKQKWLAKDGTDWSGAFGEDPTSLMSGHAADENSEEYDDFDSDDEEPDLGIQDARTRSSHSGDSQSPEPRGSEDTTGTTGTMESTESGSKNPYKQYKNYKERSRDLHRRHRGLMQWRPLRNAQFAKDEAKYAMRKVTNLGALNGRKPDVETEV

SEQ ID NO: 2069 - protein, 403 aa, Unknown
  Kingdom: Fungi, Phylum: Ascomycota
MAAPASVRVSGPPNSSFLVGYPGISATLPRIEGKVEIRPGAGYSMPVPISLVRICLQRRETIHPDADNLAKRHLGTPRRDTTDVVGKEVLLFRCSTGKDAESVVAMDLPFVLFIPFGRGGEETNRRIPPASLQLPSRTAETYYELVVTVQQGHSNQFRYSFPMPLQRYDTLSTFGMYNKPETKLVTADNVVSLGINLPRWSYGPNDPITVYIKLAPNPDWVSKAKRVTIDKITLQIEEEITFNPEGDEPTKKINKLSKQVQTVKTKMPEAGYATNIGLVFPSKDLRDPDGIIKRGKPAFPLYEVTSFTTTSTLYKIDFYLNIKVQLSGARDVSLRQPIVICPLDQQGCKEEMDAIEQAAKDASHVDPNNPMLPAHSIVLASDRDSLRALGLCMVGGQKKPYIE

SEQ ID NO: 2070 - protein, 942 aa, Unknown
  Kingdom: Fungi, Phylum: Ascomycota
MLLTHCGCFIWREASPVFLPQVAVTTHAKLAASTSRTVLKQEFVNPNKILGIEEVNYAFPLYDGVSVVGFTCKIADRSIKGVVKEREEAKREYDQARGNDQFAGLLQRSQKAADVFMTSLGNVPAGATVSVEITYLGELKHDAEVDGLRYTIPSIIAPRYGPAESFEGSDNVSATGMSITVDAEMPSVIKSVQSPSHAVSVNIGTTSTEPENEPSFKRASASLSLQSVRLEKDFVLQIVAADLSQPVAMMETHSRIANQRALMATLVPKFGLPPIKPEIVFICDRSSSMQDRISDLKSALRIFLKSLPSGTKFNICSFGSSFSFLWNKSSSYTEKSLNEALEHIDTFAADFGGTEIYEPVKETFARRFKDIELEAILLTDGEIWDQDNLFELIKTEVASSSGAIRVFTLGVGSDASSSLIEGAARVGNGAAQTILEGEKMDKKVIRTLKASLSPHVTDYTLEIKYEKDDDDDFELVEKVMANVSVDTDSVMKEAPDQPTSSTQSTKTTTSLYDPSYEDDTSVPAPPSAKNKYADLPAVPSPPYLQAPYKIPQLFAFNRTTVYVLMSESASSRQAKSVILRGTSKEGPLELEIEIQHLDKPGETIHQLAARKAVQDLENNDGWLAAARTSTGELIKDAKASQFSDLVEREAVRIGTKYQVGGKWCSFVAVEENNSDAQAKSNLGEFQVIHEEFHSPPSPSHSVGISFGRRGRFRSLAPMARRITPGSDVRFQKASRPSKSFAMSAQVGPSAPSLPAAPPPAPISASSAAAPGSSVVYGSAGVRKSRRSQPSTDHSMSLEAEVEEDDDDDNSDSEDMPMHVVKKKKKVNARDTGHSPTEVLPRLVALQSFDGNWSWSPELEKMIGGEQHKLQGLEWPGCTDDGAKDKVSATVCVILFFRKRLLADKETWEMVVEKALEYLKATTGQTIEDLEKIASQGYQVPDS

SEQ ID NO: 2071 - protein, 711 aa, Unknown
  Kingdom: Fungi, Phylum: Ascomycota
MPSRGEVDLDPYDNSPSRPVSASDHPVPPQTSSLVPGRTDSAPQITPLPATSLPAASPAPTTATPANIESSTAAGDQSPLSALTGAATLDADAEVGPSTNLRSSPSKRRRKNNTDMPAGEGVNLTSILESNGTTGSQANGADSAGQRTGVGGVTNGRHKDGAVTNGSSNGEKRLSGQNRLDGSYHGHNREEVTRLLIQALSDMGYQSAAESVSRDSGFSLESPTVAAFRSAVLSGSWGDAEQLLQGASASEADGEDGNGLVLASGSDRTAMRLWLRQQKFLELLESRETSRALAVLRAEITPICNDQTKISLLSGLVMCSSTADLMMKADWDGAEGSSRQLLLSELSKCISPSVMLPENRLATLLQQVKQSQVDTCMYHTAPLSPSLYADHMCDRRNFPTEVALELPELAGEVWQIQFSPDGKKLAACGSPDQVIIWSTDTFAVVQTLDHHDGGVGNIAWSPDGTMLVTCSQDKYARLWNANAGTLIKKLRRFDEPVSGCVWASDSRSLVIGTLDRSQSLCTFTLNDDEVQNWGKKHRVQDLCGSRNGRYLVAVDDQHTIHVYNAVTKELEYDMELKARPTSVSISHDSKHLLVNKRDGEAQLIDIATREPLKKFLGHTGGDFVIRSAFGGANESFVISGSEDGNILIWHKNIGACVERLSGHIPRTNAVAWNPSDACMLASCGDDEHVKIPQHPVVAAAVPQFPGISRLL

SEQ ID NO: 2072 - protein, 349 aa, Unknown
  Kingdom: Fungi, Phylum: Ascomycota
MDSVTVRSRLERRPPSRLPLELLIQIIECVPPNRQAILPVGSVATKTLVSLTRVSRSIYRPATTVLRQQCMHVDTSRRLADVLLCMDRLVPSLSPGLSLRHVTALYLAPFGASLDDQPTARWVREMLCEVSETLLRLTISMPFSSLEPWDDHLNVRRTLREGLEQLHALEEFACIGDYPTLSVSTPAGEATGTTTTDVWRLWPRLRRLMLFGVPLESHWLWWDIATLESLTHVVLVRPRQTERTVDLKDRYFRTLPAGDKRLQKKLRVVLMHRVRGDEDAGGEDGRWLPQGHPDYLRLDESSWEKLDADGRMEVTCYGVPRMGVMSSEELLVRLAKSWVETGTLWDARA

SEQ ID NO: 2073 - protein, 466 aa, Unknown
  Kingdom: Fungi, Phylum: Ascomycota
MSLYSITSMMKLAIASVWFAASAVAKCLSGKAIVNLDITTGPAEQLGSGFLYGIPNNGTSASNAIPDHFFTDIKFHGTRAGGSQLTDGGWSSGGKRAYDQRFNSTLSTYRSARKHGGHFILIANDLWGADGGQDGALYPGDNGDWTETEAFLDQLIFDMRVNNLIEDVTIDIWNEPDYPMFWDRSWGQYLDYWNHAYNYLRKNIPEVKLGGPAAAYAPDLNREKWHSFLANIAANDTIPDQYSWHHIGDDSNWPDRSASQFRRLREQYSLPERPISVDEYAWPWRQDPANTAWYLSQMERNDIVAMRANWGSKEDLHDRMADLLGKTEDGNYYPNGEWWMYKYYAEMDGERAETRVSEDVNFDVFATIGDGIVKVLAGTRTYELDPEVGDYVLEVNGLDSALGLDPFGTISVTTYRFDYVERSARRDLPRTSELRTTIFLMARSAFFTILRTTRRLMHSSLTSKAG

SEQ ID NO: 2074 - protein, 463 aa, Unknown
  Kingdom: Fungi, Phylum: Ascomycota
MKLQYLHALIGLAGQALAENDFVIRRRGTEFNISPRHDPAMRDSNKVLGNALAERQDGSCGNGKGSCPLGQCCSEAGNCGTSKDFCKGPQCQIQYSNGQCDASKKPSGSSTASVARNNAGTVAYDKYIVACTEPGTVALTFDDGPYKYTEHVLDLLDEYEIKATFFITGNNLGKSPIDDETTPWPGVLRRMHNAGHQLASHSWTHQDLSAATQEIREQQIIYNEMAFRNIFGWFPKYLRPPYGTCSRDSGCLAYVTKLGYHVVNFNIDTKDFENNTPETIQTSKNTFKNGLADTSKGYIELSHDIQQQTAYNLTEFMIKTLQEKGFRPVTVAECLGDTKENCLIYEAVTSRQGDTSEILVPSQRAIDPRPTEEILNAVMSRDGTCGWRGEIKSLCEGFKYGDCCSYIAPATVMVAALQTLASATSARQEIPLIIPDSGLCGGEKLGQDCIGLRFGSVCSNHGF

SEQ ID NO: 2075 - protein, 299 aa, Unknown
  Kingdom: Fungi, Phylum: Ascomycota
MASDDEHRPARRRRHDDDEGRERRDDRSDRKDRHRSHRDHDRHERRRSRTPDAGRDRRRRSRDRDSARDRDGDRERHRRRRRSRDGDDDSSRRRRHRDDAPDDEPRTTRRSPLRRGAPLPSQEASFAVTTGEEPEKPKEKPNLGNTGLLAAASNAVAQADGSSITLKYHEPPEARKPPARDQWRLFVFKDGAIVDTIELSLRSCWLIGREVAVVDLPAEHPSVSKQHAVLQFRYTERRNEFGDKIGRVKPYLIDLESANGTILNDKKIGGSRYLELRDKDMIKFGDSTREYVLMLAPRD

SEQ ID NO: 2076 - protein, 932 aa, Unknown
  Kingdom: Fungi, Phylum: Ascomycota
MTGRRDFLSQPAPENYVAGLGRGATGFTTRSDLGPAKEGPSEDQMKEMLAKRAAQLGLDGKDKDKAKEDDGADDERYQDPDNEVGLFAGGVYDKDDEEADKIWEWVDERMDRRKRQREAREQAEREEYERNNPKIQQQFTDLKRALATVSDDDWANLPEVGDLTGKNRRSKQALRQRFYAVPDSVLAAARDAGEMSTTVTDDGAPGSASTGAGDGADGTMTNFAKIGAARDKVLKSRLEAASQTAGGESTIGGSSTSIDPQGYITSLNKMQMTEGQAQVGDINRVRELLQSVVKTNPNNALGWIAAARLEELAGKIVSARKTIDQGCMRCPKSEDAWLENIRLNHESPNAKVIARRAIEANGRSVRLWVEAMRLETLPSNKKRVIRQALDHIPESEALWKEAVNLEEDPADARLMLAKATELIPLSVDLWLALARLETPENAQKVLNKARKACPTSHEIWIAAARLQEQLGQAQKVNVMKRAVQVLVKESAMPKREEWITEAEKCEEDGAIVTCENIIRETLGWGLDEDDDRKDTWQEDARGSINRGRYETARAIYAYALRVFVNSKTLWTAAADLERNHGTRETLWQVLEKAVEACPRSEELWMTLAKEKWQAKDVDGARLVLKRAFNHNPNNEDIWLSAVKLESENDNEAQARQLLEVARDKAPTDRVWMKSVVFERVLGNTETALDLCLQALQLFPASPKLWMLKGQIYEDLGKVPQARDAYATGVKAVPKSVPLWLLYARLEEQAGLTVKARSVLDRARLAVPKNAELWCESVRLERRAGNLPQAKSLMAKAQQEVPKSGLLWSEQIWHLEPRTQRKPRSLEAIKKVDSDAELFVAVARIFWGDRKLDKAQSWFEKALVLDSDRGDSWAWYFKFLEQHGTAEKRGEVVSKCVASEPKHGEIWQMIAKKPANARKSVEEVLKLVAAELE

SEQ ID NO: 2077 - protein, 365 aa, Unknown
  Kingdom: Fungi, Phylum: Ascomycota
MGSKDAQTWLEKLEEQLNVDVDWMDPEYIKNMPIKPHDQTSNQLWVDIELGSPSNADLLAQTARELKDKGWLAIYTRMAVLMCKKNIDLIQGRVLLQTLPSKAYDTQATLDHARLYDAEFARAGIGRDRYCIKIPSTGAALNAAKVLSAEGIPTLGTALFSLPQAIACSQAGMLYISPYFNETRAHDDLSLWPNVEDPATQHPMSARVFQILETYRRLYKETGREQPLLKNASFISAKEAMAAGELGCHSATISHTVLNELAKLKYDGSKQPGEGVPKPVHVYRDAGPTPERLRKLAQIDPLAAAAWDGKLASTDIDYLANGGAELTKAIEADPISKERLAIALELFTGGENRSKDKVEKALAAL

SEQ ID NO: 2078 - protein, 267 aa, Unknown
  Kingdom: Fungi, Phylum: Ascomycota
MAAIETTVVAGAEVALVAEATNHLVQIVVERLTKNINEDHLYEIFGEYGQIKDLDLPINRTSGTNRGTAYILFHREADAEDAIAHMHEAQLDGATINVSIVLPKRKLSPPPPQARRGANIDPRQPFNGGTLQAAVKASAQADSDLPRARFPDPHPQGQQAHAEAATDTEADQRDHSRLARAQDLLPVALLRESEVQALITMVHDDRFHVAEARVAITDDPMRVRSTIQAQPGTDGMFEGNPALNCSYGTHGSYSQSGIYNILKGPLI

SEQ ID NO: 2079 - protein, 370 aa, Unknown
  Kingdom: Fungi, Phylum: Ascomycota
MDYPSRPMSLEERQRRILEKGLKRRPQRDDSYHHDDSASGEDPLAATGPLSLPHAHHQQRQRTPTHSRVLETSRSPSVTPLMRSPVHKTPQRSLAVVLTPAPIKNRDDFVALRTDEPVLARKAADDSSQSQPRPCPAAAATPSSAPGQQKRRGRPRGWKPGMAYTELRPRVANSSGNPSGNTTGQKRRGRPPKPTSPPPKELYRQASAEFFAFLCEWRGCRAELHNLATLRRHVHVVHGEEGSRHGCQWGGCQSGTAATTGTAGRSFRKHIEEQHLIPVAWHVGDGPRHQGDGITPLVPRRASDGGREIPRWLMDEHGQQVTEGIWDQQVEDKATWRRNRMKLRELLIRRDENLHSEDEEAVEIEEAGGD

SEQ ID NO: 2080 - protein, 434 aa, Unknown
  Kingdom: Fungi, Phylum: Ascomycota
MTTRYRVEYALKTHRRDQFIEWIKGLLAVPFVLYSQPNGVFGDGITKMAEDAHRRYAEIMRDVEAMIEDHIARQNHDEVFPSKLRMLVPTAGPFFTRLPLEAAFKYQDRKRNISSRRYVAPSFNDVRLILNSAQVMAVTNGALQLATFDGDVTLYDDGQSLEPSSPVVPRLLDLLKKGIKIGIVTAAGYTTADRYYERLHGLLDAIAASTELDPSQKQNLVIMGGEANYLFEFSLSAPHLLSHVPRERWLTPEMTHWHEEDIAALLDVAEGALKDCVRTMNLPATIVRKDRAVGIIPSDPDIRIARESLEETVLVVQRILELSSLGIPASSSRTSSSTIARPRIPFCAFNGGRDVFVDIGDKSWGVTVCQQWFSSTGGTRIGGENTLHVGDQFLSAGSNDFKARSVGTTAWIASPAETVELLDELADLMQKRLS

SEQ ID NO: 2081 - protein, 173 aa, Unknown
  Kingdom: Fungi, Phylum: Ascomycota
MSEAPPPAVQSRSSADGGVQTPLSRNIRQLGLFFTGAAFMAASVFVTRRSVVRRQIESFPKFYVSNRSPPRFDSSDRSLLAVQAFGLATLNVMSFGVLLTGGISWGWDLCSMRELRERSQAALRRPGRQGVDPEEEKALKEMMDGLLAKMGMQIPDEGSEGGEKKPEDNKDQS

SEQ ID NO: 2082 - protein, 603 aa, Unknown
  Kingdom: Fungi, Phylum: Ascomycota
MDRTGDVHAVQDVKDEVLSHVEDTGNDYARNINAKIWNPLMGISKDNLRSQVNAFCGEYGFTDKQDIFFRGALAAQNPHPDTIASIPEFTDDDRYWLQREITHRWHLPKALYFTVALCSLGSAIQGWDNTGANGANLSFPQEFGIEHNGWLIGVINSGPTLFGLLSAWAADPVNNLLGRRGTVFVTGLFCIFPVLAQAFTQNWQGLLICRLFMGLGMGIKISTIPVFSAEVAPASIRGGLVTSFQMWVSFGMFVGYCFNLAFFRVGRLAWRFQLAAAFAPAIPVCIFVWFCPESPRWLMKKGRYPESFKAFCRLRNTEMQAARDLYYAHCQVMEERDAFAGVSFFHRAWELFTVPRLRRAVVASSWIVISQQFSGINIMAFYSSTIFAEAGYSTLNCLLASMGFGIVLFVFAFPAVYTMDTFGRRNLLLVTFPNMAWCLLAAGLCFLMPESSGARIPLIAFFIYLFTAFYGPGIGPLPSIYFSEAFPLSHRELGAGFTICVNNAVGSALGLTFPSLLANLGATGAFGLYAGLNMLAFFVIFFIIPETMKRTLEELDYIFGVPTRRHISYQVGTWLPWFIKRYVFFQHGAKLEPLYKLDGSGAQ

SEQ ID NO: 2083 - protein, 438 aa, Unknown
  Kingdom: Fungi, Phylum: Ascomycota
MSGFSGLMKNGWHPEKNSSSSSSGGGGGGGSSGSGKSITGLGIRNKTNAMIPGNKAKQEAESRANHVSAPLSSLKDPSTFAPPPKRTGSGLIPAPPPASVPRKVITAPSKYQDPRSPTPVAPPPKISSVQELEQLEQAAPPPRTGPYRPNTTGLSTDHLPKPPARRDSPTSPTVPPSYEAATSAPRPVPSLPPRLPARTNTGGSIASTNSNNNTNSTLNQSAANRLGAACISVPSLGINRSSPANNSSPSPPPPPRAGVGAAQVNALQNRFAKLGTSTTGSNNTPSTETSPAAVPAEGTTWQQKQAALQTASAFRKDPSSVSLSDGRAAVSTVNNFRQRHGEQVATGLQSANNLNQKYGVTDKVGGFAAQSQAQGGGEQQQTPSSGLGGMVAGFAAKKKPPPPPPKKKPGLGVLPQQTGVSGGGDAPPPIPTATRPQF

SEQ ID NO: 2084 - protein, 120 aa, Unknown
  Kingdom: Fungi, Phylum: Ascomycota
MPFKTVELLNVIDGENRQEATMATLGGYLNKKVLIVTADSRILVGTLAAADNSTNLVLNGAVERLIRTPDDDEPSSEVPLGLYLVRGDNVCSVGLVDEKLDESINWTEVKGSTIGGIKHV

SEQ ID NO: 2085 - protein, 524 aa, Unknown
  Kingdom: Fungi, Phylum: Ascomycota
MSRYDSILNLQTMRPVTRRSWMRESSTSRRRLSIQSRSYDDALQRLSLIASNRRITSLFESAEPAGTPSPPSNLNAQAIPEMITSLRQAGYTPQDLASMRHIHVAGTKGKGSICAFATSLLLRHHHKSGLAGSGVGTYTSPHLISPRERIAVDGEPVDKDVFAESVFEIWDRFTEAGMTEMGLSAEEAQGAASKPFYFRFMTIVAWHIFLKLGIRDVVMECGIGGEYDATNVLPAEAVSAAVITQLGIDHVAMLGDTVEKIAWHKAGILKPNVVGFTRRIPDQPSVMDVLRERAMEKQARLIEVDDALIKAWSGVDGTLKGGFQRYNQALALLAVRQHFGLNTDPSSALQDVSSQEVAGLAEARLRGRCEIVAQNDVTWYLDGAHTQESLEQVAHWFTQSVPSDDAKPILIFNQQERDASHLLEHLVTAIDRRPNAFSHALFTRNDQSSSQEDGETRDLSVQQRAAGKMTELDPLCRTMVFDNIHDTVEEARRLAREGGGKVLVTGSLHLVGGVLQALEPGVVS

SEQ ID NO: 2086 - protein, 1343 aa, Unknown
  Kingdom: Fungi, Phylum: Ascomycota
MADRPYSQNRADNIQNETALTSTGNTPPPTAAFDHAASTPQETSAVMTSSASPTPSPGKDTPVGSEAALETTSIDPNMKEKEPIASVPFDLNDPDPIPANNFAFTPTQLHKLQSERTLEILEAFGGARGLAIGLRTDPIAGLNADEGALDGGISFEEAVAAGREDRTPIRRELSALPESHQHHGLRIREREDDQGFVDRIRVFGRNQLPKRQQKSFLKLMWIAFNDKLLILLTISATISLVIGIYQSVDAEEGTSNIEWVDGVTVVIAILVIVFASAATDWQKNHKFEKLNERKEQRDVLVVRSGCDRQISVYDVMVGDLMHLEAGDVVAVDGVLIQGSNLQIDESSLSGESELVHKVPADRLVHHKDLDANPFILSGTTVARGVGRYLVTAVGASSQHGRMLMSLRTDVEETPLQAKLGRFGKQLITFGGIAGTIFFFVLLIRWLVNIEDLSGRTPSEKAEQFFEILILAVTVVVITVPEGLALNVTIALAFATKRMLKDNNLVRLIRSCEIMGNATTICSDKTGTLTQNKMTVVAGRVGLEGHFDDMDVPEGDLARPFANPLSNASTSGRLIASLSQEVRDLIRTSTALNSTAFENDDSNDFVGMSTETALLKFARDHLGMGRLREERANNPVVTMLPFDSSRKWMGALIKLPDGKYRLFIKGAAEIVFEYCAYALSDPTYKLQVVNMSESVREDYRQSIHEYAKKMLRPVVLAYKDFEASEVCSDPDDEPDSVNLEWLASGMILIGVFGIRDPLRPEVVESVRQCQEAGVMTRMVTGDNYETAKAIAVECGIFTPGGIAMDGRTFRKLSKEQLNAIIPRLQVLARSSPEDKLLLVTHLKSMGETVAVTGDGTNDALALKAADVGFAMGVQGTEVAKEAASIILLDDNFSSIVSALSWGRTVNDAVRKFIQFQFTINIAAGTLTILTELVGSAIFTVVQLLWLNLIQDIFASLGLATDKPSKDFLLRKPDPRNSSIVTITMWKMILLQAVYQLAVIFTLHYGDFEVFNPDRSDAYLRTLTFNTFIFMQTFNQHNCRRVDNNIGIWYQGVLRNPWFIGVQLVTIAGQFIIIFKGGEAFDTVPLTGQGWGWTMLFGGLTIPLGALIRQVPDAWVSHFFHLVGALIMFVTWPLRKLIGPCFRRLALHRTRRRERKKKDSESASQETQDTASQEDHEMSQMENMMMQAGRAMIQPMIIHPAHLQVGDHGEDLDISPEQRRALEKAARDQALREAAEADRILDLPGLVAAARAGQDIGKNRLEIHPATMKKDPILVGKRKNTHLPPSQDPDILRFMTHLDEDAMGAREAAELRARRIKAAAKAPTMGKTKERNGLSWEAMVRSKRR

SEQ ID NO: 2087 - protein, 287 aa, Unknown
  Kingdom: Fungi, Phylum: Ascomycota
MASRVGPRSVKDATRFTSTIPHATSKTAGASVAGAPSPAAKAAAKIASQRAARLPGETPEQRVKRLRQAHLAAQKAQISTSDKLIDGSRRVLNVVHRFTVTGVVIFTVVAGIVSIYSVWDMIRYNRARRAEWLAAQKALEDDALASARMAYMQGKATPEQITMVEEANREAEAQGTKLPPLLSPPERRTHFEETIQPKLQGEGKGVLGVVAGLFGGGKAEAGEAAVTVADDAASGVPNTGKTVEEKASAAWEAELENQRRGGPLDQLGLDTASSSSTENKKKGWGWW

SEQ ID NO: 2088 - protein, 554 aa, Unknown
  Kingdom: Fungi, Phylum: Ascomycota
MANFLRQIVAGPRARHPEADLDLCYVTDHIIATSGPSQTYPQRAYRNPLDRVVAFLDERHGEDWAIWEFRAEGTGYPDHLVYDRVRHYPWPDHHPPPFRLIPMIMASMRNWLHGGELHDENVDSGDKSGKKRLSLKGEEESKAERSEKRVVVVHCKAGKGRSGTVSCSYLISEEGWTPEDALARFTQRRMRPRFGAGVSIPSQLRTISYVDRWTKGGKKYIDRPIEITEIHVWGLRDGVKVDIAGFGDEGKRIVVLHTFRKEERHVIEGDAPDGGGLGEMVWEMAGYSANPKKEAPPEAPLADSANLEEPDPKKTHSLKDRGTKLIHKASSSTSLRGRKDKDAADGSGSDEKEPGGKAVILRPETPVRIANSDVQIAVERRNKTSKNLGFTMVSAVAHVWFNTFFEGNGPEQNGKADDAGVFTIEWDAMDGIKGSSRKGARALDRMSVVWRTVKGDGQGAEVDEPPPGEPVPEVKAADWKGGEGYEKELGLRVQSPASVDVSKASSLVDDPKGEGGSGGGKAAADDVDEWQGMRTSGPMGEELNPTEKKEESKG

SEQ ID NO: 2089 - protein, 320 aa, Unknown
  Kingdom: Fungi, Phylum: Ascomycota
MYSCGMGIHADLLDSKDIVMMAKWLVVAEVLYAFNLGWTKLGLLLMYYRIFHVPYFKKMAWVVGVFVMAWVVCITFLFIFICVPVQKLWYPLLPGRCIDQVATWIANAAATILTDLIILIMPLPQLWRLRLKKREKIGLTFAFSLGFFVVFASAYRTSVLFTYSTADPSYTLAPTVGWTAIEMSAGIVSTSLPTLLPVLNMVLSLVGIRSKSGTLSTSKRYRSTVDKLNSAPGGPRLVTPVGTENNTFYRLSDDDDRGNSGTSPSARSMPLEAKLRPDTMGFKYTVTSYSREERGEESGDDIPLHAIRVKTDFEKTIGRK

SEQ ID NO: 2090 - protein, 785 aa, Unknown
  Kingdom: Fungi, Phylum: Ascomycota
  misc_feature (145)..(150): Xaa can be any naturally occurring amino acid
MSLAQLPPLDFDSGGLRISLFPRSDSPPLFAPDSVSGEPAIADSRKSNEAEIPVPQRKRPQIPDHERYHGDGHDIDRDVSLGLKHGDQRPPTERGYPISSDGASDKHGDTQLRHGHEENDPFGDQSSDVTGLSEPEDNKPQSKVXXXXXXLHEVTMGGPVTKPKLRSMDAKARRERLLEQEKDSEPFDQLWRYRPGQKQHEVLKLLAQISFGVYLLLNGMANSNSQVVTILQGHIDEVDEFLEVALEDLAQATIDLNGRIDYLKLPMSNMQVFEELLEDRNFRVEILEGNEKIEHILARTNMALKQWDDDIDAGLVCSADFTKWLRQQDSASWKTDRPEVMDIFDAMNGNAEGWQNAFEEMNCRAQEMNNLIIKLMTIVAEMEKKAGEISRKTWAQIPPFTVPAKIGDKSSISSPQSHQSNTRSQGSVRSGTFSAFSAQKADHHPIDDDSLLEYPLPGGTPLLPPPRISARAAPRPSSSSSSTKRQNGVTFAPMSPPRSVDPAEGSVQDKVVAEEESLYILQPRTYTPQPTKPAVSQATQQSPRTQLSPKPGDVSSDQKSLQKQTSLRQRVSQRGKAPVSIQIPPRNFAEGTAVHRQSPSFATPRTGGSMAHDSAYGSDSEHQPQHRQIPRMASHSDLSAPVRPPLMPSPRSDHQYYRPVQASPHSPLQQRPHTSGTGAAAAPRHQSASYTPQHVRNQPSRLGGMSMLSNVTNAQDDARTIATQRTARGTDRTLKKKKSAFGWLKKAFSMDDEERAAYEARKAMQVDPQYFDDKSPKFLDGKRIR

SEQ ID NO: 2091 - protein, 184 aa, Unknown
  Kingdom: Fungi, Phylum: Ascomycota
MPDTTTTIDDESLTTGCCSQWTQPVEVGGDQSWNYDGKNTFFQGPFLGPLLFENESSDARDHCANERTFLSYLRLSIYMAVVSVAITLSFHLKSQPSAIERKMAKPLGAVFWALSVATLIVGLGNYIRTINKYGRREAIVQSGWKTQLTLGILASCIVGTCVILLSISNTSSRNSRLMSFVMQP

SEQ ID NO: 2092 - protein, 628 aa, Unknown
  Kingdom: Fungi, Phylum: Ascomycota
MYNDDPTRDIELAQIPTLHPANHIVQSFSWSSLSVTVKSRATKQPLRILDDVSGIVRSGEMLAIMGPSGSGKTTLLNALAHRVAAAGAVTTGGVSVNGDSATRQVIRDLSTYVEQEDALIGSLTVRETMMFAARLALPRQRNIGQKETRRRVDDLITSFGLQGQADTIVGTPIKKGLSGGQKKRLGVASRLITNPKILFLDEPTSGLDSALSLEVITFIKEIARRNNLIVVASIHQPSSSTFKQFDKLCLLSQGKTCFFGPVTNAPSYFARNGYEMPPETNAAEFYLDLINTDLDRDGEVCERMADITQKWCDSDERAGVVSTIALTAQEPSGTLTGEDSAKPSSISLSMVLLHRAWIKSYRDIVAYGIRIVMYLGLAILMGTVFLRLKTEQNYIQPFINAIFFGGAFMSFMAVAYVPAFLEDLQTFYQERANGLVGPASFMVANFAIGLPFLFLISLLFSVVTYWLSNFRPSADGFFRWVLWLFLDLVAAESLVVLISSIFPIFVVALAVTAFANGLWMCVNGFLVPMSILNAFWKYVFHYINYQAYVFQGMMVNEFGYRDYDCAKTTDGYQCMYPSDLSDEGKIQGTAVLKNFSISRGEEGTWVGIIIGIIAGYRLLAYLALVLRK

SEQ ID NO: 2093 - protein, 487 aa, Unknown
  Kingdom: Fungi, Phylum: Ascomycota
MDTTRTVQGPPLVDQKDSHVEENSPVDGSSLEQQSERPKTLKTRILTVLWDSFDKSPEERKFIAKIDWWILTYCCIAYFVKYLDQTNVTNAYVSGMKEDLHMTGNDLNYLQTFWTVGYIVGQLPSQIIITKVRPSIWLPTAELAWSVIVIGMAGAKDVKTMCGLRFVVGLLEASAYPGIMTLLGSWYTPMELGKRACIFQASSSAAQMFSGYLQAALYSGMNGRAGLAAWQWLFVFDGIIGVPVCIYGYFAIPDAPAASKAAWLKPRDRQLAIERMEKLGRAPMKKLTWGIVKRILTTWHVYLFCAIFIAHVLGIRIYSYFTLWLKADGRWSTEEVNIIPSAGYGLQILCTLTYAWTSDAIQSRWQLIIIACLISIIGTIILSVWPAHNHAAMMTGWLLTFCETGAGALIITWINELLSYSAEHRALVIGVVETAAFTFQAWVPLLIYDTGKAPHFPIGYEMATMFFALEIVLTLVILYLSKRFPIS

SEQ ID NO: 2094 - protein, 375 aa, Unknown
  Kingdom: Fungi, Phylum: Ascomycota
MAAPPSVLPPLTPEQGAETNLARIMAVTAVFHSLALFFIGMRMYARSIVVKAPKIDDAFMVLATIGAFGSGMVMFVLQASKGLGRHRQTIPDQDFVTFRLYGWVYSVVCAVVSFSLLKVSITLSLLRLSRARWFTWSLYGLIVTAPGFITAYIIVALCSFFFHCRPIEGSFNATIKPSLILASPDRPRAFNMFSDVMCATLPIPIIWTLNMKLRTRLYLIGVLSLGYITVGMGGIKAYFQLGARRDPDSQFEQNIQFYGFLQINLGIIVACAPTLRPLLGRALKLSSRDRYYGSYYGNRSGNPRSTRQRSDMLPEDGFEMDDNVTFNKAGQVKTTIHGGATAVYDKNGSRSGSEEVILQGNEPGAILRTTQINVR

SEQ ID NO: 2095 - protein, 1135 aa, Unknown
  Kingdom: Fungi, Phylum: Ascomycota
MGKRSTHEADGAAAFRKRQKITHEVPAGEDVVDSAHLRQLLSFDQDMHRARHALQSFKRLLDAIRSNDENRRANLAILTEYLEDVKPRNADDDSVYLPDIMEMWSFATQVHNDDVASSVAVVLALLLQIISNSLQLLPHGLGICRTLLQEQQLKSISKNLSAPKSGGFIISPTLRLLTEAVCLDGGAFAKRIFRARDSTFTALGRNLELGHIGEGQEEVHRASIRTTAVRFLLCCLRYLHSAARKELLSQREWISHLTYTIKSDPPYLALEILDSLKKYILMDEKIDRPSKLRAFNTKTLMRVLALYSNNAIAIGGDSQVSVGDKAHEFLLYIGTTQSAGILYPATGLYPKTAEEDQPSLTRGATAANNSDLWVGTLDEGVPVYNFVLSELAQKLRPWSSSKHAELLVAIFTAAPELISDYFYNNRSFTFEPKLTMTWIGYAAFLFNTMMIPIPPSFGDRVLYAAVPPPVQILLDNVIPPPITQKVLSRCFNPDSHLTSFFATRILVVALEKLSTVLELLEDDFRSTSSLWKDAARQLLDAFCRRIPDMVELVRSYKGIPSDHYLHRTLASRLLRLYYEVVPRVALAANFDVSPFLAEMLRKIDSKDADTEATPFGMIELENLVSIASYSPGMRWFTRPGKPADGTALSPFTALLRLLCQSDSADSAIHLKKVLETVAVESQVVSQSSKLNDIYRALQALRSTTKQDLNPVWQYLDNSITRCASTPIKYVELFENKIEEAGSDKERQSFSLIGVALAEQLSFATASTSKADKALLGQFLSLYFNAANFSEGKKPILRALHQQIRDSLKEASVKIPKLGASEDVDLLKAFPVEVNTAEEDSASSEKKSATFVDSTTLEETLRVEQHPVEDTAVLVKWSNQSVEDILEDDWAARLVHLLLSPHTHIRKEALTNILKLAAKVKESSYEEKDQIWLLFSELAESSNSLVSAGPVPSPFVAFTTHAIDVLRNPLHVLYPKVNTFLTRGPVWSPDRLPMAPDVLHGEPSEDDRYYAELAWLLTYLLDALRTPSDLAVFHRRRWFEKIFALAGNPYVRSNLRQKILRVVYRATEIEGGSTTLATRFGVFSWLAAQRAVCDVVEEVGVYDALVRRVWETCDQERVGTWSHGGVEKLVERLSKV

SEQ ID NO: 2096 - protein, 137 aa, Unknown
  Kingdom: Fungi, Phylum: Ascomycota
MTVLGLRTVAKGQNGVGAFILQCKKLDFHYCDWAGSSKGMNGFIKSLLPKFAAANPQVEFSVSPRPGKHPVVIGHYINGRQKPICVRNLSPFEILQKVELLRDASGEKLRKTNKPVLSTKQSVRGVWSPYHGKGMAV

SEQ ID NO: 2097 - protein, 370 aa, Unknown
  Kingdom: Fungi, Phylum: Ascomycota
MAAVTLPTLRQAGQRFPASAPSPDGSGAAGAKIPRKDDAPSVAEVPVRPRLGVREVAALSESERVSPVDDDGAVGLSWSDTVYFVITTSVERLLLDAHPTTPHIVRDLDTEHDTEHSEVQSTGVMATTTGGYTLAIVAAASATLLLVAYRDYRAYVALGPHGLPDTFWGWYKQLKLSRLARKDTTVPAPYDIEAEKDTYGPHAATSFLVDGLQPRRGSRPTIPGFVAPQRQITAVASAEMKVQMHKFLSALVAANSSVLQYELSVLEGPVPAVQLKSDIARPAFLKTTKGEMIHVHPPDGSTHLTLSLADSRSVIEQGWGQRHRLSGGLLGWGYTLVYAPRDQRELEVWKGVVWAAARYCCADVHELRHP

SEQ ID NO: 2098 - protein, 125 aa, Unknown
  Kingdom: Fungi, Phylum: Ascomycota
MSLKDEKFPSSWAFDTINSALQGEQERKDAIKQGKAIFGFTLKNAQGETASWHIDLKETGTCGKGLSDKPTVTLILSDSDFGDLVAGKANAQKMFMSGKMKIKGDVMKATKLEPILKKAQTKSKL

SEQ ID NO: 2099 - protein, 507 aa, Unknown
  Kingdom: Fungi, Phylum: Ascomycota
MSRPSFISSEASGYSYFCALWVAIGSLLWGYDSGIFSTAQAQDYFMHQFHPNPSMLGGIISIYTAGGAIGSLFSGIVGDRFGRRGTIQIGAVIAAIGTAMQTAAQETILLLVGRLIAGLAIGLIYFAIPMFQSEIAPASHRGTFVGLHAQFIGFGYMTSNWVGYGISFASGEVTYRFPVGLQVLWALLVLVGSYWLPESPRWLISKDRHDDAEKVLKKLRKSDIDPATVRKELVQMQDQISWERQNEEKSLIAIWRKPSYRKRLIIGCLTHIGQQICGISAINYYQTVMYRSLGISGSTVLLLAGVWGLTGPLANIFCLMFIIDRFNRRTILLWGSAALTVDIAIVQAMVAVYGGSDNVVANAFGIFFLLLFGIIFSLSWNSACPLYATEIFPTQIRATGGALATFCSFAIQVVLAQASPVALNNIGWRYYFFFIAMNVATGIIVFFMFPETKGKTLEEISEVFGDPFVTLHMDEDLKRPMDEEETAEKRVENAPNSGRAQTVSEAK

SEQ ID NO: 2100 - protein, 731 aa, Unknown
  Kingdom: Fungi, Phylum: Ascomycota
MAPRGFDDEELTISLSSSHIRRQAQQQQQEEARRGRDDASRQPPMPTIADGVVMDAPPTTERVKQKTEQRIDAYKVIRTLGEGSFGKVKLAVHTSTGQQVALKIIARKKLISRDMAGRVEREIEYLQLLRHPHIIKLYTVIKTNTDIIMVLEYAGGELFDYIVANGRMKEAEARRFFQQMICAVEYCHRHKIVHRDLKPENLLLDDNLNVKIADFGLSNIMTDGNFLKTSCGSPNYAAPEVIGGKLYAGPEVDVWSCGVILYVLLVGRLPFDDEHIPSLFAKIARGTYSIPSWMPAGAVNLIKKMLVVNPVQRATIEDIRQDPWFVTDLPAYLQPPVEEFFNTGMDPSKAIEKSDIAPHASEVVQERLHNEVTEKISKTMGYGKGDVEEALKAEEPSAIKDAYLIVRENKLMQVSQNPDALVTDEPEGAASSPLMSLSSARSGMSQIPGQVRPYVSKVGILPSSIPTYHKDYVERLKAGTLESEGGAENPDEEPSPARTEAEKEESVRRLKPHSRSQIRMEESAKPQSLTPVTPKKTKPVRWQFGIRSRNAPWEALLTIHKALHKLGATYLPDEDFELAHRKETDGSRSGDSSFVQEQDGGPVDGGSTGSLDSTNGYKLPADPWHIKVRWDSSTIRKLAPAPKTGAEKEKYGTPDSFHVYSPDEANKKSPFVAMHLDIQIYEMEHGVYLVDFKCSGYETSQGLLLEEKDVTSPFPFLDMAAKLIMQLAEAD

SEQ ID NO: 2101 - protein, 386 aa, Unknown
  Kingdom: Fungi, Phylum: Ascomycota
MQPKQAGFQGSAETSENLPHVTVLPFLARPIWSAPAVGLERGQPRQSATPGLILHQQWESNVFLFPAHLGPGQSSQMEPSPVILSPKSLPSGPSVTFRDSSYFSRNGHGASLPSPSDVLAEGAVQHPRYVNDFERPPVRFRDLGLLVKYGWPPKVTIAEGQCLWALRRNMPRVPVPEIFGWVEHEGCVFLFMELVNGVTLEERSPSLSREERHGVCEDLRSMLADLHQLHQEPEHPFIGDISRGPLGDIVFTNGTLPRGGPFNSVKGFHDWLSAMIKWGKEQHWPGVDPADIPDPYRQGLPDESSIVFTHADLHPTNIMVSRESPCRVIAIIDWQQSGWYPDYWEFCKAEFCVHYRSDWATEYIPQFLKEPTCVETFEAYAQAYGY

SEQ ID NO: 2102 - protein, 169 aa, Unknown
  Kingdom: Fungi, Phylum: Ascomycota
MSDNVGLSTPRGSGTSGYVQKNLAHMRPRDRIAPYPKDLDSTRHKQRQPDKGILDHERKREVEVKVFDLRDKLEEEEVDEDEIDRQCDELRTKLLADLERGKGGPGPKRTFKQGQVHEMADAKIKESERLRKALKISSNYEEGSHWKKQEERLRGALEKEGETAEKERD

SEQ ID NO: 2103 - protein, 165 aa, Unknown
  Kingdom: Fungi, Phylum: Ascomycota
MATPPIPFTRLKQIATDVCNSAIGNAEFYDHAKAEQWNSTIINSMLKAVIAESKDESDQNKMYKFACNSTIVQHLVPTSSLNKPRGGTESKNEEPHVSTSTDGGAATATDGKPHVGRRGMHSATGAFWDEKQDGMWTFKYDGGEGKGMDVIIMMMWIAVPKMVLI

SEQ ID NO: 2104 - protein, 652 aa, Unknown
  Kingdom: Fungi, Phylum: Ascomycota
MSGPKQRPSVLVTDARERRNPRSGLQRQGTSSASPGARMPMRFMTVDNVLQYNTQIPSGQPRGPPMPARPSTSSGLPVTGRRTLSGGLLNTQSRTGKPMPSRTTKVSEKLVLLPETDDKDDDAEDEIESETVLARRLQEDEQRPLKDEEIDVLRKRGGVRGKSYAERLPKVQRTEKVSRVTAYCTAQAYKIKPTAEFLRKKHEAKTKLYDDCLYVIYALPLLNGTDGYRVRSRPILKTPGTGKTVLDLEIERSERRDHHEGYFDDDAYTSVESPEPADQRRRRDVPMTFNDPSPDDPYPSNPFQGADDRTSQMNRLAPEAKKFAEMFVFSYGVVVFWNFTERQEKDILADLTFADAEDDPSLLTRPLDEDDFETEEFHFEYSADVKRPRVFNDMITLLPRSDHMIKLTISHAIAQSTKLCFFEERMGETMSDAQHVPKTLALTGELNMTRTEIVKILGRLFKSRVDINLSSNILDVPNFFWDSEPTLHPLYAAIREYLEIDPRIKVLNERCRVFLDLAEILSDSVADSKMSAITWIIIILIIVSILVTISEVTLRFAMLEKSKNDEKKWREGHPVDTLRWSDQKLGRDNYMPFAPPPPSPVIPGQLSDLDILARELGLSEGASLEDVRQGIWDLKQTEDDRARAGRGPELLR

SEQ ID NO: 2105 - protein, 335 aa, Unknown
  Kingdom: Fungi, Phylum: Ascomycota
MSPSAYNSDAPSVEANGRGQHPSRALTPGIYVPTLAFFDPETDELDTKTVTKHVVRLAKSGVTGLAVQGSNGEAVHLTFEERARVTTTTRLALDGAGFTDMPLIVGCGAQSTFEAISLCKQAASSGGDYALVLPPSYYSGLFDKATVESFFNEVADKSPIPIIIYNYPGATGGLDLNSDTLINLSKHANIVGCKFTCGNTGKLGRVASAARASGADFLCFSGSADFTLPSIAAGGAGVIGGLGNVAPRASVRLWELGKDPARAEEARELQRAVADGDWMMIQTGVVGVKAALRDMFGYGGWARRPLPRLSDEKIAWIRDGMKELMQVEKELEGGS

SEQ ID NO: 2106 - protein, 677 aa, Unknown
  Kingdom: Fungi, Phylum: Ascomycota
MTSPHRHGSSSLEESDSSSTHSNNPNVRSRYNSGPTRASAAAAAAAASHFYTHPSRVSLLNPSHPHSIGSPTSQLRDTETAAEMEEDRADGTRGSSWRNGSGTPSFSRAFDMFTAPDDVDDASHLEEDRFFVPSYLEGSTYVHQLEEAHLVKVQAQRDAKRSSINGGASSGLGSRPASLPQGSYMGMAHTVIERPPAFEADDDLAPLPTRWNKDDMWGGIEVQPDGLSIKYTGQKNHHEREHEASAVRADHYMPPQCGLYYFEVQIISAKRNDATIAVGFCTKAAQMSRPIGWEPESWGYHGDDGQCLTAHSVGKYYGQPFNAGDVIGCGVNFRDNTAFFTKNGARLHKLDPFANIARGKLYPAISLKKAGEHVRANFGQTPFVYDINQLMREQRESVQQTISLADSSRLEPGMTETDLVQTLVLQFLQHDGYVETARAFAEDMRVQKEALNMDPDTTVDGINIKDDEDANNRQRIRRAILEGDVDRALKFTNVYYPRVLAENEQIHFRLRCRRFVEMVRKIAILNMKNDSRGDVAEQDMDMDMDHPSPVDAEAQAELLELEGSMLEYGQSLQAEYATDPRREVSKALNEIWSLLAYKNPLKEPQVSHLLDRKGRVAVAEELNSAILLSLGKSSRAALEKVFAQTTVLLEELRQDGGDGAFVSVKDLVDEIPKSSEI

SEQ ID NO: 2107 - protein, 73 aa, Unknown
  Kingdom: Fungi, Phylum: Ascomycota
MAGPHSTYYDRKYRQGPALIRARRPYLIPNAITGVCLLAISVGIYTYTLRAVGQDDFDDVKVPDQPRKPSEAK

SEQ ID NO: 2108 - protein, 307 aa, Unknown
  Kingdom: Fungi, Phylum: Ascomycota
MAGWYEPPPVLEAELLATLPTAFRTLGTSDHSRNQKRGRALDSFLEGPVVRGDTLYLTDIPYGRIFAVDLTTKEWTLVIRYDGEPNGLAWSEKHKRLVIADFKLGILTLDPDCPGEKTVHTLMDRFNGERLKGPNDLVVRGDGTIIFTDQGMTGLQDATGRVYRISPDGGRVDVLLRNCPSPNGLVLDPSGTSLFVAMTRDNSVWLAPLYPDGSVQRTGRFSTYFGVGGPDGMAVDEQGNVFVAHSTLGTVFVHRRDGTPRARISVESSGRGSTNLTWGGPDLKTLYIVESEAGSILTVDWHCKGVL

SEQ ID NO: 2109 - protein, 893 aa, Unknown
  Kingdom: Fungi, Phylum: Ascomycota
MSTTTSAAPASTGAPPQGGIIEGLNPVHYNPKDPITLFIIQAVIIIVFCRILHYPLSKLGQPRVIAEVIGGVLLGPSVMGRIPNFSSTIFDPASMPVLNNAANLGLLIYLFVIGLEVDTRMFSQNWRVAAAVGLAGMILPFGLGVGIAVGLYDEFRHEAAKPDMSFGTFALFIGTALSITAFPVLCRILSELQLLNTPVGITVLAAGIGNDVTGWVLLALSVALVNNADGLAALYVFLTAVAWVLFLVFAVRPVFIWILRRNGSIQNGPSPGIIALTLIMVLISSWFTAAIGVHAIFGAFLIGVICPHQGGFAIKLTEKIEDLISVLLLPLYFALSGLRTNLSLLNTGVTWGYVVGIIVVAFFGKIVGGLLAARASRLLWRESFAIGVLMSCKGLVELIVLNIGLQAGILSERTFTMFVVMALVTTVATTPLCKRFYPQSYQRKVELWKRGEIDWDGNPLVTEAQATEQRMAKALDQAQASRVAMHLRLDSLGSLFNIVSLLGDSKRANEQQREKPINGSETNESSTGETPTTQPTPPSRPLEVHGIRLLELTDRTSSVMQSAELEELANQDAVFSAFQTFSHLNGVAVAGHVAVVPSSRYADTLVEHAKEARSDLMFIPWSRHGSLAEDATITLPEHVSLIDRFFSRQHIDFVQTALSTSECTTGIYISPTPEDPGSSKRPGQLRRVATGISVQSGRDALAVRPRASKAQHVFLPFIGGEDDRAALLFVLQLANNPQVTVTIAHMKFLPDDNAVEAPSSSAAHQVAEKSANIKEAELEPSASDLELLFTVRQSISNTNLESRVHFMDDESPSASVVPARVLELSTETFARTSGHRLDNMIIIGRRHASFSSLMTRESGMERDFQRTVGVLGDKFARSGTKAGLLIMSAKEQK

SEQ ID NO: 2110 - protein, 162 aa, Unknown
  Kingdom: Fungi, Phylum: Ascomycota
MAKKNARDPPPSAAATTQASTTATGTVPPAATTTTAAAATPKPVLAKAAGVASWDQVLQNIYEYYMKETPQRTKLIDVFLGFIAVVGALQFVYCILAGNYPFNAFLSGFGATVGQFVLTISLRIQTTEANKSEFPSVTPERAFADYVVCSLILHFFCVNFIN

SEQ ID NO: 2111 - protein, 195 aa, Unknown
  Kingdom: Fungi, Phylum: Ascomycota
MAYSLSSLRGALAGVRAATASRILPTPTKSSLSVNASRLFSSTTSLLARKAPMKSGGTVKKPAAPLRKSQRPQRSESYRRIAILKQNLFSPAPPPLRMARLRYLRHWTIHRAWMLFRRQQKEALDAERGRMHAGMYNACEELRKTVGPAGRGEGYLYRVAMEKKGVWNMGGVPIEYGRMQTDTPAKEAWDHNWKR

SEQ ID NO: 2112 - protein, 820 aa, Unknown
  Kingdom: Fungi, Phylum: Ascomycota
MAPTPAAISSLLRQTIHYHLDNSAYENALFFSERLAAQDPRSCEAVHLLALSHLRLRDFRSAYDVSKTTAYRGTHVGCAWVFAQACLQLERFKDGITALEKSRNMWAQENNLGKHSAQTRAVNPDAAAVLCLLGKLQRGYGDKKRAISCFEEALKMSPLMWDAFTALCDMGINVRVPNIFRAGEPLLASLDPAFLHVPTKENGVPEAPTKKSSARPAVADLGADPFNVMGSDTNVPAIDMFVEPAETDFMSKIQAARLRLVSSTNSQPPLDGMETPTGNSTTDMMPARQTNPHDPPQAPLRRARTTTVDSITEAPPRMNYRLGAKRTGRVQERGNDDNVGLMSEAANPPPPTQPTRSGIPGVERKRTVSGHPVARPTANIDEHTTRRSARLNMFKPSVKANSGAATIGVSAGRELKKARPQISRIVRPGSSGASVGRVVSGNRKPLEDQNGGDVDHGETVRVREAPSQASQVKVPEPDSVKLEEALRWTLDLMKKLASGYYYLSRFQCPEALQAFASLSTAQQNTPWVLAQIGRAHYEQAAYADAEKYFRKMRVQAPSRLQDMEVYSTVLWHLKRETDLSFLAHELVDSAWHSPQAWCAVGNAWSLARDPDQALKCFKRATQLDPKFAYAFTLQGHEHVASEEYDKALTAYRSAIAADRRHYNAYYGIGRVQERLGSYDKAHTHFQAAQSINPNNPVLICCIGTVLEKLKQVRPALQAYTRAAELAPRAPQTRYKKARGLLAVGEVEAAQKELMILKDLAPDDGMVHFLLGTLYRSMNEKQLAVRHFTIALALDPKAGPKIKEAIESFEDDVPMDDSMMA

SEQ ID NO: 2113 - protein, 268 aa, Unknown
  Kingdom: Fungi, Phylum: Ascomycota
MSIQILSDLHLEAPKAYDVFEITSRAPYLALAGDIGTVVAHKADCLAFLTRQLAQFRAVLFVPGNHEAYHSTWDETLQTLREFEEEVRRDASLGEFVLLDRRSFRVPGCNNTVVLGCSLFSHVPEHSHESVSFGVNDFYHTQGWDVAAHNAAHARDLAWLNDEVAALEKTEQDVEIVIVTHWSPSRDPRASDPRHGQSPIACAFSTDLSGERCFASPRTKMWVFGHTHFNCDFAVEREGGRPLRVIANQRGYYFSQAAGFDPEMVLEM

SEQ ID NO: 2114 - protein, 320 aa, Unknown
  Kingdom: Fungi, Phylum: Ascomycota
MQSSITMTSKRNSRVFDDDQPQRDRGHSSAMAPLDASRRTSRTSSCEDMHSAMVSNTTGSHDDDENEKPATYVTGSSLNAVDLESAHEQTDAASEKNDLTDPSMSSAISSSGSSSINLAQQGRMANFGVVAPGVYRSSYPLAEHFDFCQSLGLRTVVTLVNKHDERSVNLRSFVQDNGINHVVFNMQGTKKESIPHHTMTAILEIVHDKAAHPLLIHCNQGKHRTGCVVAAARKVAGWPVDTVIQEYRTFAEPKVRDCDITYITALEAASLRLRNSDFGTAAMFNNPYRTMRRRVFIRFVAIAFTTILVFMCSSWQWNTS

SEQ ID NO: 2115 - protein, 564 aa, Unknown
  Kingdom: Fungi, Phylum: Ascomycota
MEETKVAPPPSPPASGNGDHEKKLDNPTTDLTVNGHLGDNSDDLHRRLNNRQIQLIAIGGSIGTALFVSIGNGLIAGGPGSLFLAYTLYSVILGMVNNSIAEMTVYMPVSGGFVRLAGHWVDDALGFMVGWNFFLYEALLIPFEISALNLVMSFWSDKITEPGPTAAICIGCIIAYAAINIIAVRGFGEAEFWLSGGKVILIFLLFSYTFITMVGGNPRGDAYGFRYWNSPGAFVGATPKLRFEGFLAALWNASFAVVGPEYISMVAAEAKRPRIYIKTAFKTVYYRFFIFFFGSALAVGIVVASNDPKLEARAGSESSASASPYVVAMENMGITVLPDIVNALMLTSIFSAGNTYTYCATRSLYGLALEGRAPAFLRKCTANGVPIYCFGVVMLFPFLSFLQVGSASAEVIVWFVELITAGALIDFMVMNITFLFYYRACKAQGVDRRKMPYYGRFQPYGAIIAIVVQFLVTIFYGYKSFAPWSVEKFFRNYTMQILAPILFFGWKFIKKTRMVKPHECDLIWDAPIIDRYEASFTNPPVGFWTEMGRMIGIRRAKKANQMDA

SEQ ID NO: 2116 - protein, 710 aa, Unknown
  Kingdom: Fungi, Phylum: Ascomycota
MTLPPASSGDYTVRRQYTKRNFAIYRPLESDETRSAPGFVSVSIDGRNWTKHQPIYNYTLPQQTEDHRQHVKQQFASHYEQVQSLGTNTEEKGDRGKEFTMSRGAKGWTHHIKSWAPEAAWCIIAGVLLGALVILLMQYNNQTLPEWPLGLTLNTAVALITTVLRSVTVVLISEAISQLKWNRFAVQQRRISDLHVFDQASRGPWGSLLMVLRGRGGVLGMTAAVVFVTGLATSTITQSTISYSTRMVANTTNHASVMTRTEYGRGGGPFENTTATNSAPPNGIENVAFQAVYQPTDQGWLMNEPRCSSGDCKWQAFSSLALCYDMKNVTDKLRLTSREYDSSSAMNVHQNISLILPVQGNFSLSDSWSQIDSRPRYNAISLLSPWPSLDRGRGEFQDLDRISFPGFRESVGYASDSDILRSAASQWFAIYVVNANTGVSTREYRAIELLWHFCVKTYNVSVEGGKVTRAVLATSTKIRDGQGYGFDLPLNDDEESRNFTLLSASGDERFPIYNTWDYARIDSNMRIAFQGRYSTLLGDTGFNEFTRGISQKMFAGVEVNMTDLDADKKVWDNLGNLATTVSDAMTDFMQKKGSRQTGEVLVSETFVQVRWAWLAFVAIQVGLSVLFFICIAWHTASLGVDIVKSSNLSELFALRHKDVHSQLPPGAAGIRPLVAPSVLGRLERSEDIWTLEVSQQSESETKGLASWLRQ

SEQ ID NO: 2117 - protein, 556 aa, Unknown
  Kingdom: Fungi, Phylum: Ascomycota
MAEDLAAPPVLSTPDDHILDLPAATDVVPSTSTLSDHDLRITYEIPRTVTEIRLGGYTRVALQFPDHMLVDAPRVADSLATDLAISSDDSASHTVDGTTTSSGAPRIYILADTSYSACCVDEIAAEHADAQVVVHYGRTCLSPTSRIPAIHIYTNHALDSAMVMQEFEKEFTSKDTKVVLMADLTYQSHVAGITTALQASGYSNIVPTEVVRNPAAVIPNRATVGATLDEQTLKDYAIFHISDPPTALLLALQSRCSSLHVLSTSAANPTLSNPTRQTSGLLRRRFARVLSLASAGVIGILVNTLSVSNYMTSIDLLRKKIAAAGKKSYTVVVGKLNPAKLANFAEVEGWVVVGCWESGLIEDDAGYWRPVVTPFEMEVALLSEDERTWGGEWWGGIERLKLENGETSIADLKTPEVTEEPSQDISEPHDDDVEGEESQPPEFDLRTGKLVSHSRPMRLPSRPAVTAPQASLEGSAESSTGQDRPTSAAALVKRTVGELTSINGVASPGAEYLRSQRTWQGLGSDFEQNQEASTVIEEGRSGVARGYQVGDDGNRH

SEQ ID NO: 2118 - protein, 436 aa, Unknown
  Kingdom: Fungi, Phylum: Ascomycota
MSEKATLPLYHHESSQRGGGGTMGHSHKKATVDCTSEDALIHLKSYKYSSVDKSPISKYVLGPWWNAFVNVLPLWIAPNMVTLLGFFFILANIGLLVIFMPDLVGPGPAWLYFSFAFGLFMYQTMDNVDGKQARRTGTSSGLGELFDHGIDSLNCTLASLLETAAMGLGTTHAGVFTALCPCLPMFFSTWETYHTHTLYLGYVNGPTEGLLIACAIMVISGIYGPEIWTQPLAGFFGDGFSGLKAMLGQTTFRDIWIGLIVGSLVVGHIPFCVLNVARARRKNNLPIAPVFLEWTPMVVYTLAIGAWVFSPYSTLMRDNHLVLFCLTLSLVFGRMTTKMILAHLTRQPFPYWTVMLTPLVGGAILGNLPRFGLPQISAHLELRYLWAYFFFSVVVYFHWAYVVVTAICDYLGINALTIPKEKQIANKQARAAEKIH

SEQ ID NO: 2119 - protein, 330 aa, Unknown
  Kingdom: Fungi, Phylum: Ascomycota
MSRIAGFAPLIRRAGCSRAYALPRLTQRHPRPTPKPFVANYSAGASESSRTSTESKPNPSHPLPDVGKKRLADFDLAGRTYIVTGGAQGLGIALAEGLVEAGGKVYCLDRLEEPGQYWHEAKSRVVPEWGGGLEYRQVDVTDTDNLNSVIAGIAEENEGIHGLIASAGVQQVTPAIEYAVEDVRKMLDVNYTGVFMAASAVARQMMRYKCRGSICAIASISGSMANPGLLTPVYNSSKAAVIQLCRNLAMEWAEHGIRVNSLSPGHLMTPMVRKNFEDEPHLEKLWKSQIMMGRLGDPSDFKGPALFLLSNASGFVTGADLVVDGGRTAW

SEQ ID NO: 2120 - protein, 667 aa, Unknown
  Kingdom: Fungi, Phylum: Ascomycota
MRSQTLVAVAACLFASTVVAQEEYEGYAFAYFTGNSLAGENIFLAASNGNDALSWTELNGGQAVLKSQYGTRGLRDPFVIRSHDGSRFYLLATDLSIGSGTDWGDSQRFGSRYIEIWESEDLVHWSEQRHTLVSPVTAGMTWAPEAYYDDELGTYLVFWASALYAESDTGHTGTSYNRMLYATTDDFVHFSEASVWQDSQASRIDSTVLKEGSSYYRFTKDEGRVTGCADIIQEHSISLTAQLDGWTVDASCIGAKAGTQAVEGPTVFKANPNDVHGEKFYLFVDEYVNRGYIPLETDDIAKPDWKVSAQYNLPASPRHGTVIPVTKSELDNLTAALGSTPPSRREVLARQEENDGPALPGFYADPNIAAFGCDYYLYATSDGFPGWGGQDFYAWKSRNLVDWTRAEEPFLVLDGENGTVPWALGNAWAPTIIEKDDKYYFYFSGQNAQYDHKTIGVAVANSPEGPFIAAPTAMITNTETVSSGQAIDPAAFQDPVSGKFYLYWGNGEPVLAELNDDMASINWATAQHVQGLEDFREGLFMNYRQGIYHLTYSIDDTGSPDYRVGYATSLSPEGPFTYRGVILQKDESQGILATGHDSVLNVPGTDEWYIAYHRFAIPDGDGTHRETKIDKLFFDPDTGLIKPVVPTLRDVEPLVMPGCSSSWGRNH

SEQ ID NO: 2121 - protein, 160 aa, Unknown
  Kingdom: Fungi, Phylum: Ascomycota
MEVGTKVKSWTVENFDYQATYMSLAPGQLTHVKGYVNFDLVNPALPYKAKCSALSESQPEPFADKKATFNCKVDKKYGTDAASFKFNLATGKLEIKQSWACAKEGGRFEADGFVTIKNPQCTDLTTTNNLWRKGSLYSTREVVCPKIKVKAPVKNLSAVL

SEQ ID NO: 2122 - protein, 715 aa, Unknown
  Kingdom: Fungi, Phylum: Ascomycota
MIPRLIPRSSLLCPRCSFTTAHARPAWLPQRPTAPYRSLHTTSVFRREAPTNTTKAQVPAPKPTTPASAVSNAEKAGNPRPRKNDPLATVDKSAAEQRKADWAIMKEMSRYLWPKDNMGTKLRVSLAVALLIGAKVLNVQGPFYFKSIVDSMNIDVAAVGGTATTIAGTMILAYGAARIGSVLFQELRNAVFASVAQKAIRRVACNVFDHLLRLDLNFHLSKQTGGLTRAIDRGTKGISFLLTSMVFHILPTALEISMVCGILTWQYGLKFAAITALTMVAYTAFTIWTTAWRTKFRRQANAADNKASTVAVDSLINYDAVKYFNNEPFEVSRYDKALLQYEKSSIKVATSLAFLNSGQNMIFSTALTAMMYLAADGVAKGSLTVGDLVMVNQLVFQLSVPLNFLGSVYRELRQSLLDMETLFNLQKVNVSIQEKPDAKALALTRGGEIKFENVTFGYHPDRPILNNLSVTIPAGKKVAIVGPSGCGKSTLLRLLFRSYDVQTGRILIDDQDVRDVTLDSLRKSIGVVPQDTPLFNDTVEHNIRYGKIDASHEEVIAAAKRARIHDTIMTFPDGYETKVGERGLMISGGEKQRLAMSRLLLKDPPLLFFDEATSALDTHTEQALMQNINGILREKGRTSVFVAHRLRTIFDSDLIIVLKEGRVVEMGTHRELVDRDGVYSELWSAQETLFNEDGTEKDEFKEEDELKEEDEAKIL

SEQ ID NO: 2123 - protein, 117 aa, Unknown
  Kingdom: Fungi, Phylum: Ascomycota
MVKKRKNNGRNKKGRGHVKPIRCSNCSRCTPKDKAIKRFTIRNMVESAAIRDISDASVFSEYTVPKMYLKLQYCVSCAIHGKIVRVRSRVGRRNRAPPPRVRYNKDGKKIVPNAPKA

SEQ ID NO: 2124 - protein, 284 aa, Unknown
  Kingdom: Fungi, Phylum: Ascomycota
MFSYFVGGLAILLFLSNPITQYLYPQASTSRRRNLSPRPQLNESLLAINHPNDTLPECPPDSYIAHILKTEPLVIYLENFLSESERSHLLEISEPLFEPSTISNDGHATRHDTSIRDSSVAIVPRDPTVLCIEQRALSLQGWRRDIYLERLRTQRYGPGGHYTHHFDWTRNAAGWGRVSSFMAWVHADKELAGGGTEFPMLRARSSGKGDACRFVECDEDEEGKESGEDQQEKGTVFKVKPGNAVYWENFSPDGRGYDETWHAALPVEKGVKVGLNIWTFGRIE

SEQ ID NO: 2125 - protein, 433 aa, Unknown
  Kingdom: Fungi, Phylum: Ascomycota
MSKEKLQLAFPRHHRPHSAARTVKRSKTVAVFLFVAALLHCTIVSSANRNALSAKYSPTTYTSISAKHNELLAGGNWRSTDDEADEGNVLGYSRRELLENDHKWRRVGSVDSGNTFTYGNVVVKAFQPTYSPFRNCLPGENVRWPTEISASLVLSGLAEDLSLSENAIYVPIIDYFLASGNENESPTWHMVTPFFSAENLEYLAKQLRQSPTNYSAKELDIIFRPSFEHLLRALNKMHTDHELCHDDIKPGSIFPVVGTGEPNETTHWLLGDMGNVRQVNHPYHRSFLWTRNNLRDCRANDVFRLVQAYMRFLSRAVDSNTEFNEQLLSGEVAWSRLFWATWHDVQQKLSISATRLLARSQSLDFVPDSPSRPSSFGGWPIELQDPVSWSLMGREKTLATAVKEKLDCETTETPARLWGLTAILGIPTPDCRG

SEQ ID NO: 2126 - protein, 1437 aa, Unknown
  Kingdom: Fungi, Phylum: Ascomycota
MPNAKRLRSSGASKAHPKAAPAPDASKDEGRPTPAEVEEEEHQFVQVARKNWLKQGKKPAKVKVKNDVLKQNIWDQLEREGFAYKSLLLLESLQTLEFYLWPGYTEDASNYHVLLIALIANVKRREHLETWSLFEDKPIDFSSLFRRVLSMSLDRTLATTIRTQLLSFLIHAFQSLDCTIVRKECAPLVAIGIWHNLSSDKMRDAHLDQAPHLRKAWRGAQRRYDAADDATKARLRFERSWLYTLLLDFLNIVYEERSKPESALYCERFLEFLSDLQSQLPTRRYVNALVHDLNLLAAIKLSPMYHDEDNSLLRDLHALLSHYAFFAIDDQTGVQLNRTEAFDKHCAALGKLQRVSLKHFKEQLTVLALSNYGAIDKRDELQTLLEPLSDEQLCRLVGLLDIRTTYPEDLRLKVDRRFLMEVVLSKFERRKTFQETAENMILTPTEESLFDAGFRRADSYDGSHPLALPKLNLQYLSVGDFLWRALILYRAEAFYGIRKDIETALRRLKPQAKKSGETQFGGFSKMALPISKPSILEVVPALVGDDKPSLVRAEVVVDVRGLGDGVRREWDSLRPDDVVFLLAASPVDASSNGEAAEAESNGVSVVRSAEIIQITDDRGRHVRDGAHHLDNKRRIQLKLDARTYQQDVDRTEAGKPDVYGRINLLLRRGRRENNFKPVLESIRSLVLSEVPLPSWLHEVFLGYGDPAGASYKNLPNRLQKLDYRDTFLSWQHLVESLPGKTVEPGFEVSSSFGPPYVLETAGTADKPEELKPSKKRRRDAEPPLSTEVETLKVSTYKPPNTGPYPQDAPRQNTIRFTPSQTDAIMSGSQPGLTVVVGPPGTGKTDVATQIINNIYHNFPEQKTLLIAHSNQALNQLFAKIVALDIDQRHLLRLGHGEEELGTDGNFSKYGRVDSFLENRDRFLLEVRKLAASLGAPGAHDNSAETAGYFHKVYIEPAWAKFLQTAFSQESDTAEIVAAFPFHGYFADAPQPLFPEESTREQVLDIAHGCHHHISKIFSELADVVPFEILRREKDKANYLLTNEARIVAMTTTHAAMRRGEIAALGFHYDNVIMEEAAQITEIETFLPLAMQKPIDGEMRLQRVVLCGDHFQNSPVIQSLAFRHYANLEQSLFSRLVRLGVPAITLDQQGRARPSIASLYSWRYPKLESLPSVQTNPQFVHANAGFKFDYQFINVPNYKGKGEAEPTPHFIQNLGEAEYAVAMYQYMRLLGYPAEKISILTTYAGQRALVKDVLNHRCARNPVFGLPKVVATVDKYQGEQNDYIILSLTRTSRVGYLRDVRRMTVAVSRARLGLYILGRRVVFEACPELRPAFDILLSRPDKLMLVTGEMWPTERPLLEDDTGVVDGEVAMENVEHLGKYVYEMTGTRMKQLEGDNSLPMGGEVIAEEGLGEGDHDEEEGDEDVPLEPDILEVREGEA

SEQ ID NO: 2127 - protein, 653 aa, Unknown
  Kingdom: Fungi, Phylum: Ascomycota
MSWKLTKKLKETHLGTLSPFARSPSTSTITDKEKEDKGQHSTGATTPTTESAIAASEAMSQAPVVKPPKPGILIVTLHEAQGFSLPEQHRNAFASQHQGSLSSGSALNSVAGSVRPSSSQRVAGSFMNGSNRPHSSAGGFSGIPTNHGRISGKYMPYALLDFDKVQVFVNSVDGNPENPLWAGANTQYKFDVSRVTELVIHLYMRNPTAPPGSGRSQDIFLGVARINPRFEERQPLVEDPKASKKDREKAAAEHAQRTSGEGHSGTQWVDVQYGTGKIKVGVEYVETRAGKLKIEDFELLKVVGKGSFGKVMQVRKKDTNRIYALKTIRKAHIISRSEVAHTLAERSVLAQINNSFIVPLKFSFQSPEKLYFVLAFVNGGELFHHLQKEHRFDVNRSRFYTAELLCALECLHGFNVIYRDLKPENILLDYQGHIALCDFGLCKLDMKDEDRTNTFCGTPEYLAPELLMGKGYNKTVDWWTLGVLLYEMLTGLPPFYDENTNEMYRKILSEPLHFSDVVPPAAKDLLTKLLNRNPDERLGANGSAEIKAHPFFHAIDWRKLLQRKYEPTFKPSVADALDTANFDPEFTSEAPQDSYVEGPMLSQTTQNLFHGFSYNRPIAGLGDAGGSVKDPSDDGVGSQDSIERDDQQADPAR

SEQ ID NO: 2128 - protein, 159 aa, Unknown
  Kingdom: Fungi, Phylum: Ascomycota
MADNLQCGCETGNRQCLVPPFYIRLLDQGNEHDADASRRERDQLPSLLPASYCKESGDLAAVGRHVTACVEKELDLERLTRIHDWLWVAGLPLPPRALHNQLLLGRGIFVTERMDMHLVWTTSKMLLKPIPRFLLEPSARSTGAVFDSPQRGLNLVAKI

SEQ ID NO: 2129 - protein, 335 aa, Unknown
  Kingdom: Fungi, Phylum: Ascomycota
MPTFTVFKGSKGGIAKEAKTTRPDELTGDDVLVKITASGLCGTDLHYKEQDMVLGHEGVGVVERVGPDVKNLKQGDRVGWGYNTNSCGLCVRCLEGEDVFCAERGLYGSVNRDQGSLGYQAIWREAFLHPIPDALSDEDAAPLQCAGATVFTTLYGVAPNETVAIMGVGGLGHLAIQFAAKLGCRVVVLSGSDSKRDEAIRLGAHEFVAMKNLSRDSKDSPLKGTIDRLLVTTSAQPDWSLILPMMATKSSIYPLSVSGGNFEIPYMPVILTGISIKGSLVATRVVHRQMLEFAATHNIKPVTETFPMTEEGIAEAINKLEAGKLHFRAVLKSQL

SEQ ID NO: 2130 - protein, 1132 aa, Unknown
  Kingdom: Fungi, Phylum: Ascomycota
MPPPRWHRDSASSYKFRSSSAVRKSSPLSFGEANAQGDEMDVPGAVVDAPNGTALDQGYEPTGQINGDTQDTPPRTDYPGLTDTPASEVPADPMLVANSEGILPEYYDEQQPSDAPAQADEEEAMGEIPIDPAMIDPALMAGTASQRVSEPRSTSEEPTGTIEVHDPSLQVIRDDSMQDVEQTDFSAPADTADVKAESGVEHEDNANSEQLVNGAAGDSSYPQRGSGDTSLDGPSNGAPTTELTQHSGSSPAEQNSASKRRRSSPLETRAKSAEVKAEAKASDSTSNSVSGSQSQDQEKGQEHVPKTSKLATSSEITTRSSTHKGSSSPEMTRTTRRSKAAQEQAELAAHVRQKLSEKPTVSTPLKKEQAERGTPEPAKKLSRSQPTPAGQWAYLTPYVDGEYSIYPEMKVRSDDEANGDDQSPEDKEEKEPNDMEPMVEDNDDTGDAQATEVPTPALNTPRRGSPVPDSGAITAFGSPAPAVADEGDDDSVSDTEEPQRSRHFRFRKIRDAEEYISALENFEDMSTADLYAVLEAINVSMVQWQTEWTSLGKRVDDYENAQRRRAADAKYESRTRNLHQHNFNYEEPDFAVKGYKAKEKETMSETRYLQGQDRIMAATYGFEYDPHPSKIGRQNPELQQEGMVTRGRMLRNHPRQTVKASEGDEPTGKRQRKPVQLFDPAPQDVSRSSTPVPTRARRRKNAAAEPEELQPAPASSVNDNAASDDETGVRKTRRRRGRAKADPDVEEPAATVNPMTSSQEEPTRSVRRGRGRPGPRYDDMYASPSGHEKISQSEEKDEPRRHLLTLKIPKGKHFDDAASAMTDNGDSRPSTAGSESSSHTVESSYSFRPKRQKRFRDEPEESPTAVSQQPPKKRRNRTSGAVVVASKDNVATPAANNSEKHSMDGSVAAMPTTDPFVTETPQTAGKKLQKIKVVRAVPQNESSRYGTPTTLMSFNSEDGDEPPKDYKSMTKSEKMSASMKSRWANGNMAGAVEKRKATLAAKKAAQAAAEARVGAIAPKPQAKRSKKDAMEQQRQQQQHHPPQHQHPHLQPQLHHHHHHQQPPHMQHMQPIQPHHHQPLQPHPPPPHHHPQQPPPPPPPPHHEGQGRFQGFPSRFHAFIANPWGPPGPPPQM

SEQ ID NO: 2131 - protein, 507 aa, Unknown
  Kingdom: Fungi, Phylum: Ascomycota
MSPVVRGSTVSVSLAQSNFLRPWFVGVQHTLPRGHSTRKASSSSNTSIMTQINVPARRRIHSSERKSSTISSALEDAEPAMAEPSAAHRAPLSVLPLSMILRSLATTTVSSSPMLLSPSLAIMGALAHSTNPLLNPDRNPILRWFLKNTFYAQFCAGENAAEVRQTIARLKGIGFTGVLLGYAKEVVLSDKQAENLAAGKLGEETEELIRAEIAPWAEGTLETVRLAEPGDFVSLKFTGAGSLALYRLQKRLPATPYLAKSIDTICSLAHERGVRLLFDAEQDILQDGIDDWTMHYAEKYNKDPDHAIIHGTYQAYKKCVPQVLAKHLAAARQGNFTLGVKLVRGAYLGSDPRSCFWDTKEQTDECYNSLASAVLTQQWSPMLPGEGEFPRASLVLATHNAESVRRARAICDAGAVKSEIAFAQLQGMADEVSCELVEASHSPEREAGTTAAMPTYKYLVWGTTGECMKYLLRRAHENKDAVQRTRSGRDAMWAELIRRCKAAVGLA

SEQ ID NO: 2132 - protein, 635 aa, Unknown
  Kingdom: Fungi, Phylum: Ascomycota
MSVPLTIAAPAAAGALAYLNARTQFWYDKRIMSCNLKSRGRILWGIARDRLNLFYYLESRAKSWSTANKVFFWFEGQTWTYAETYDAVLRYGSWMRNELGVQPKDIVAVDFQNSNQFVFIWLGLWSIGARPAFINYNLTGAAVTHCLKTANVKVCIVDPNVAHYVDQDVRAQLPGVRFIDFDSKVEAHVLATSPDRAPDSARAGEEFHSMSSLVFTSGTTGMPKPAIVSWGKCYVGGTYASTLMGRGNDIMYTSMPLYHSSALVLSFTATLISGSTQAIGRKFSTKTFWNEVRASKATNIQYVGETLRYLLAASPQYDPETGECLDRVHSVRQAFGNGLRPDIWNEFKERFGVETIVEFYAATEGPFGTWNISSNDFSRGAMGRYGSFYNWLTGLSTCVIALDEITQEPVRDPKTGFCKKVTPGDPGEAIHKLPPAEIETRFQGYYGNPKATESKLLRDVFAKGDVWFRTGDMVRWDHEGRVYFHDRIGDTFRWKSENVSTAEVSETLGLHESIREANVYGVQLPHHDGRAGCAAIYLKGNATEDTMSNLAKYVKKSLPRYAQPLFLRIVPHIGEDSNQATGTNKQQKHNLREAGVRPDRAKDEELGSLWWLKGGTYVPFKDPDWFELEGGRVKL

SEQ ID NO: 2133 - protein, 691 aa, Unknown
  Kingdom: Fungi, Phylum: Ascomycota
MVGTLNLVDASIGDIQDALSSGALTSVELVARYLRRLATYDCQGLALNAIPILNNDVFAEAAASDKRRRSGQPSRPLEGIPFTVKDSYKVKGMTAASGSPAFKDLVANQDAFTVGAIKAAGGVLLGRTNMPPVAYGGMQRGVYGRAENPYNPKFLAAAWASGSSNGSAVSTASSMATFGMGEETVSSGRSPASNNGLVAYTPSRGWISIRGNWPLYPTCDVVVPHARTMPDLLKVLEVITVEDGTTEGDFWRDQPFIQLERPWRGLPRDEVFAKAGKCTSLKGLRVAIPSMYSGCDAPEGATLVYTHPDVQKLLEKAKQSLEKLGAEVVMVPDFPPVTGYENPDLLPPGCPRLPSDWNWYERGPLVAHGWDKFLRDNGDSNVPDLAAVDEMQIWPHAMRTEAELKYFPPQNAIHWGKLAGYVKEYSFYGIPHLEHALTALEGMRKRLCDDYLQQYDCDCFAFPAQGDVAPEDSDVNPDSAAHAWKNGVWYSNGNRALRHLGIPSVTVPMGLMESKGVPMGLTFAGRAYDDVHLLQWANAFERGTLERTVPRHTPPLPSDLIELKKPAGTRHEAPTISIQRIEAVLQETEGRLRVAIEGTLDTECEHERNDGADPILNITVNGQDCPQDKVEITREGDAGPFTFTAITEAAMSTQRSKRDETVVPVARDKTMVVVVARWSEDGYPAGHVALV

SEQ ID NO: 2134 - protein, 230 aa, Unknown
  Kingdom: Fungi, Phylum: Ascomycota
MGVYVTNLTEGDIPAAVKVVQEAFAEDPYSRWVFDRSKFNPKRNAASLGMRMRWGIRNGIFHAAKDTETHEVLGVAMWLKPQPADAPQPWSDWYEGWKLYFNQVLMNLWYGRGGLITKRYWIWKAAQAGIQSEIWDDPRGYYFLNIMVVHPKAQGRGVGAKMMREVTQEADSKGMKCYLESSRDVPNVAIYERLGFRLVKDMICDDDGDKIRLFTMIREPHAGPPEKTSS

SEQ ID NO: 2135 - protein, 551 aa, Unknown
  Kingdom: Fungi, Phylum: Ascomycota
MAHIFDVAPLVDSGYVNGRKVDNRVKYPSSAAFSGFNKPCRFEGDIFDLEVDGQIPPEINGTFYRVQPDHRFPPVFEDDIHFNGDGNITAIRIQNGHADYKQRYVQTDRYIAETAARKSLFGRYRNPFTDSDLVKAVIRTAANTNITFWRGMLLATKEDGPPYAMDPISLETIGRYDFEGQVQSPTFTAHPKFDPETGEMICFAYEAGGNGNDGSRRIAVWTINADGVKTEEAWYDAPFCGMIHDCGISKNYVVLPMTPLKCSPERLQKGGNHWAWDPKEDQWYGLVPRRGGKPEDIIWYRSTNAFHGHVAGCYEDEQGKVVFDLTVADGNVFFFFPPEDHPVGTVAKRNILKSPTQRWVFDPKSPSDSWVEPSVTWDTSGEFSRIDDRYVTKKYNHFWQAKIDPTREYDGAKCGSPAGGLFNCMAHYTWNPKSEDVYWAGPRATFQEPSFIPKDDGGEGEGWLIALLNHLDILRNDVVIFDARNLAKGPVATIHLPMKLRLGLHGNFVDQREIEAWQARRKADGEVGPVKPAETPLPWQMEMLDSSAVAG

SEQ ID NO: 2136 - protein, 602 aa, Unknown
  Kingdom: Fungi, Phylum: Ascomycota
MGSLTWSRENGWCDDKVWWKEATFYQVYPASFKDSNNDGWGDLPGLISKIDYLHDLGVDVVWVSPIFDSPQKDMGYDVSDYQAIYAPYGSVEDVDQLMEECHRRGMKVILDLVVNHTSSEHPWFKASRASKDNSKRDWYIWKPARYDSNGVRHPPTNWRGYFASSTWTWDETTQEYYLHLYAADQPDLNWDNAECREAIYEDTMRFWLDRGVDGFRIDTVNKYSKRRDFVDAPVTDPTSPHQPAPEMWCNGPRIHEFIHEMNRKVLAPYNAVSVGELSLTPHPSQVVPYVSASAQELDMVFEFSLIRLGNGDGFGSKYIYKPFPLSKLKQMTDTWQTFIDGTDAWTTVFCENHDNGRAVSRFGDTSSREMWLRSAKAIALWQTALTGTLFLYQGQEIGMTNVPETWDISEYKDVESRNYYAEALEAGDEARVQATMHGLQILARDHSRIPFQWDSSDHAGFTGKEAVPWMRVHDDFASINVAAQVDDPNSVLSFYKETLKMRKAYKDLFIYGRFQLLEPNNEHVFAFVKHSTQNERGQEHRKALVVLNMSAEPRPMPDVAKSGWSFSGSRLQMGNLASTQDYKVSNLALQAWEARVYIQDVK

SEQ ID NO: 2137 - protein, 549 aa, Unknown
  Kingdom: Fungi, Phylum: Ascomycota
MRLSIGTVSALLGGTTALANIPSDDPPRVRNIAIIGAGAAGSSAAYHLNQLSSSSLPLNITIFEKSPVIGGRTLTLPVHDSPLLPVEVGASIFVSANAILVNATRDFGLQTSRLGDASVTGLDGDEITAIWDGESFVFQTRSGDKWWWEAVKMVWKYGTSPYYAVKLVEKTVNTFLQLYEEPMFPFRSLTESAMELGLNQVTGVTGEQFLEANKVDAHMQQIDKSFSRHIIQAATRVNYASNLAYIHGLETMVSFATDGAVAVEGGNWQIFDGMVSRSGAHVQLNTTVTTVDLVRDPQEKTSPSAQYTVDTKGTASSDVRGEKYPVAFDSVIMASPWQFSQVRADPSVVRDRVDPVPYTRLHVTLFTSPLRLRPGFFGLRPTDRSPSSVYTTLRKDEIPRAGKDGVGDTGFYSISTLRKIINPHTGAEEYLYKIFSAEAVTASFLSDLFGADMPKSFTSETITWHHAHVFDAYPIELPRVTFQDPVIGEKVYYTSGMESFISCMETMALMGKNVARLAVEDLAKEEDAEWVVVGKDDVGEAMAGPPDEL

SEQ ID NO: 2138 - protein, 126 aa, Unknown
  Kingdom: Fungi, Phylum: Ascomycota
MGKNDKKGGEKAAAKGKSGGDKEAGGSKAKGAQSINVRHILCEKHAKKEEALAKLHEGVKFDEVARNYSEDKARQGGSLGWKSKGSLDPKFEEIAFALEPSTTSSPKIGEAKTGFGYHIIMVEGRK

SEQ ID NO: 2139 - protein, 555 aa, Unknown
  Kingdom: Fungi, Phylum: Ascomycota
MGIFSLATSLLAFGSAIQAASLPERTNGKSARLSPSAQNLFDYSMSVSDSRYDSSYNYIWYQDNGQWSTRFTSWYLPGLLHRGKPADIKNAIASIEAVLATQMNEDFNSPWYGTFKLSPDEPYPTANGPLYPPSIYGSYDPNWREFVGTQLIQVVEEFEHLLPNSLVTRIENALEAAAVGGMRRNGTFPLGDNLILGYSNPSIMRCLTTGWAGKRKNNTVLTAFAEEQGKDILKLFQRDQNALAEYNAPNYYGIDIWALAANIAYGPADAPMTTNAKTILQDMWDDIAAHYNPYLGNMVGPYDRAYSRDATTHSQILSIIVWGVYGREYFGQPPLGEADLLYDIAQGAALALVMDVIAPTISKNAASIIKAKGKWKGSRFIKKTIYEDLTSDNARVATSWLTSELTIGGQTVKETVNRGNQYVPALVQWAADPSHTPYPYMGFFSLYPSASTLDAVASKNRLTVSYPNTTQDGTNIFTFALTGIPPSWTLGGKNTVTGLEKLPCLDVKVTAPGLEKQDVVYGATLRDHWIYNISYVVPETFKGIPQVTLDMKYTC

SEQ ID NO: 2140 - protein, 183 aa, Unknown
  Kingdom: Fungi, Phylum: Ascomycota
MMDMGSSTVAMPIPTTATDSSSMPMSSSTDMTMTMVFFTSTTTPLWSHSFTPESTGQYAGVCIFLIAFAIIFRLLVALRFNIFRVLAALERRRQGGGPLLSPYTAGAGKGATSCAGSDGGPRRPWRAGDTMMTASLDMVIAGLSYLLMLAVMTMNVGYFLSILAGVFVGSVVCGHWTGSIIAH

SEQ ID NO: 2141 - protein, 1180 aa, Unknown
  Kingdom: Fungi, Phylum: Ascomycota
MERSRGVPDQELFLSNPAPANEEGGDSPTVEPLRIFKPQSPANSGTSSGHRYPTPPSAFQQSFPLPPGASSSAAPLPFPDDDEIHKPTPAAPYGASYNIALSPRLDTATGEKKPGLAERRGAAPKPIHSPTSPDGDQGLFARPLQEHARPGSNPSYPDYQKKTYYPPPGAAAQPASSSNTSLHAPDALDSQGGAGVNRFASTASVSTTRASRGSPPPPETPIVEPGQAPGAGAGGIEARYAASGISGTATLNSLQAHQVQSAAASQRLAQYNNQRPPQRPWTPTESPGQAPSGPPTVYQGANPVSSPPPTRTTFSPPPQQPAQGQNGTGEQVSVLEQDLQGLSTNDPPPAYSSVNPGNKSSYPNEKQRPQQAAASNSSTPANNATPTPAKPAAAPIPAAAAAQQHPGHPAFANEGQSSDQGSQGSQPTPVPSTPSMQAPAIASPPPLPEGWIAHLDQNSGQYYYIHLATQATQWEFPKGPNPIAHEQAPLSPAASTYGNPLASPMLGGKQPMASPMYPPHTPGYAESIMSVAASQAPSTSGFTGPPPSAGVDMYRIQPTNGVYFGPYLRYVNMDMEKGLWLGSILIVTDSPQPPTIHCHLSHDLSPNPRQLQPHVIYTHQRWSFHKYDMDLPMSEAGTERWTYAVTSHMGCTRYEFAVAGRYETSWRFIAHSGNDFAGGTSQNERARLGGVGFMWKDVLQKNVDCGGFHVQLGLGDQIYGDRLWKEVPLLKQWLAMSGRENKKNVQWTARHEEDVAHAYFHYYTSHFDQPFLREAFAQIPHILQIDDHDIFDGYGSYPEYMQSSPVFKNIGRIATEMYLLFQHHTTVEILRNVSTDHDIFTVTGTGWHFVKYLGPAMVVVGPDCRSERTQARVMAGPTYQGIFPKIATLPPSVQHCIWMISVPIIYPRLEAVESIANTVAAGKKAVNTTYNILGKVTSSVAGVVGGKEVVAQGFSQVKKAVGKTGLMGNVLNQFGELDIQEVLKDMWTHDTKDLERTYLIRTLQGISQQKGLRMTFLSGDVNASGAGLFHDPTHPGDHKTMYQIISSPIVSAPQSNHMLKLLHNQKTLYVPRNGDKSNHEPSDTKEDMMEIFHTDASGGSRELKKLMGRRTYAAIVSYDPDAAAQNQPPFSPNPSISSGGQGQGLSKLSLAVDFVVQGDGPYMATTKYGPVIIPHLEFGR

SEQ ID NO: 2142 - protein, 223 aa, Unknown
  Kingdom: Fungi, Phylum: Ascomycota
MSSEPRIATLDASNYARLPPHCAALFEAKQSKGLSFEAIANHLERSEVACAALFYGQTTASEEDIERLSKLLELPQEVLTSAMSGFPDRGRAGPMPPVEPLIYRLYEIVQNYGYAYKAILNEKFGDGIMSAICFSTKVEKEVDEAGSPWVVITLKGKCLITPTFRMPSKTNTNNTSAQSPGYPLGCSVMAKPQGQSPGYPLGCNVMAKPQGQSPGYPLGCTIM

SEQ ID NO: 2143 - protein, 426 aa, Unknown
  Kingdom: Fungi, Phylum: Ascomycota
MFFVLYRRCSKDRQLWLSTRRGRYDEATPNKQVFNNLHLDAEQCETAFPGLMKEIDDEVARGPLEVQFQSGVILQARIENNQLFVLRSPHKNDLSQAMRHRQLSTLHQLHRSLLTSPSPLPNTTLSLSAHDVSSASTIAFARPLVSPSDKRILPMPHFSFWSWPLPFIGSIPSAARRIAEIEEASGGFGNKDGKAVWRGTSWFNNGAGASPRGRQDLLRIAKGKSWADVEALQWEVNSEDASNALRIEDFCKRKYIIHTEGFGYSGRLQFHQLCASVVLSPPLEWMQHTSHLIRPVFSSMLLSNGRQAGAMPKWEQRARTGWTEVYTTDEANMVFVRPDWEDLEEVISWLEANPGVAEGIAKRQRETFEERGYLSPAAEVCYWRALIRGWAEISRPTGDGWETRGQLYEEFVTVKQVDKEAIADAD

SEQ ID NO: 2144 - protein, 332 aa, Unknown
  Kingdom: Fungi, Phylum: Ascomycota
MKVAAFSATLAAAGTLASAAVLPAFKTPKNCDKPSKRIEWRQLKAEDQQGYLDSVLCLKTKPSRRGLNSTLYDDFAHVHFELNTYIHGGPPFLPWHRYFGKVYEDALRACGYDGPGTYWDWTLDSAGLRFSPVMADTLGFGGNGSPDNTEPSPDPGARPLRCVSSGPFMDLRPEYLAVTPKEMVPGGHCLYRDLPEVSEPRAFETMAEVFGPEGVARTLASGNWTHFHAALEGGPHGMIHACLGGEMNPTTSPNEPLFFLHHAQIDRLWWMWQRGGEGEDRLKEYSGQALHSGEEGSRAVSLDDWLLMGDLAEDVKVADVMDTRGERLCFEY

SEQ ID NO: 2145 - protein, 1321 aa, Unknown
  Kingdom: Fungi, Phylum: Ascomycota
MAADSVSEHHQQPASHQSPRQRGRASGKQAVGREEVDGTWIAQETNGESPRPGASHGPPPPACRRPLQLGQPRHLRRPEQLPTRAEVPRSTPAGHLWQPRRSRPPLCPVAAALKLAGPSITEHLLGQSATSRTAAPRTQDPTLPDLSPNGRPSLEIPPVMSGTMRGTPNRNQSRGAIPFANSPAGGSSIPRPVLDSQPSETSSSVSASRQKQSKRDEAIRRKLENDLSKKKHLTNRARHTRKAPPGTVLALKPSPALQIKPATTVSEAAQLMAAKREDCVLVTDDDDRIAGIFTAKDLAFRVVGAGQKAANVTIAEIMTKNPLCARTDTSATDALDLMVRKGFRHLPVMDENQDISGVLDITKCFYDAMEKLERAYSSSRKLYDALEGVHSELGSTQPQQIIQYVEALRSKMSGPTLESVLNGIPPTTVSVRTSVKEAAALMKENHTTAVLVQDQGAITGIFTSKDVVLRVIAPGLDPANCSVVRVMTPHPDFAPMDMTIQAALRKMHDGHYLNLPVMNDGGEIVGMVDVLKLTYATLEQINTMSSGDGEGPAWNKFWLSIDHETESMMSGDGSQSHHHTNLGSRVMSPDVTRDRLGDSVAPGDSASHAGAESPPRSIAPDTPEIVSPAETPFPFKFKAPSGRVHRLQVTAAQGMEAFVAAVASKLGNEVDGIGGAPVVEDGKMSGAGFALSYMDDEGDTVSITTDNDLLEAIVLARQRHREKVDLFVHDPEKPPVAPAPVPEPVAIPTPPTSTASGLRERRRARDDDDEEDEDEEEEELATGRRTRRSRSSQVQEQLIAGVPNDLLLPGAIVTLAVVICGRVKVQLHPCAGWSGTQADLKFGDSTTSDNAFPKAGIGRRDDNKKCRSRRALAPAVTRCALRQLSTETKTDNSTNAANQAWPTPQAAVAPPKLSTSSKKKKQKIVQEVIMSLGADSSQEHQGAAWTKPHQVGSEVMTPAQQFAEFQRIQKNTRSLGSRVERRYVPTELISNPPAPEDVTLELLMASQTHMGHNTSLWNPANSRYIYGVRQGIHVISLETTAAHLRRAARVVEEVAYRGGVTLFVGTRKGQMEIVTKAAEMAGACHLFTKWTPGAITNRDVILKTQGTKVVDHLDGELDGFDMYKGMARPLLPDLVVCLNPLENYTMLYECGLKNIPTIGVIDTNVDPSWVTYTIPANDDSLRAMAVVAGVLGRAGEKGQKRRLADAARGSVSWSTSPELTRHMKKEVQAAVLKRKEVMGRMQSDIQGFTEEEQNILRSQYKGVELDVTEDEMVQMMGEAVDAPPARQAEIKADPRLDEIEAQLHGVREKTADIEAAVKGDQ

SEQ ID NO: 2146 - protein, 678 aa, Unknown
  Kingdom: Fungi, Phylum: Ascomycota
MLDTFEVITTSGVVLWSRTYAPINPSLINNFIADTFIEEKSGSTAFREDQSASANPAYKSDQHTLKWTLVKELGVIFVAVYRSLLHLTWVDKLVDNIKTIFVSLYSDQLQKPHTTLIECHNFDDYFEQQIQELDSSGAAARHAPSVVTHGNRPIEEETISGNLGDDPPLPPGMTYRGRHINGGAANAVTTSNDSTPIQTPTTSRPSTPGGNLVTAKGGPVAKMSRRARKVQNAHSSSVPASSGDESAPASRKKASKTTKKGRKWDADGYADEDDDVQLDYSRANITSDSDADGSPVVARSSAVDPIDAASWGKTTKGKFVLKDLGDEVHNMLATAEAEKAAASASAADSRSSGLLGTGVSALSGLFRNVVGGRTLTKEDLDKAMKGMEEHLLRKNVAREAAVRLCEGVEKELLGVKTGNFESIQTRIQSAMEASLTKMLTPTSSLDLLREIDAITSPSATSLRQARPYVMSIVGVNGVGKSTNLSKICFFLLQNKYRVLIAAGDTFRSGAVEQLAVHVRNLKELTEREGGRVELYQKGYGKDAATVAKDAVAHAAQEGFDVVLIDTAGRRHNDQRLMSSLEKFAKFAQPDKILMVGEALVGTDSVAQARNFNAAFGSVRTLDGFIISKCDTVGDMVGTLVSLVHATNVPVLFVGVGQHYSDLRNFSVKWAVEKLLSNA

SEQ ID NO: 2147 - protein, 603 aa, Unknown
  Kingdom: Fungi, Phylum: Ascomycota
MHFSNILPAVAGLAGLASATFLPPTVPVVSDLVKGSDRVVKPVCDLAHHWEDDILFKGDVSADVSLNLRLVQAEVSGEVGIDCSSKFLQAPSLRLSLAGVKAYVQLDLSASASIYESVELFATPELKVDLLDILNIDLKALFALDLVVGVSAAIDVTAGVYVSFTEDAYIDIDLVKRDVLDVNLANPVIEALPIALGADVDLAAAVDLSIGLRLRSYIALEADVSVVGIDLLDAGAEVAIYVNLFDYTTTLIDGSNNCVVSGATDIALTLGLAVHLDVSVLDLIDLSLTPNVFVTLATAAKIDICLPSRGDYPCDGGSDGGNNGGNNGGNNGGNGGNGGGNGGIPTPIVPVTPIVPVTPVVPVTPIVPPTPIVSVTGAPPITPAPAPTSAPVHGGNGTIHTSTESITTTYTITKCNIDVLNCPADKKTIIVYSTVYKCPATKTKVPQIPEITETHVLTPCPTPTTVTVTAPVNPTGVPGKPSQPAQPSQPAQPSQPQQPSQPEQPSQPEQPSQPAQPSQPQQPSQPAQPQQPSQPEQPSKPAQPVCPGSPECPSETVVQPPPAQTEVVTPPVSTPTTPAEAGAGSLSVGMASVCLGAFIAVLF

SEQ ID NO: 2148 - protein, 2373 aa, Unknown
  Kingdom: Fungi, Phylum: Ascomycota
MSRAPPPPPPGWGPPPPPPPPPSSSIPPPPSGAAPPAPPPPGFLPHADPQIAKFAQKKKEWIRQQRNRFGEKRKAGFVQTQKADMPPEHLRKIVKDIGDVSQKKYTNDKRSYLGALKFMPHAVMKLLENMPMPWESAREVKVLYHVNGCLTLVNEIPRVIEPVFFAQWAMMWTFMRKEKADRRLFKRMRFPPFDDEEPPLSWSENIEEVEPLEPIQMELNEEEDEAIYEWFYDHRPLLDTSHVNGPSYKTWNLTLPQMAALFRLSRPLVSEVFDKNYFYLFDLKSFLTAKALNVALPGGPRFEPLYKDIDPNDEDFGEFNAIDRIIFRDPIRTELRVAYPFLYNSLPRSVHLSWHSYPQVVFKRAEDPDLPTFHFGRDINPVSSRTVAPKNVDVSHEDELFGPGNNEEAEGEEFELPADVEPFLDEEELENEDTSSAIDLWWAPYPFNRRSGRMVRAQDVPLVKQWYLEHPPTDKPPVKVRVSYQKLLKNFVLNELHTKPPKAHNKQNLLRSLKQTKFFQQTSIDWVEAGLQVCRQGFNMLNLLIHRKNLTYLHLDYNFNLKPVKTLTTKERKKSRFGNAFHLMREILRLTKLIVDAQVQYRLGNIDAFQLADGILYAFNHVGQLTGMYRYKYKLMHQIRTCKDLKHLIYYRFNSGPVGKGPGCGFWAPAWRVWLFFMRGIIPLLERWLGNLLSRQFEGRHSKGVAKTVTKQRVESHFDLELRASVMADLMDMMPEGIKQSKVNTVLQHLSEAWRCWKSNIPWKVPGLPAPIENIILRYVKSKADWWISVAHYNRERIRRGATVDKTVAKKNVGRLTRLWLKAEQERQHNHMKDGPYVSSEEAVAIYTTTVHWLESRKFSPIPFPSVSYKHDTKILILALERLREAYSVKGRLNQSQREELALIEQAYDNPGTALERIKRFLLTQRAFKEVNIDMNDNYNTINPVYDIEPIEKISDAYLDQYLWYQADQRHLFPAWIKPSDSEVPPLLVYKWAQGINNLSQVWETENGECNVMIETELSKVYEKMELTLLNSLLRLIMDHNLADYITAKNNVQLTYKDMNHVNSYGMIRGLQFSAFVFQYYGLVLDLLLLGPQRASEIAGPPQGPNDFLQFRDAETETRHPIRLYTRYIDKIWVFLRFTAEESRDLIQRFLTEQPDPNFENVIGYKSKKCWPRDARMRLMRHDVNLGRAVFWDLKNRLPRSVTTIEWDDSFVSVYSRDNPNLLFSMCGFEVRILPKMRNKNDEFPVKDSVWSLVDNTTKERTAYAFLQVTEEDINKFNNRIRQILMSSGSTTFTKIANKWNTALIALFTYYREAAVSTVDLLDTIVKCETKIQTRVKIGLNSKMPSRFPPAVFYTPKELGGLGMISGSHILIPASDKRWSKQTDTGVTHYRAGMTHDEETLIPNIFRYIIPWEAEFIDSQRVWTEYSQKREEANQQNRRLTLEDLEDSWDRGLPRINTLFQKDRSTLSFDKGFRARAEFKVYQLMKSNPFWWTSQRHDGKLWNLNAYRTDVIQALGGVETILEHTLFKATGFPSWEGLFWEKASGFEESMKFKKLTNAQRSGLNQIPNRRFTLWWSPTINRANVYVGFQVQLDLTGIFLHGKIPTLKISLIQIFRAHLWQKIHESVVMDLCQVFDQELESLGIETVQKETIHPRKSYKMNSSCADILLFASHKWNVTRPSQLHDTKDVIEPTTTNKFWIDVQLRYGDYDSHDIERYTRAKYLDYTTDSASIYPSATGLMIGIDLAYNLYAAFGMYFPGLKVLVQQAMAKIMKANPALYVLRERIRKGLQLYASESNQEFLNSQNYSELFSQQTQLFIDDTNVYRVTIHKTFEGNLTTKPINGAIFIFNPRTGQLFLKIIHTSVWAGQKRLGQLAKWKTAEEVAALIRSLPVEEQPKQLIVTRKGLLDPLEVQLVDFPNISIRASELQLPFQAAMKVEKLGDMILRATEPQMVLFNLYDEWLKSISSYTAFSRLILILRALHVNPDKTKLILRPDKTVITLDHHIWPSLSDEEWIKVETQLRDLILNDYGKKNSVNVSSLTSSEVRDIILGMEISAPSMQRQQAAEIEKQQQEQQQLTAVTTKTQNVHGEDIIVTTTSQFEQQTFASKTEWRTRALATANLNKRTKNIYISSVDNDMDDMTYVMPNNIIKKFITIADLRVQVAGYLYGASPPDNDQVKEIRCIVMIPQIGGLRNVQLPQQLPQSELLEGLEPLGVIHTVSGNELPYMSAADVTEHARLLDAHEEWNKNNAVTVSVSFMPGSVSMSAWGLTTEGYKWGAENKDTQSDQPQGFTHTMGEKRKMLLSPRFKGFFLVPDDGRWNYSFMGSAFAGMEKKPVHVRLDNPLPFYNDQHRPVHFHSFAELEDIWVDRNDNFD

SEQ ID NO: 2149 - protein, 113 aa, Unknown
  Kingdom: Fungi, Phylum: Ascomycota
MVVKIRLARFGKRNSPFYNIVVAHARTARNSKPLEVIGTYDPIPKPDPYDDSGKLHKDIRIDSARAKYWIGVGAQPTDTAWRLLSMLGILPKKSYGPVEREIKEIPAEGARLR

SEQ ID NO: 2150 - protein, 351 aa, Unknown
  Kingdom: Fungi, Phylum: Ascomycota
MSRPPRLGSPETPGSLSPDFHTPPRQSADNPLPSSPALASPTASLSAGSAYLGSMFTGLIRRFSTENSQLGSQIDTFFMGPPTDQQQREAQQERTAADGINGVFQPPIKRTISPFRPPPLDPLVLANRGGDSPGLLTHEIAEEIRTMIPERLRITEHWKIAYSLEHDGASLSTLYQKCRMFEGKRVGFVLVVKDRDGGTFGAYLSEYPHPAPSYFGNGECFLWRASLLASLPPPPSEDTTFLTRNTQLAPPPRSSPSTLSPDGAAQPSRSPTPSESIRFKAFPYSGLNDFCINCETGFLSVGSGGGHYGLWLDDSLDVGHSSRCETFGNEPLSDEGEKFGVVGVELWVIGA

SEQ ID NO: 2151 - protein, 392 aa, Unknown
  Kingdom: Fungi, Phylum: Ascomycota
MRLSSATLIAFAAGAIGAPADTVKPRQAPGGCSSAVKLDAKTNVWTSYTLHPNAFYRSEVEAAAAQLSGTDAAKALKVADVGTFLWADTIANIDRIEPALQGVPCNHIFGLVVYDLPGRDCAAKASNGELPVGSLNRYKSEYIDKLAALIKKYPNTAFALVIEPDSLPNLVTNADLTTCQQSASGYRDGVAYALRTLNLPNVVQYIDAGHGGWLGWNDNLTPGARELANAYKAAGSPSQLRGFATNVAGWNQWDAEPGEFAGASDAQWNKAQNEKKYVELFGAALASAGMPNHAIVDTGRNGKPGGRLEWGDWCNVVNAGFGIRPSSSTGSTLTDAFVWVKPGGESDGTSDSSAVRYDSFCGKSDAYQPSPEAGQWNQAYFKMLLDNAKPSF

SEQ ID NO: 2152 - protein, 307 aa, Unknown
  Kingdom: Fungi, Phylum: Ascomycota
MGATEAEFEQPSGGALQTAKDLFSGAVGGIAQVLIGQPFDIVKVRLQTTTQYSSALNAATSIYKNEGALAFYKGTLTPLIGIGACVSIQFGAYHQARRFLETRNAAKSPSSSPDLTYPQFFAAGAFAGIANSVLSGPIEHIRIRLQSQPHGAGKLYNGPIDCVRKLGAQAGGVLPAIYRGEVVTIWREAFAYGAWFTSFEYMMNSDARRNGIDRKEIPPYKIAFYGGLAGEVLWLSSYPFDVIKSKMQTDGFGEKQKYKSMRDCFGKTFRAEGMGGFFKGIGPTLLRAMPVSAGTFATVELVMRAIN

SEQ ID NO: 2153 - protein, 219 aa, Unknown
  Kingdom: Fungi, Phylum: Ascomycota
MTNFRITIVSDTMCPWCYIGYRKLQAAQTTWLQKYPNDTFSVRWKPFLLRPDLPRGVSRDKATVYAEKFGADRAPILQAHVAEAGKQVGINFKFGGRLGATRDSHRVIHLAGRLGGESLETKTVEGMFAAYFENEQDLTNLDTLRSIAINAGIPEAEFQKSIVETDDGGAEVDRAVMEARYGNVSGVPDFTIQDKFNFSGAQDPAVILGVLEKVKAQEK

SEQ ID NO: 2154 - protein, 638 aa, Unknown
  Kingdom: Fungi, Phylum: Ascomycota
MMQAQPQHGRKTITRSRAGCAVCKSKRLKCDEARPACSRCKRLGIPCPGYSKQLKWMKSESTPAPAEPGPVSPQPPVLPMAAPPMFDFNESLDPAYTDFSTMHSFQTFPSTIETPTTLNDFTSSSSDLQFTEDLALRSPPSNQPPATQQQDEEWQGVDKSGTWLDSILKNTDTENMAITHRRPSSRRGSRPQDQAQLPSALQDHTSILVEYYFKEVCGMMSCYDSQMNPYRTAISNAWASSPALYYVVQSMAAACLSDVCHEFSAVGRRLLDQSVRLVAEDMKPGQPLTTPTLMALVMLGFSMSWHDAGSLGQAEYELLSKALLSIETQADGTLWPEKQKQVFFYNSLVYWRMLLSFVTDTEPTLPITCKLLPQPEVAKPDAHVPPHPQTGIGIEVQELVAQVGKLVRRERKRIRSRQSASRIDIEQAQAAIRIAEQLQRELCAVTLPSEASVMNSGDDMTPTSHLLQVAEAYRLAGLLQLYRNFPDLLISRLSPSPDMEAVADSWLTRLALHINDMVQDIPITSRSKSIQPLLLVCICSELSLHRKMYSLAAFQSPAVSVTTSPRFLTTLTPSITDVLHARRTSMARLSFFKNMLAAKPIQQMMTLVQETWAYMDRTRTEIYWMDVMLEKGYETLMG

SEQ ID NO: 2155 - protein, 2087 aa, Unknown
  Kingdom: Fungi, Phylum: Ascomycota
MSSPETAQALVAVFAFGNIVNAATTSLFQFIKDHGWQSFRDGPRLVLVVFLVGAALWAQVDFIAIMMPGSAMPGCQIATSFASAFDQIARVSLLQFLLWGAQNGNKTTAQTLLFQGFVFVRFLLGGVVVGTARPQFGSEFCVSTSLVMPFSIAVIVIDCAMAFFLLVKVFTQGSFQAATEGSHSVMRRKVLVIAIIAFAIWTALSAPMLLGYESMVLITRTFLPAIGLGIVLGVISFNQAQLSFVPQRATSEEQGGPFPGDATRHARDPGTQDSGYSTDNYAPPNRYEEIKGETVVSINAFGQNSRPVRAYNQTKAPSLSQIGRPHLQQGPDGISFDAQSTFAPSRQAPAPNQGQKDSKAQRSLSKKGGKIQISAPLLVAPAETGQNPLDRIATIDLATAARHEKERRELPAQPLASNLLAAHYGSKGPLSPNSMMKNPGSVKRKQIAPSPSDQSVPAEPLLDPAEMVTTTSSQLSPGVEELRRRSPRHAPEGPLSNNDASSPRVPVKSPARRSQHIMSALTASDSKTRPSSTLPLTPPPKSPKRPQPPLSPFGRTADYEAQTSTLPVERGTVKVVIKPTPKAGNLESPAVPPKDIVAATVRPMNGLPRNPRMAAAKRFIPQQKTPKEQTVMLIKDIEYDDPDTVRDIVQGAATKPAAKRVASVVNRPRPIPRQSTLDRQIFPAEGSPSPNSRHAHKRSLSGGSAISRKSILQSMPTSPSQLPPLPPVPQTAGQPGRPLPNNTRSMTFDEKMVIFYPDASAGDQPAKEMRRRSSSVPELPELPAAFRERSRSRSQSRDLRDSMHHTDKSSRSSIRTASLLDFPEVPTQRPKVPPVSKFSVDTTVGEGMIWAMSTKSKFDGYKRQSSPVLPAEALRSPSNGSELKSHDDDTTTLWGSIHSPVKCTVMQKAMAVEVPPVPKIRPCPKTEDEAEKRTTKDASERGHESHVLMTVVLDTSNQGSPFSKPPSSEAVERVLEADPRPVSWHRRIGDECPMFSGRQDSVKRRKNPPPAPLPLNRTTDRRPRLVAAPEPSPLEAPEQALRAIQEQLRKFEDPNRESTGSQQLQRMTLLANLEAEMGMHENQWQKMQSRLDRDSFSTTAGSPHKRESRPDSLAVSIVAQADDHSQRPERRTSRPSIRLSKNKRTASIASSRSNSSLDNEHEWDEDLAEAQAEYLKHRFQLVSHLSERTTSMLVASPKKASQPELPITRSSPDERVPEQTTVKLWQPPKSQSSTFIDSTPSLWIGVPSSVNASLPIAKQPETLRRTLNRACEPLAVESDRLWQKKQKRGSFGPQKGLWASKQVVRPISTTSVSDMKPQASAAPSKTLARKPSRRSKRVTLLPDILENPEPMPDKRGTLAIYQFPWGEKSDSASIRPRPQMLMAMPGTMTSGRSTQLPLQQQQQQQPVPQLTNPFAFDADNYSASYFDDEDEGDNFPEAQALSDEEDRYDEQEDDSDDFDETTLWEIASLLKSNQVPSRQSLLPEDWRLNVESAQVNYSDPTKISQVDSNRSAFEQDVVPDAQSDASSLYEEETEASPALWTGQKTYVPNNGSITLPNPEEQEWHEYAATMPAPVRAATRSAQPDTVSSESLWMAEPETTIPVNDDSMWQPKMAERVVAALWTQKPQVNETPKGIDNPTEETWAAYQIDLTNVVRAATRSSGPSAIESTSLWQAKNSAPVAGNLWVQQTSVPQQPKGIANPSRDSWAVYNVDMKDTVRAPTRPSQTSTIQSDSMWKLTSSVKQASADGLWMSQAFKAPPTQLWSAPAPEKLQPATGLAQPPTPSWANYTTTGLSPVRAKPRLENVVDPTLELTSSDLWGAAHASPVREDWISLSTVRARSPSTSSVESAASDASSIKSTTTKASTVGSIFSAFWRRKRGVSDATTEESVPEVPEVPVLPIVEETQPEPAVVQFVEQPAAKAPSALPLRRQYRPNIVFRADWDAALQEAILASNPSPPRLSRPTAQPSDWADALTAALPQHSSSSQEASPTTQLWTSAPPKSPLPTTASLWVSHLSRAPRAAFPADCSVLPSPSRRGRSGSLLQDGVVSSADAGLEVPEGLTEQSLWRRSVAMQKAEIRTRDWLVGGSD

SEQ ID NO: 2156 - protein, 593 aa, Unknown
  Kingdom: Fungi, Phylum: Ascomycota
MARRRKAQRIVSSDDESDASPKPEPSASSSQSDEESDEGNPFIDRDALEEDDDDASTGSEDSDGPGPTFHLFNQLPPELRDKIWDFFCPELTVSTRVLRMGLELDDDEATGHFWEGTHLEAMTETFRCLSSVHRESRQRALKFAPDEIMLGGHSPDAVIRVNGAKDILCLEFIHYSPRIEHSSQWQPKCGGPVQRIAIMSRDIEGMRNFGGIKPFQSLFPELKTVYNMSEEISLNDRWLRWCVSDYAQSYYHERLEDVDPVPQILPMLLAFPDTDRHPDFAKYSLGGLARNRCSQTTVDEIEDSGLTLLPMVSFPYLAGLERFEKLEESKNVPLPQLPPDWPSDAEEEALAADADEDGYESDGINDEELSEDDLSSEDELIPRPISPGSDADSHISIDSSSDNEAPAANLSSVEPSEDEDEAQTAANTNTKRKRRVVSDSDDEADDDDKLAEPAAQTQRKRRRVARTLQSDSETETGDIEAAPRTTARDGSDDEEISPSSESSSEEEEAPPKRLSLAQRLRQEQQQHTRRRTRAHESGSEDEEDGSDESSEDDDEDEDERPRRGGAFFLNEASEEDEDEDGDGDEDEYDSEME

SEQ ID NO: 2157 - protein, 902 aa, Unknown
  Kingdom: Fungi, Phylum: Ascomycota
MTLAMTTCLIDALFFPASTRRTHRGARVSPTRRPPEIQTHDFQVLADRPPRAPTPRDPLPSVAVPTRIASAAVAWPNMDLNSAPPSPPASLTPTGEQTNKPSTASSTVNNTHHDNDPSLANSGSHPPHLTNLDVSIVSPSSANPAHPYSTSPDRRPKKSSSTCTTCRARKVRCNDSAAWNVALPRRRVKQACQSCHSRKARCSGHIPSCDRCRAQGLECVYRPTKRARVSRSGASVGGVSQRQSPESQDEHMDDAHNDSDPGLTDPGSTTTPTAYHQDVPGPHGSFDSLISSTFEKFFRHVHHIPMYSFLHRASLMEQYHAGKVDRPLLLALIGITSCLTDMGSGMREYGDRCIEEAEQLIFSDFARPSTMKIQALVFMIKHRILSHRFPSAFFLLGLASRYAASLRLNYESPNLCFLAQESRRRLMWSLYCIDAGVSGGFPDFSLWNGDAIHVTLPCNERNFEFDLPQPAEMLVPESTSSPQAEDVGSNALHIRIQHIRKKVSEFTKSVLRTKDMHAARMQTRVLTLHQELDDFASQLPASFQFSEASLRLRAYSPRLCVYVMIHLWWRQCHCDLYRIGLVGLREALPRTVLDNLPESFLEHCQRQCVDHATAIANIFSSTQKLHAKMAADLDLALCAYQAARILTYAYHTNAEKFDLSADGVLERTNVCLQAIREYCAGKAANGVKSDLEKLVAQGIGSRASSSSRSGSPAVQNGKIGGHVRGNSSRNLVRNVRGSNGVGPLGISSLPPAIISDPWSSDNQFSQPDPLQPIQDIQVHRGNGPSKVISSNGGGNPVASAQTASADLSQAVQDHNQQAQSGAVPQQQQQQQQQEQQRQHSSQATPGSVAPQVTELNNAYEGALEGLGLDNGLEYAMGVDMNMWVPGNGDWITPEFMNGGVGL

SEQ ID NO: 2158 - protein, 328 aa, Unknown
  Kingdom: Fungi, Phylum: Ascomycota
MADTADAGAGGSLFETTKANAAAAYNSVTSGPVAQNVQEHAQKTGDEFSNLAASRRTPANPAATGQPLTHYHSFFSELLSWKNPRASAIAYAGIVTLIFAARYLDILRWGFKLSSWTLFAAVAAEATGKFVLNTGLTSQVRPRRYYTVSRETLDGAIGDVHELINFFVIEAQRIVFVENIWASAAACVTAYLSYHLVKLVPYWGLTLIATTMAFFLPLVYTSNQELIDEQLRNASEVINAQTAQVQGVVQKQAEHVSSLTKQYAGDYTGKVQEMLRGKGSNPAPTTETITKEYVPKESTFPTAPVDEPIADKAPEIPAVPEEEPLIAT

SEQ ID NO: 2159 - protein, 335 aa, Unknown
  Kingdom: Fungi, Phylum: Ascomycota
MERFRNLLGGGGMGLGGAAHGSDNSSLVDNSETVYISSLALLKMLRHGRAGVPMEVMGLMLGEFVDDFTVKVMDVFAMPQSGTGVSVEAVDPVFQTKMMDMLRQTGRPESVVGWYHSHPGFGCWLSSVDINTQQSFEQLNPRAVAVVVDPIQSVKGKVVIDAFRLINPQLLMMGQEPRQSTSNLGHLNKPSIQALIHGLNRHYYSIGIDYRKTALEENMLMNLHKHVWTEALEMDDFRTEGVKNKDRLEQLVSLADGYEKRVIEETELTKEQLKTRYVGKVDPKKHLEDVGQKIIEDNIVSVSRQMIDKEATVMTKKDQSNGQAKGEQMDVEEEL

SEQ ID NO: 2160 - protein, 370 aa, Unknown
  Kingdom: Fungi, Phylum: Ascomycota
MSFTEIPLLDLSLADDPATKPEFLKQLRHALLEVGFLYLKNVGIPDELFEKVIKQGIAFFDLPTEEKLRIEMKNAPSFLGYSRLSAEITAGAVDHREQIDLSTEHPLPKPSDPISHNLLAPNQWPSESYLPGFRAAYTEYMNLMGAVSICFTSLIAEAIDLPPTAFEKYFDEDQQHKLKIVKYPDRGQLTGEGTSQGVGPHKDSMLTSYLLQASPHRGLQVQNVKGEWIDCPPTPGTLVVAIGQGLEALTQGVCVSTTHRVLSPEAGAGPRFSIPFFQGVKLDAEFDDLESVGVGAVPEEVKEQRRKVVEKAGGKRLDDVEFTFRTGGAAKTLGEATLRNRVKSHPDVGERWYPDILRSIREEQARVAAQ

SEQ ID NO: 2161 - protein, 104 aa, Unknown
  Kingdom: Fungi, Phylum: Ascomycota
MSEAQIAGGHKANINNPNTSEESKQHSKQVLENEFNGGDGTTALSPAFELMCMTDNVYKVPSADDNKEKNPNNVAGGLKATVNNPKVSEEAKESAKERLQQMES

SEQ ID NO: 2162 - protein, 1113 aa, Unknown
  Kingdom: Fungi, Phylum: Ascomycota
MGNTPSQEAPRASSRKLSKPKVAGRDGPKSRASPSAPASDLAIPHIKVAQFSNSYLVGTVPISASQRTSFDILSPGPATAVFHENPLADPANRDSTTTTSEPKSPKQIAANELSRAERIERRRSTGHGSVNGGIPLPRAPSTPGNRHSVQGVTRTPSVQTTRTLTGTRDVASSIEDPIPRSQSLVERRASLHSRSNSRGGESQDAVCNLRRNSSTPQPELVPPHRTRSETSLYPPHRRRSLIMTPGIATRAETPKLRRKASFRRSVEPTEPVSTGESVDSKSSRHMSLPVLPSKSEMADRAPTPTEAEYKQLGGMVFGTLRITNGAPSPSPGQEPGEVDFYTAKATSTGQMETPGKQSLLAVTHSEWDGLEMQGKRRHPQLTIEPASSRSSLLPKAPSVVNPEGQPLPPSPLSPRASTYCSAMTPQLPVTVRPPTPELQITSKHAAIDDQLFEEEEEENSRRPESAEADLQVIEVAQEFNVGLKSPTRPNLVDVSRKDSGYVSNTSQSSRKTLSTVDSGYSSNVSVRSVRQKHNMADAPDYISWGSATGKQSDSSPGGNMFSGGENPLRIEGTPTPPEERLQPSISSKDDNSMSTPRTSTSSASHSIIRLPSFRSGKSREQKQIRRSPSQDRPKTSGSLLQRVTSPVGASNTGTRMSGLRRLLSGGSRKGLATSYAVHEFDTAVPSVPTAIEEKLQGHSARFPTAPKRLALRAEPSKDSLGTILSVEDPSETVSVERSPLPQNALQPNLESHDHTKSVSLTRLERRKSARLSVSSVHGSITGAATSILLPKSVPNPRNIIRRRSTMDDRIQRTSRNRGEFDFDDDVLIDNSVVGEQDFMVPNLRQTAGNSAFDQALLGISDHGRYPVPENQSWMREPYVDPKATRRHPQLRSQKSAPDVRQTMAGHLSPVFERDSVKMTSRTPPPISLQTRGSKKKRGGPKNNRRQSTPGGMAQYRPKMPRDPYDSQSSVPSSSEDLSHYSYAAPPPPMPAGPYPQAAPLPPSAHWNSPSPKTRRPLFGQRYSFDGQGYRPPSMHQQKSALAPMPSREQNEDHWMPNRQFHGRQQSYGSQSDSDHYQHRRPSSNRISVDGQNAPFRVLHSYNSPAYKDIPIWG

SEQ ID NO: 2163 - protein, 121 aa, Unknown
  Kingdom: Fungi, Phylum: Ascomycota
MALEAVYHKDRFTASNLDTSLPYISGPFGRPSLFTHQVGHYDPKHKTEIANKLGEIGTRLPVKLIWGRDDGWQVHDWAEKLHGAIEGSELDFLEECGHFSLEDQPERIRDLVVDFIRRRGS

SEQ ID NO: 2164 - protein, 751 aa, Unknown
  Kingdom: Fungi, Phylum: Ascomycota
MAVGHFAKNNPGALGELQQNQQEAAPRSPRKAKDDIAHDRGRSQSPIKSSKFPLSSDVASKAKSRDNSPIKQKKSGTGLAGLLSRPKSLKNMYKLSTEEAQLVKDKENKEPQIAGPPPIYAQFASDRSWQNTSAERSSIEDVRSPDMVPPQARPGFKERPKSFQVPIVSNNSSSTSLSPSKGTSEQHSGKGSSEKTASKTQRGRVMNALGNFTHKRTKSEMPSPAAAPTEPTLDPKDIDKHLEAMLDRRNIPENQRYKMRNLNDTIKMEFIRQDWAEMQAVKADRPGTNDSFKSVDNMAIDSDAEDDKDKPKRTRGRSFTFSRGKKDSSSAKKSKGEGTLGRHFRSRSTDSVASENPSSSASSPSNGILSKIKLQQGPSEYVGYLRKVQKPELVEVGKLHKLRLLLRNETVAWIEDFIQQGGMREIVGLLERIMDVEWREEHEDALLHENLLCLKALSTTARGMQYLDTIQGTLFPKLLGMLFDPERKGPSEFTTRNIITSVLFAYIQSAPITERTTRAQRVLSYLRDPEPKEDERPLPWVMEMRQDRPYRVWCKEIVSVTKEVFWIFLHNLNVVALPSDKGYTPIATGTALPPGNDQTSYMTQNFPHERPPVPAAPYVGGVEWDATNYLASHLDLMNAILACTPEKDQRNRLRGEFRISGIERCMGGSLRLCKEKFYGSVHDGLRTWVKAAAEDNWPIKDVRYGPPPEARASPKKQGGGQKKPVENAPKIEIPKLDLGLEKGQPVRDAWL

SEQ ID NO: 2165 - protein, 2352 aa, Unknown
  Kingdom: Fungi, Phylum: Ascomycota
MASPNRRDPRLRSPAPSSPAFSTASTADGQDDIGSSPALPPLPAPSLPERVRGLLRTPPLPGSVDENRFGTASWGSPYPRTDRNLRRLSFSSEASDDSPIHQLEIDTPYLRTAPEPEENPVEPQVSSSLTGAAAVLANRVRRQTTGLTEDWIRTHTAGDLSESKHWFSSGSESEPSSLSGSESGWHEESNSQTPRAGHRLKSVTHRQTRYPRGGSSIDTLKPGDSLSLGAVTEADMASPDPQQAAVSDATNGRSQATPSEELPTVPHSPTMVPTDAPKVPSTPTKGSQKPLPKEPVMTPRLKKKVPWRGKNIMVLLPRDDERGLPGKAPKPLRQEDIDRMFASWEELGYRIDGFDLLVEDSQPPGTDDSQSRDAWPNMDDVVRERAERNYKVTLPDLNAWKNYVNELQEAKLRALGVFTAEDDPEPEPEPEQLVSPPLSGPSRGISAQYPPLPFSPPIPTSSAASNVGIPGYPFPQQFMSGSSATQSPGIPGASPSPFGVPGKYNPRQSISVPPSHSPFQANPDWINQNTFIPGLNRGGSPSLMNISGLMSPQSPFGIEGLQQVGSPGFNMHQRHQSLQYPMLPHQFQHQPAVRASPRLQEVREDEEDVNVSKNTSKAPEPTQRNPHGLQAEIDNAEYHLEEQLRTQLEHSDYNPKAQAERPGDAQAASVKDEGESTSNGFPAPELFANEPSEPLILHHPRPHSRGHSLTQNLYKDSQEAQNTEMNNKHFSSLNDIPEAQKGDEAYEIDTNPSNLGTPVQDFDFAQARGHQKSMSTTSNPWNDAISNASKAGSRRPSHGSKPSLSKLNVKAPEFKFNPASTFIPGQQFTFGGNAFQPAIFQASTEMQPEIPPVANNVMQFGSTPKFSREAPSFSPGQSDFSFSTSGPKFRPDAPAFTPFQSLSGSVTSPTASGSESVGNHSSIFGNIDIKMSDIIKPVKNSKAIPIVRPSSRHSAKSIKIAVDDEVRDDVDGRLTMDESRVKRARSSAPEGDEVPAFAEQPPIEEAVKVEDDGLEEGEINEDAEGEIEHTLPIDTSLSSIVTSDQQADTKETTAAPSETSPADNNINRWTPFDFDNKFDNPKFDQSRSIGDHSIKPAHKKSLSATAPAFTPTGLVFSPNAPAFVPRQSQEQNELTEDDEVKDEPTETSPRSPEENAPVEPVREVTPPIAKPRVVSKGLGASRFASPPPKPKGLAASRFASEPSPPPKETPEAPSTPQADESVNFDDYLIQDSKLESQSEIMLPSVERDMDETQVHSPTFEEIDDIMLHLGTDPSRGVNKTKEEPSRWQQPAPVDKPTLTTIAGTNPYKLSPPDAEPVVSRETASPTPRPEQAFSKLVSPPSAPLEDPFVDPPVSPPSLEAADLVDEVASPPVSDWEQDFSEDEQEKLHNRAQFFDVHVNEIVGNLLTARLEPLEKALLEISNGLALGPPRGSSRRRDMRSVSGEPQHSDADDEDEEPTLRRSMSPRRDRRMDQIRAAVMEGLAAQQKNIPAVAAATISEDPATESAVLKALAEMKDHLGENLRLDFRGEDLKNIVEDAVQRRMPESPKADLEMAIKVDELSAKLIDLEERLQLEREKVEREITERRAAEDMSAELNRKLQAAETRVEVEIINRSVFDQRVTDLEERLRNQESKTEQEVESRRAAEDRLSEIQRLLRIATEEENRLREVVEERDIKIKTMEHASGEATAQMAIIDASLAHSTQAQSDMANKINALETDLRVVRQDNHHWRSEAERSDEASRRTSAELAQALDENKHMQKSLNTLTTQLEENERLRETWRGKFMSLQEDMANAAREIAEDNARRIKKDQAMLARQEVLDAKLQAEAKTRERLEIEMERLQMNERSGMRAVNECKRLEGLLGELKTENHRLSETAAQHRRDYEEAREIGASEVKRVRMALQVELDSANHQVNVIREDLEEQNNKLRIELDNVKLDSDTAKAKLEMLLEDAQASKAAEIEELKERHQNELENLQARLEHQLGTAVDEGQKTESHLLERLSFSASKMEHLQDRIVHLEEKLEVAKEAAAAAAQAAKSAGVEPGRASTVAAKPRTSGQKLDVPEKISPQALRESIMVLQEQLQAREQRIEELESSIAKLDPEAPTKIAKRDDEISWLRELLAVRHGDLQDIIAALSSEQFNRERVKDAAIRLKANLQMEEQERERALNGGSALNLPSLVQAATPRVAQAVGPLAAAWGSWRKGSSGSFSSLSAALNSPAPGRNATPSKSSPAMRNSSLGGLMTPPASGLRQSPLADNQPQPTAFASTGRRFPSQSSRARVDSSSSRARVDSNSSRARVDSHGSSRRIEKMPVLDTTPLGHQDEELDEAGPVTPPMMRQSGYDSDAQPGDFDDHDFFED

SEQ ID NO: 2166 - protein, 1403 aa, Unknown
  Kingdom: Fungi, Phylum: Ascomycota
MDRIISSPSDVLHDVRDLLSLLKEEGITGSSVERAYYDGFQVAVTHSDLARASEFASRSASARAVVEGHETPGVRRLKALAADPTKHPCYGLTNMWETEVGGAPREFTGDEYEEWLWRGKSLPLPKLADLRNDGAFPTFDDLPTDNDIDLDFYKTIDGFHYGPSKHWCFLAEIVDVQRFLRLMLDVKDRAGQTNRLMFYTDDRGEEVPRSLVRPGNKVAVLYAEHHGFLDMSVGIRHEQPQFLKIFPVQLTELLELSDRVQKHTSMGEKGITCHSCGKSFETLKKCARCSIIWYCGKIKRIKINMFSVSYAHLANYFYPIGNTPAVSLTQGLPNELPATVLLLGCGDLRHILFTLHTNSHSLDITACDLQPAVIARNVFLLTLLMKDSERVHKESYWNLYFHFKVDDDSLSCLQLHAQYLCSMSATLERWSRSELGRFITFCDEGSLHKTREVWQFWLKWTSADKSRFEDVLQKARHIKSRVGHGVNITALRSASPIIFDALNDLPRLHDHYWKHGTTDTGLKAIASATHLNPMFALPSMDEILHYGTDPLLGFHLATEFAPLTADSPLFSKPGQPQGMQTVVNAAREEFSAWVTSFERNFRDVFNIRFFAGDAIAFSYQLQNTHTSTSQRPVGWYSDRTHFRPLSLGDGYSSGGSSPSRFDVIDTSNLADHIGVLNLLTAVAPLLKTDAWATLYTERLLKLSETRKELVDDLIGGDMPTLSMLLGLVSVEMATSASTMCSGGENIMDVVCRQLDEGMSRIAQQFVRLAWKRPMGMLRSPLPHCALPKINFDPVDLGFVLYFLYLSMFQSEDTASLMRDLTTNNSTTSHQVAMNFHRRSLPKYHRASFSALIRFIRSRVSTDWDASISKLLDLIEADSSKYSMSRNYLQELYTWLHMLDIYTVSTLIAYPGRPVDDMTPQDLRSWKDIPPVVCITLKVPREKLNVFIDKDITQGVATPLLHCSVRSPPNGPMQYENHFAALQTGFGTVSTGGTRFSSSFKIAITEDGSAWSGQLPLLVSFYAPAWMLLLEPRQTILTFGLHVTPQTAQLFSSRLGLGLTVFSTTLGDLRHVYVTKHFPNLLTKPKILDVELHSQPQQDTSVIPEPKLSATTAVGAGEISSVTNRVDIRGKPSTALSSGCEVHLHSLSPFNYEILLGKEHTIIVDFPIPVAHSHIKTRIARKSSYIELVAAIKRETFSTGSFIYPLLQTSKAPLLWSLPYLSLQLQPSLDVSRSGPLGWLNTHLSMMFSASQRRLRDDRQSPAPVEQRTAVELKDSLLSLFMHYSGVQGGKANVFGIACPDAGGVHILVLASSLRLDLSNRTVLLDAAVLPLYDDLMPQIIPDIRALHSCCQRGQKDAVPTPIKLAANTPSQGTFLSQSTKVKDACALAEKASFRPGTCTAHHS

SEQ ID NO: 2167 - protein, 866 aa, Unknown
  Kingdom: Fungi, Phylum: Ascomycota
MATTTDANKLSDALLSFALEGKFPEDITSLPPVSGTDLEPAIQALDKAKQDLEAEIHIINEETKDDVGSWVRNAKTLQEDIIRSKTIANDIVREAEAPDVSGKALEDAEAKAEFLNREVQYSSQLHAVLKRIQDANNALNDVEAACSEARVIDALRLLEKAWAALDRIEVDKSTRVLKVLNSRSFSLKNRIHEVFDRAWKGMLVFDVEAGEATIRDSIPGIQMSLSDAAVGLKAYKEVDERMEQLWRNLDAAIILPRMDHQRKEAPSIRVNADTLRLQGQAMSGIKPLLTDLEASLAMLASKLPRDLLQPLSHWMMPDLLRRLIEQWLNPAVPSNLTNMDVFHSMIEDAKSFCQRLDDLGYAHIDEIQQWVKNAPTIWLGKCRETALDSIRRSLAKGIGEARPVEKIEKQMVSVAEGNELATTGAGASADTNDWGAEWGAEWDDNDEEMGGIEDDRKAARPEIQATPRTEEDDGADAWGWGEDDEAAPNDTHSSEQNSKPKSDEEDDAAAAWGWADENETTNQEPESKSSPAKGRMRPAAPAPEETRELVLKETYHISSMPDPVLELINRILEDGATLTRGEDQYSHVAHTAPGLFSLPTFSLALFRAISPHYYPVDEGGSMYLYNDAVYLADRLATFSEEWKQREDLTPRARSLLRMDTDIKSLRSFANRSYSNAMNLQKTVLRDFLGGAQSLMQHDESGAAIESGIARIRTVASVWEPILARSVWSQAIGSLAEVLATKIITDVLEMSSISQDEAYNIASLIAKATALDDLFLPSRLSGVAAPTGEDEVPATAQYAPSWLRLKYLSEVLQSNLNEVKFLWVESELSLYFTVGEVVDLIEASFELNPRTREVIREIRSKPTPMAS

SEQ ID NO: 2168 - protein, 770 aa, Unknown
  Kingdom: Fungi, Phylum: Ascomycota
MVVAASFAIGLAAFAFQLWPTVVRAAAETTLNITAFTSEVDSDWTSVYYSDSAPLLIGNDGGAASGGLHAYDFGTKTPLPEVKALPVGRTKVVTVAHNVGGKDLAITIAAPDSILRVYELPSFAKAHVEFTLLGAWSAMCSWKSKSRNQYFYIFGKKKAVQLLIRPDGEDFEVVQIQTFELPFEPSGCAVSESKSLMFLHADDTPELHVFPLKESTSAPVLSAAGEVQHDLTGVAVYRSSDGETDLLFTAQTDTIAIYEASTDITGSLQGTIRLTGYEDIEVSGLSFLQSSTNGFSEGALTFAIKTDDLEGYGVASLGGVFEDLKLKSNTAYRPGAPRDCNGRGPVCKSCGYNGYCLKSKEDSSCDCFAGYSGSKCQKHICLNNCNGNGKCVGPNVCQCKKGWGGISCSFLLVEPSYETDANGGDGDDPAIWISEDKPEELSRIITTVKSAEGAGLDVYDLKGKFVQHLEAPKPNNVDMIYGFDLGNRKVDLAFAACRSDDTLCLYEMLPNGTLTNIPGGSQPTVDDYTVYGSCVYRSPKTGKQYLFVNEKSARYLQFELTAKDGVLETTLVRDFQGGNGGQVEGCVADEENGWLFLGEEPSALWRYGAEPDSDDAERVLIAQVGGDGKLYGDVEGVTLVYGNNPQEGFIMVSCQGVSAYNVYRRAPPHEYVTTFTITKSANGKIDGVTNTDGLTAVGTSLGPDYPYGLLVVHDDANQLPDGTTSEEASFKLVALDQVLGATPIKKLGLLKEVDRRWDPRALLRSRRRDL

SEQ ID NO: 2169 - protein, 1321 aa, Unknown
  Kingdom: Fungi, Phylum: Ascomycota
MPRRKRLTTPKRTRKPSKVPDIPDDQWHEIKGILDERRRSGRTEYLVDWEPNAVTGDTYDPSWQVEVTEDALSEWKAKKAGAYSSSPLPSSKLRETEPESQESQPPRPADWRSLGRSVAAQKHKRKQSATEESPEASRKKQKSDRAISPSDGRAPSITTASSAVSLSGSPPPSQQVYTISDEDKQVAVVLTKNPDFDPTDFHSVVGTNTQTTAFSSQSLSQLESQDTQLHLTSTPRNSRQTVPDSQELLESSLSQVASNESLSSRQGPVQRVVADSQAESQPLTDTELSLAQQSIAAQDVSSRYPTGPGTQIPSGQGLSQSHKRSYDPVRDSLSTRQSDDLAVVYQSQPPFTPFPDSLASSGHLATETPSQIAALSLPHGEQPEHESQHYAERQNPFSSHLSQAAQVTRGEFDPPLDKDNLTQSPRQKSGLSAGFQPFTNTSTQGEQSQSAHRSRVSLSECLARPYSSETMDNSQGLHNPASRPSAEEELNKILDLSAAGPPSSRPSVQAELDSIFTFDVDPPPSLSAIPEAEKRDELSGRDASDNESAPFAQAEVTIQSQPRTMSDGPSAHDQQLDSISQITYNPQSGAPSGGDISGTLRADLPADGHLPGTISPADILRPSEGLMMGSIPELVEDFNSSRQPPPMGQTETEMDQATPDDSLAGRESRDVLVTLPFQASARDEYMDRLIREKVPIQLYSRHFTEEDMEDPADSLVSQIDDLFRALQNICDFPPDLIGTSLEGLDAKSKTKYARDANGKFSFIYELLQGITVDTKVVIVARSTELLRLIYCVTEALEIECICEALQIRESAFKDSAAVVRLALPSEDVPITDIDVIIGFDNSLTSSTLLKQSKSASANAPLILRLVTTHGMDHIDFKVDHDIVPLERRHAILFAMVKGRHFVSDPERGQQEPHEIAKAIYDYLNGEVEDPDYIAVPLPDSLLMSYLGSQDQPAIPAAQTDVDKGLKRKHDDDEDDEAKRLKTTVELDLSLDNQDPPIPDEVLQMLDAISPGDDVLAARPTTVSIHLVMLELMAQQLTELERQKSSTQLDEASKAVIESQAKQLRSYKRSVDDIYNKHRAALADRQLFEKRMKDAEQKLLEAEKKAARNTEKFEQRIAVLEADKARLLGTKEGEEGEDTPLATNEKLLKEAQEKVKVLEKRLVNAREESEYIRDQYRSAQSAAGETGQLRTQLKKAEEEAGRNKVRIHEINVANSVRGYLSRISELETLLKEREVELDRIREELRVLRNGRRETRQTSVPRSPRMGVLSPRAPARSYPSSTSRGGSPAPVGMDVAHVAGGSLLSGMQFLHQTPANGRWNQPT

SEQ ID NO: 2170 - protein, 341 aa, Unknown
  Kingdom: Fungi, Phylum: Ascomycota
MAILPDVPGIEVRVKVEGELVPDYENTDAKAEVLQPPNHPTSHFYVEAKTDARYFVQINLNEHLHAYLRTKHKSATHLGVALIVDGAMACLSGTGRFVEKHRREKTCEMRHTTWKSCGVWEYRDLVFNSVLIANALDAEEIQENIGRAPRIGLIQAFVFVNPGTITSVPLFQEARRQERELRSRANRVLGLTEKSMKGLGLSHASSLHNESTTKRYRPGKYPEGEIICEFRFSYRSKGLRAGQSLEAGSWLTFSIETLHSLGIIPRPGSKMPNFSGMTREELLSLAERNWRTLGDEEDRKPLAHSNRAVKTEPRGGTPGQDPLQLTAVRKRKRVEVDLTED

SEQ ID NO: 2171 - protein, 716 aa, Unknown
  Kingdom: Fungi, Phylum: Ascomycota
MTTSQITAGAMALGPVPIEGGAGGSATAPAVEPLQNRAKESKSPFVASAANSAVAWQPLDHATVERARRENKLLFLHIGYQACHHCYLMASDSFSNQACAPLINESFIPVLVDREQRPDIDNLYMNYVQGVSGAGGWPLNIFVTPEMEPVFGGTYFPGPGSSQPSSGDNDEAVTDFQTVLKKVRDAWLDQEARCRKEASESLAQLRDFAAEGTLGTRSITGAQSLGPTSAAASTMPPPATETREKSTISSELDLDQLEEAYRNIAGTFDPLFGGFGLAPKFPTPPKLKFLLSLKSHPSDVQDVVGEAECQHAEQIALDTLRKIRDGAMRDHVGGNGFARFSVTPDWSIPNFERLLPDNALLLSLYLDAWKLGGGTATGEFYDVVTELAQYLTSAPIALPGGGFASSEAADSLEKRGDRNSREGAYYTWTSREFESIFPSSDQQASEAVAAYFGILEDGNVDQDHDPNDDFINQNILRITKTVEDISKQFNIPIESLSESIAMARKLLQEKTLKDRPRPQLDDKIVTGWNGLAISALARTASALKDVNTELSAKCGEAASKAASFIKTNLLGSEKVLYRIWRDGKETEGFADDYAYLIQGLLDLYEFNSDESTLETANDLQKIQTSLFYDSERGAFFSTTTSHPFSPIRLKDGMDTSLPSINAVSVSNLFRLSTLKPGGEEDKLAHETINAFEPEILQYPWLYPGLLGGVVRARLGA

SEQ ID NO: 2172 - protein, 1024 aa, Unknown
  Kingdom: Fungi, Phylum: Ascomycota
  misc_feature (276)..(280): Xaa can be any naturally occurring amino acid
MASTVDKPARRASTEAAEPVATNTVEPSAADKEKANTRIDENTTENAIPHVQPGHPRDDAASPDPNALATKALEFLSTATPTTLSAVAVGFATVTYAVLGRLGLVLIGAFGGVVGFISWQARNPQVAKIVQGEKGIHVVERLLLDLDKKSNNNAKADDEEDESTLKSFDDFRPETKDALAGLVDAIIRDYVKWWYSPIAPSDHSFPLACRKVLTSFLLGISNHLYRKRPADAFLDLLTNSSSMLIVFMSELASAFSTLPPDSNMTAADTVYNYLSXXXXXYNCAPARIFLREIFANSVFEMMLQKCSKADYINAWIVYLLEDGEPDLSQAIDVGMQTGRDTGSSVFADLDGNVGNIGLVRPTQRNTHKKQLSRAEEEMDEAMEEMKRMNAMIVKEEEARRQREASITEDHRPSRTSTESDIDNRDKTRTPGEESPTFGRSFDKSSGRDNSNDGFSTSAKSETAPTPATPLSTTDYSSPAASPREKQQSHFTNFDQIVPQTQQADEDEQKEEKPAPKKAPLTLHNASFTLHDDVSSDTARIRMKPAWDYLIQVEPSSSDHSGWMIVRRYSDFETLHEILRRIAQISGATAFTELHKELPFWKIHTRESLRGELERYLRDACWYQSLAESEGMRRFLEKSQGHTHTSSKSFGWDTVGKNMLEGLTTAPKGFVEGGKTLVGGVSGVFGNIPGLVKRPTLQNSESTPNVSRLSISTPPRMDSMRSPARSERASMDSQRSSVISTQPGKMAPMERRPSYQSQGEGDGEARSSRHDRMESTSVSGSARPSREHSRAPSGAPLRSPSSLSLLEQLRLPPHPDEVADDFEWSADGAEIHPKPLEKPIPSPGPSSSGLKMAPKPGRQYSQLSEPETRVAVELMFAVINEMYTLSSAWNIRRTLLTAAKSFLLRPGNPSLLNVQNLIQESIIERNTSDGSIAAQLRKLRENVMPTEQERAAWPAEPTDEEKEKLRVKARALLIRSGVPAALMGVMGQAATGEALGRVFDCLQIEEVARGLFFGLMLQAVRIVTH

SEQ ID NO: 2173 - protein, 148 aa, Unknown
  Kingdom: Fungi, Phylum: Ascomycota
  misc_feature (117)..(117): Xaa can be any naturally occurring amino acid
MAYTPDSIWRNRSTFLQGRDAIEAFLTDKWSRENGYRLRKELFAFEGNRIAVQFWYEWHDEGGQWWRTYGLEDWTFAPNGLMRKRQMSGNDVSISNEERWFKDGVDVHDVDISEKHXIVALALALAESTGITSALAESPVIRATLNVA

SEQ ID NO: 2174 - protein, 796 aa, Unknown
  Kingdom: Fungi, Phylum: Ascomycota
MKFNIDMLTYGSELPVLFPYPRIYPEQYAYMCDLKKTLDAGGHCVLEMPSGTGKTVSLLSLIVAYQQYMPVKRKLIYCSRTMSEIEKALVELQALMKYRAEELGYEEDFRGLGLTSRKNLCLHPSVKREKSGSIVDARCRSLTAGFVKEKKDRGENVDLCVYHDNLDLLEPHNLIPNGVWSFESLLRYGEEHKQCPYFTARRMMQYCNVVIFSYHYLLDPKIAERVTKDFSKDCIIVFDEAHNIDNVCIESLSTDITEESLRKATRGAQNLERKISEMRDTDQEQLQNEYQKLVQGLRDADDARQEDAFMSNPALPEDLLKEAVPGNIRRAEHFVAFLKRFIEYLKTRMKVRQVISETPTSFLSHLKEHTFIEKKPLRFCAERLTSLVRTLELTNIEDYQPLQEVATFATLVATYEKGFLLILEPYESDAAEVPNPVLHFTCLDAAIAIRPVFERFYSVIITSGTISPLEIYPKMLDFSTVIQESYSMTLARKSFLPMIVTRGSDQASVSTGFQVRNEPSVVRNYGNLLTEFAKITPDGLVVFFPSYLYMESIISMWQGMGILDEVWKYKLILVETPDAQETSLALETYRTACCNGRGAILLCVARGKVSEGIDFDHQYGRTVLCIGVPFQYTESRILKARLEFLRETYRIKENDFLSFDAMRHAAQCLGRVLRGKDDYGIMVLADRRFQKKRTQLPKWINQALLDADTNLSTDMAVSSARRFLRTMAQPFRAKDQEGISTWGYEDLMQHKEKVDMERIRELEEEGANGVKSRKEGYEDDDFEDDDIDQDMMDMGY

SEQ ID NO: 2175 - protein, 439 aa, Unknown
  Kingdom: Fungi, Phylum: Ascomycota
MAPAQVEDLDPDVAMTQGEEDDQTERLINEEYKTWKKNSPFLYDMILGTALTWPTLTVQWFPDVKEPEGKNYKTHRLLLGTHTSDESPNFLQIADVQIPKQVAPNPDNYDEDRGEIGGYGKSGDVAAIKCDIVHKIEHPGEVNKARYQPQNPDIIATFCVDGRLLIFDRTKHELQPSSLGKVNAQVELIGHKSEGFGLAWNPHEEGCLASGSEDKTMRLWDLKTLEGELRVLKPSRTYTHHTQIVNDVQYHNMSKNFIGSVSDDQTLQIVDIRQSDLTKAAVKAVGGHLDAINALAFNPTSEVLVATASADKTIGIWDLRNVKEKVHTLEGHNDAVTSLSWHPTEAGILGSASYDRRIIFWDMSRIGEEQLPDDQDDGPPELLFMHGGHTNHLADFSWNPNEPWLVASAAEDNLLQIWKVAESIVGKDDGDLPVDELDR

SEQ ID NO: 2176 - protein, 126 aa, Unknown
  Kingdom: Fungi, Phylum: Ascomycota
MPYLLLLLSAFLFFLVTALFVTRVHWVHLLPSVPGSNYLYSRLPSSFAGDIEAGLSSNTFDLSGNIEDGDSRAGLDDASKREILKIMKKRRMNFDQARKKYMEQRFKDNGIGADGMPRDPKFVSFS

SEQ ID NO: 2177 - protein, 512 aa, Unknown
  Kingdom: Fungi, Phylum: Ascomycota
MANRLRRLATGGLDWLGARLRPRKGLLLFFGFLPVIATFRDTVADLAAVNGESMYPFLNDNKDQSLGRDWFLNWKWDASKNLKRGMVVTFRSPYNPHGWAVKRIIGLEGDVVRTKKPYPFAEERVPQGHIWVEGDGEKTLDSNTYGPISKDLLVGKAVGRIRGHTMSPDDVESEARPSIVHAMLAGGIGGSTGDLLMHSLDTVKTRQQGDPHIPSKYNSLGQSYYTIWRQEGFRRGLYGGWVPALGGSFPGTMLFFGTYEWSKRVLIDHGVQQHVSYLAAGFLGDLAASIVYVPSEVLKTRLQLQGRYNNPHFKSGYNYRGTVDAFRTIIQTEGSAALFHGYGATLYRDLPFSALQFMFWEQFHAWARVYKNSREIGSPLELLTGGAAGGLAGVLTCPLDVVKTRLQTQVNPPAAEKTAPHAKDPNPQKRLISTSSPSTHRPKPGAIALETSSVITGLKVIYRTEGVAGWFRGVGPRGLWTFVQSGCMLFLYQQILRQLEIHMPVEEREKQL

SEQ ID NO: 2178 - protein, 767 aa, Unknown
  Kingdom: Fungi, Phylum: Ascomycota
MYEDGWYTLVPDQQARPAPTPAQGRGHRRKESLLQQPNGTSHPVDVVEPLENVYEDVEQVSDPPETEVLKRAASYSDFYHVVRAQLHKDSRRRRKISRKDRTWDALLLSDKADDARLAQQKSILAPQISQSELLESSQQEYILYRDQLALTERHLDGLIDDANSSLELLTSLADSFRAVEAQTSSFQSQCENLLDEQRRLEKLAHDVGTDLHYYEYLDNATRRLNAPGASKLVDDESFGEMIDNIDACIVFMNSHENYRDRDTYSARYNALLTKALHLLDHGFTTKLSKISSDIGRQVSVNHSESARHALAYGRFEELMMNTYHLIPNIHKTVQRAYDQYGRPVEKPTETTPTYAISASNIFHAWFTTRDRDLKPMTQSDVEDFQKEVKSLSVETACRNYIKQSFERVYNEDGLFLKIFSVEPLWSQDPETVYQKLKAINTTMAHPGNISPLANNLQSTLQTSDLQTICNLVGWLASEYSMPDNDDDESPFQAKSREYAARLLVEHLWPFTDKAFDVEISKSISKAVAQDSDLKIGPVEGGVASSNAFPLVKKAMELLVMFDQSMPKDRSSQNSSVVFNIVRETIHVLQRAEARIKAIRSDTDPDLFMVKNLLIIKNELVSLEIGDIRSQAPSMQHFTQIWDTLSPQNWVGFFGNMIGGSFWSRGGAAAPAVTAKTLTVEDMNEQLDELLRQSIYAFTKRWGSLINDSRARKTGVKPIAKGEAQLETILETAFSNQPEVKAKLKEAIEMNAQAQNDAQDGKQGVRRY

SEQ ID NO: 2179 - protein, 271 aa, Unknown
  Kingdom: Fungi, Phylum: Ascomycota
MATHSHDGGPTHSHDGFNAQEHGHSHEILDGPGSFLGREMPIVEGREWSERAFTIGIGGPVGSGKTALMLALCLALRERFSLAAVTNDIFTREDAEFLTRNLALPPNRIRAIETGGCPHAAVREDISQNLAALEDLHREFDTDLLLIESGGDNLAANYSRELADFIIYVIDVSGGDKIPRKGGPGITQSDLLIVNKTDLAEAVGADLGVMERDARKMREGGPTVFAQVKAGVGVDHIVNLITSAWKASGAEEERKSKGGPRPTEDLDQLKK

SEQ ID NO: 2180 - protein, 533 aa, Unknown
  Kingdom: Fungi, Phylum: Ascomycota
MRTSILAALAGGIASVSAELKIKSIARLNAPKSIERGQCDSLDPCKHAPPGSYVPDPKTFFLPHAHNRREKHWGLCKNDAYCKDQDIYSKVKFDFRGDSLVFDFDIPHAHYEDVVIRIQRESPPTDASPSFDLHSRYCHSNSHGGLSCSLPYHSLNSRGWQDLCPAKDEGGWVFYIQIKLVISLHGEKVTLYNQAIEKDTGTCWFSLSYCCTKCPDCKHRPVPYHKPQECGHSCHGSHSQQDRTKPCPKCNKAHWPRDEGVDGKAEAKQATGGGSSLPIQETHRNKALNSGGSPSSKPSSKPSPKPSSKPSSKPSSKPSSKPSSKPSSKPSSSTKPHSVRIQKDGQVAPRGTKSSWPKTQQHKGHEVDVACQSAQVVIFGQGAHSHRLNELGSYPGHAECKNRKGHYHTYVKHDLEVTVAGALELNNNAFGSFVVEFDKKNKNTEIIIKIDVWNALYYVVEAAVFIDCKEGIEKGWGGRHGSHICRPETFPYWYVDEKGISNYDFHIKDEFKCKGDYVFALWVKPAAGLVILV

SEQ ID NO: 2181 - protein, 300 aa, Unknown
  Kingdom: Fungi, Phylum: Ascomycota
MACFSFFNTLATSHRGASMANDGLHTRIPPPEGLQFLQLSFPTPAKDIVLIRMNDPKTLNALSTSRLRELDDVLSWYDDEPTLRVAIVTGAGRAFTAGADLREWRASLDDTTRGEKFGERKGVVPFTRRKGLKPVIAAVNGFALGGGCEFAVNCDIVIASSTAKFGLPEVHVGLAPTGGVLTRIVHTAGMQVASEMVLTGRHVTAQEMHTWGIVNRVVPEEGSLLDEAVGFAQMIAKGSPDAVIAAKAGLRQAWETADVERATEDWLATWFVKLEKGENLKEGMDAFREKRAPKWKPSKL

SEQ ID NO: 2182 - protein, 516 aa, Unknown
  Kingdom: Fungi, Phylum: Ascomycota
MATHHPPPPYTPDQLQSLYPPNLDLQLVQVLLRHGERTPVNARFANVGLAPFWPYCNSVKQLRSAILDSNNTFTSLEWKRRLETFADEDDSPVVATGPAGELDAVCDMGSLTDLGRQTTLNLGQRLRHLYVDQLRFLPPTIDNADSLYLRATPIPRALESLQQAFQGLYPSSARAPDFPPPTILSRTPGDETLFPNDGNCRRLAVLARAFAQRTAERWNDSEDLKYVTKKIGKYMPDEGAKVAVDGRPRLSGVMDTINATDAHGPATKLPGEFYDEKLRAIIDKIGVEEWYSGYKESREYRALGIGGLLGDIVARMVGSAERTAADGGYEVVKKGEVAPIRFGMSGCHDTTLAGALSSLGAFENEKWPPFTSHIAIELFRQKTAPQAQPVAAAAPPAPIPEARSWFSKIWGGDGGASGKAGVPPAGIGRKTTEELSEKEKRTLQGYFVRVRYNDRVMSVPGCKAPGKHLEGDESFCTLEAFKSIVDKFTPKNWKHECRSNKDAPFFPSKPQPAGYE

SEQ ID NO: 2183 - protein, 447 aa, Unknown
  Kingdom: Fungi, Phylum: Ascomycota
MKFARSYSSGPLGGAIPAKKLKYVPTSGTYPKGFQASGVIVGIKANNTTKPDLALLTSDRPCAAAAVFTTNKFQAAPVTFSRDVLRTKANAGFRSVIINSGCANAVTGTGGLEDAAKMAKTTDQKIGSEDSTLVMSTGVIGQRLPIQKIVDYIPVAYHEAGDSHKHWLNCAKAICTTDTFPKLMSRSFELPSSPGIEYRIAGMTKGAGMLAPNMATLLTILATDAPISPKIMPSVVRYAADRSFNAITVDGDTSTNDTMALLANGAAGGKEVAEEGSADYEAFREILTDFSADLAKYIVRDGEGATKFVTIKVEESLTEEAAREVARTIARSPLVKTALYGKDANWGRILCAAGYALISPPGQPVNDVPDIAPERTSVSFIPTDGSPELKLLINGEPEQVDEERASEILEMEDLEILVRLGTGKKSAVHWTCDLSHDYVTINGDYRT

SEQ ID NO: 2184 - protein, 602 aa, Unknown
  Kingdom: Fungi, Phylum: Ascomycota
MSGHMYPRHGMGAVPPSTARLDELLEQVRGEFTSQMRQAEHLDQQINTQINEMQMVREKVYTMEQAHMTLKQKYEEEIAMLRHQLAEVRKGNPQAAMAGPPQHTPSSQQAPPSIAPGNGLFSGIMGGSQGGLAPPQQQQQPAPQDQHMAPGHQMAQGPPGLPGPPPHPSAPGQPPYQGGYPQGPNGLGPQPPPSTASPGPRGRGVGRPPNAVGPATPQINNPMPYPGNAQSPQVSHPTPDHARMGGPRAPPPVGNNLGDLDVEQLPAQYKKLGTDWHAVFNPQVQRVLDVDLVHTLVHESVVCCVRFSHDGKYVATGCNRSAQIFDVQTGEKVCVLEDHNAVEMSADLYIRSVCFSPDGRYLATGAEDKLIRVWDIQTRTIRNHFSGHEQDIYSLDFARDGRTIASGSGDRTVRLWDIEQGTNTLTLTIEDGVTTVAISPDTNYVAAGSLDKSVRVWDIHTGYLAERLEGADGHRDSVYSVAFSPNGKELVSGSLDRTIKMWELSGPRGDRTQAPKGGKCIKTFEGHRDFVLSVALTPDAQWVLSGSKDRGVHFWDPRTGTTQVMLQGHKNSVISVAPSPAGGYFATGSGDMKARIWSYRLM

SEQ ID NO: 2185 - protein, 540 aa, Unknown
  Kingdom: Fungi, Phylum: Ascomycota
MFVLACCRICEPIAFMSIFPYIYYMIEDFHITDDSSKISVYAGMVTSAFTLAEFATGVMWGRLSDKIGRKPVLLIGLAGTALSVLIFGFAPSLPVALFARALGGLLNGNIGVLQTTVAELVTVKEHQPRAYTIMPMVWCIGSIIGPAIGGALARPCISYPEIFGKGTIWDRFPYLLPNLFSAATVFIGVVVGLLFLEETHALKKHERDRGRELGDYLLAKFGCFRGFRSGMSNPEKQALLSDTISPYKSLDSMSELDGSSDDESLPAYRSSESSPKLTPVDRNKSSSQMRTQIPADCEKARIFTRAVIMNIVSYGILAFHTMTFDQLFPVFLSTAPPKHPVLDLPFRFVDGFGLDTKTIGIIMSVQGVYSLLSNYLIVAPVTRRLGSLRLFRILAFSYFALYLVTPYLVLLPDNLRMGAIYILVIWKCTFATMAYPSNAILLANSAPSKQVLGTINGIAASTASLCRALGPAVSGLLYAWGLQTGYSGLAWWFSGFVSIAGAFLSSQITEGGGHFDQAPMEEDELTEEALLAAYDEDETV

SEQ ID NO: 2186 - protein, 987 aa, Unknown
  Kingdom: Fungi, Phylum: Ascomycota
MSWDLLQRFLESDVFNSNPFLSVSYLSRYADHVGIHYVLCNKLRQFPYEDIEFFLPQLCHLIISVDNESMALEEFLLDLCEESVTAALLTFWLFQTYLHDLAANPATGAFQTCRRVYNKVQHIVFGLADAARHDKIKENILPVTVLSSFVLASVALPMFPQWAGPLAVAQARKPQPLALTETAIEVADVPKPPARAKTVTATSSRSRRTKEGRISSAPDANHPDGARSRPPRSAIPTTTVTKPRDSDAPSVRPSALEMRSLEARLSSASLPLPSPKIHTRPSTPVSAGIVPRLGESIHRRHSHHHSKAVMTSNDLSPLQKTRLLRQHYFRSQTAFLTALEGISNRLVVVPKPARLSALRAELALISQDLPAEVDIPVICPPTLINGSPGKSQHHRIMRLNPAESTVLNSAEKVPYLMMVEVLRDDFTFDPETADNQRLLGTLMSEGENAKRLFDLTSDTPRLAAARAQEVKTPDPVIDSVFEPVSGDLGSSPMLKPFDDEPSTPRYSSKSHASSSTLRLSSGATTSSTTLDAATPRTSGQYTPRSTSPAPGRKMTLTLPRTTAVDQPDFSALATHMRTASQMLAQLEANSGKRPKHEVAAIRAKIIASMQSLEEQSFETEDQGPTFDTIIAKTTSNTDITSPNPDLEDDAPIDPAINASAGRDRMENDFKTGGVQRRGDRDDPSAAVFGEAWEAKKERVRKSSPYGWMKNWDLVSVIVKTGADLRQEAFACQLIDVCHKIWVDAGIDVWVKRMRILVTGESSGLIETITNGVSLHSLKRSLTLASIESGSNPRHRIATLKDHFVKAFGQPDSEPYKAGVDAFKRSLAAYSMISYVLQLKDRHNGNVLIDSEGHIIHIDFGFMLSNSPGSVGFEAAPFKLTHEYVDVLGGLGSPDYEDYKQLCKQAFQALRRSADNIIDLVAMMGLNSKMPCFSVGVATVTTTLRQRFQLHLSADEAEQFVDDLVAKSFGSYYTRLYDTFQYRTQGIY

SEQ ID NO: 2187 - protein, 107 aa, Unknown
  Kingdom: Fungi, Phylum: Ascomycota
MASSTCCRKGNVECACAKQATCSCGKQSALNCNCAKAADENKLNGPRCSCRARPAGECTCDRAATENAAVSGEKCACGSRPASGCTCEKAADGGFNPANEIDFTTKA

SEQ ID NO: 2188 - protein, 424 aa, Unknown
  Kingdom: Fungi, Phylum: Ascomycota
MRSPAPGEVMDITNMLNNKGMHHQQALPGHLPLIKADPIMERSVSPHGSEHSHYSSHSLARSYSSQGLPGPIHMSAMQNGIPLPGYPDMHGMNGMPHMQMPAMVQQGHEQPMPQLAKAYACSTCSKGFARRSDLARHERIHSGDKPHFCDFKGCGKTFIQRSALTVHQRTHTGEKPHHCETCAKKFGDSSSLARHRRTHSGKRPYKCPYADCQKTFTRRTTLTRHQNHHTGTIEEAAAATAAALAAGKNKAIPRSEPDHLSAHGSPMTTPSPAQRTMSMSPSMDLSGTGLGRHPQDFQYLQQNGSIPVHMRVGSPASTTSTSYTTSMRPTSHPTSYGPPPTLEPSLEQHQSGSGSANGSVAGSPHMTSVGWQSPAHMASPSHNGAHYAYPEADYSHSAAMGQMFYGAATHMRRPQSAEPGMVHM

SEQ ID NO: 2189 - protein, 268 aa, Unknown
  Kingdom: Fungi, Phylum: Ascomycota
MFEQPEAKRVRRDELFDSGDSDDGDSSDELMKREMRALLNEQMAQSLGLLQADELSNQIASKGQGSPNETKAISQSNSEPDNGEGEDAADEFDFQLFSGSAPTTKVVLEDDHPGDGALVKRRPQSYYLTTTISEEQKRRFAAAAVTADEILQRAKRRSWGLELPWKVIHASSTGQLNSVYETGQAANAREGKGRPGKKKRIAMRTKARAAMEQAKLASAKMAEKEEHIKDKKKRLNRAKKLRRRAKAREQKAGGGGGGGDSGDSDDSA

SEQ ID NO: 2190 - protein, 665 aa, Unknown
  Kingdom: Fungi, Phylum: Ascomycota
MNAGLQHEPSRRSSSSSLTRNRSSPRNGRRRSAVLMNLQLNDPAMPGPGELASEQSPSAQRLSPQPLSGSPLMADPHHHRAPSLGELHQELEAEQEAHVNRLLQMIRQQQLELQRLQASNPHHGQGAAAEDSSAISERSGHGTPIPTASHTSMTSIPQTGSYSRSPGLRHPRSSFDMARADIQRRSRTPSRGTSPRIRATSISAESGDWVLGGRDESAFYQAETQMLTRENQMLRHRIRDLEKQLSELSPHVAGSSEPLVHSHLTRSSTADEETSSAARQADFTHTVVGGGVVGLAIARQLAQRPNTTTLLIERHASVGTETSSRNSEVIHAGIYYGPSSLKTQLCVRGKHLLYDFCEKHSVGHRRTGKWIVAQNDVQREALEGIHRLCGEIGVDVRWVGEEEIEREGEGVRAAKGALDSPTTGIVDSHGLMMCLLGLFEDAGGVVAVNSPVESVTPLGSGTPGSSGWEVSVRDGFSGEASTITTETFINAAGLGSVDIHNSIVPAEQHKQLFYAKGNYFSYSASTHSISRLIYPAPEPGAGGLGTHLTLDLGGRIRFGPDVEWVDSPEDLAVNAERKDLAIAEIKKYLPGVDESALVPDYAGIRPKLGKRGAVTAGKGFHDFIIRKEDGYEGWINLLGIESPGLTSSLAIAERVDGLMYGSVKE

SEQ ID NO: 2191 - protein, 931 aa, Unknown
  Kingdom: Fungi, Phylum: Ascomycota
MVLRSTVLSLLLATPLVRGAARLPLSRDEDRDPVEKRHLQAPQPRQEPPPPVTVTITVFPEQCTDNPPVNPEDPVNPEDPVDPEDPDDPVDPVDPVNPVDPVDPENPVNPEDPVDPVEPVNPDDPVDPVDPVDPVEPVDPIDPVNPVDPVDPVNPVNPEDPVDPVNPDDPVNPVDPVNPVDPVNPVNPDDPVGPVDPEDPVSPVNPVDPVNPDDPVDPVDPVNPVDPVNPVDPVDPVNPVDPIDPVDPVDPVVPVTPVDPVDPTDPEDPEDPEEPECDAELLPGGVVKRSTRRRDIRRRGPWRRGISRRQDDDGAACELGVEHIVYPSNGGNAVETGAIYATMLTMVSPTGISAEEAPGLGVLFWRVVLTSKQATKVKETAGVAFVYVPCKDDCYDPTTQDIIMQPDAGDDLTVVGQFNGESLEWYKDNYVYHSRAGESVSLYILDNGANLEHKEFVEGSNIASRARWIHTNPNIPEATAEDENGGFRTGHGTCMLGRAAGHLHGVAKKIDPIIVRVPTRRTAIEYFIQGLRHILYDLGDGRRSVLLLSLYWPRYNDEGGFTFKGEDGSDGYDAVRKTMGDLLREITKKGVTVVTGSGNHGLRSMDGIPATLGAADAEDRIDELIVTGAVNHRGDTVWVGSNSDAAKGLPHIFAPGENVDCPELKEIDPTNTLYRTVTGTSPASAAVAGLAAYLLSLGDLPPFEGLTDVGTPQRLKDYMLQLSYPRGPTADVNVFFNGISRLDLGGLNDDGPSCTIRKRQDGDGAALPDWEDCSSPDDSPENPETPEEEPESPIPDAPGDPDPARTWACEINQYGSTVIQDQCKCLPEECDPTAEEPVEGCTVQIVSKEQWNCDDQCGGCVFTVPDVVEPDPESSEWTCHEYINRSMDQCTCERKQCPDGTPLQECSVLMLKNQDGCDDFCGGCKPEGVSP

SEQ ID NO: 2192 - protein, 814 aa, Unknown
  Kingdom: Fungi, Phylum: Ascomycota
MAAQSKVQLTAAEDALAAFLDKWTVLLRKRLRTTSRTTRLLALLALTSSIILGAEGGRQWWKSRREEREQGRKLVRTNSWLYNKDGSRTIYVPYKDGTSKVVINTTKPLTFEAHRRLFLNPPRVSGLGDGVVPGAQTKPGLNLAFLHQFLSLMSIMIPRWSSKEAGLLLSHGVFLMLRTYLSLVVARLDGEIVRDLVAGNGKAFAWGLAKWCGLGGFASYTNAMIKYLESKVSIAFRTRLTRYIHDLYLNDNHNYYKLPNLDGGVGHGADQFITQDLTLFCASAASLYSSLGKPFVDLCVFNFQLYRSLGPLALSGLLSNYFLTASILRRLSPPFGKLKAVEGRKEGDFRSLHARLIANAEEVAFYGGADMEKTFLNKEFKSLKTWMESIYMLKIRYNILEDFILKYSWSAYGYLLASLPVFLPAWGGIGGVAEMAGAGGKGGRERNRMKEFITNKRLMLSLADAGGRMMYSIKDLSELAGYTSRVYTLISTLHRVHADAYYLRSGQNELYSLSDVQGTIQKGFDGVRFEHVPVVAPSLWPQGGDELLESLSLIVHSGEHLLISGPNGVGKSAIARILAGLWPVYRGLVSRPKSTGQDGIMFLPQRPYLSPGTLRDQVIYPDGHHDMREKRRSEDDLKRVLEEAKLGYLPDREGGWDTRKEWKDVLSGGEKQRMGFARLLYHEPKYAIIDEGTSAVSSDVEGLLYETCKEKGITLITISTRASLKKYHTYNLVIGQGDSGEGWEFERIGTEREKMQVEKELQDLRERLAKVDEWKRRREEIDAELAAVWTDQGDVVDPPAYTEQQQATEQVQES

SEQ ID NO: 2193 - protein, 341 aa, Unknown
  Kingdom: Fungi, Phylum: Ascomycota
MDATPAIPVSVRHAPRELASLPAELLLLIAGFVPSGQDLSALSRTNRRLYGSLLRYRYRQGVRTHGTSLVTWAIRRRRTGTVRDAVAAGGVAATTCPHPACAVPSPLELAAQYNFEELVALLLGARDGGDAGDGDGDGGRGGRGQGEGESEGDGGGINVNARSAKGQAALCWAAAHRNAELARMLLRVQGIDLETRDPYGRTPLAIAAGHGDAALAEVLLAHGADANSPLLPAPAGDGGDGGDDASAGVVVDAAIEAVVSRLLKDRGAVDAAARLMRENAPGRYYDSCSVPLLLAVGSGHGAIARVLVAHGAHLHLGMEMEMGGGGGRRGDDGCRCSEMYA

SEQ ID NO: 2194 - protein, 77 aa, Unknown
  Kingdom: Fungi, Phylum: Ascomycota
MALAKKAYPKATLKKIIKAHSNRNIKKNADVTIFLNYVLFMENLVKEAAIKSKQSGDRGLTARSVRKVTRVCASPTP

SEQ ID NO: 2195 - protein, 440 aa, Unknown
  Kingdom: Fungi, Phylum: Ascomycota
MSARYSGPPVQPRSPYGPPHRHEVSGPGIPTGNTPSSAQLPRLPSLSSWADTNSQSPNLASNHHSREVRTEFELSRHRYPQHAIQPRYPKANAESFTTRPDSTVTNLGPPNSEVRQPEMCFRGGMYAEPGYREPPPRPAAETISRASIAPPSYREHPSRPPSYDATSLDTKERPVPSKPRLEMHYKRQASSPDRQELSSKRIREQSPPSFRPRTQIRDVVPNLIGPDKAHLVRNLKFSLKIRQQPQQARSCGFADKDRRAIDPPPIVELKIEGEGFSKKDLEVYMNYDRYVMCCTLLDENGVDAMNMEQDGLRSKRMMGENTVVPFVGTDEHGQVGCFFSFNDLSCRTPGDYRLSFSVSALPTLEESRAGVRYPRMTDIMSDVFKAYNAKLFPGMTESSALARALKEQGCNISVRKGNEKTKNSRGRNAARDDEDEEDDY

SEQ ID NO: 2196 - protein, 1399 aa, Unknown
  Kingdom: Fungi, Phylum: Ascomycota
MRAPPGAFLNTPAIASRFQSASDPTRRQLFQQPDGRGARSGALVRTGENTGAGVDGTVATNAPAQGSDSLVAQSSLPAPRPENVPPVVKAANAINTFLKTDESFPDLDSCCRQGASSDYDLQNSDSAWAPFHKTHMYPIPNEILDNYNRGELQTLMGLFAEINHAWVVIDNSLYIWDYTRSDPQPLGFEEQTHTIHAVALMPPKPGIFQSKVTHVMAVATSSEMILYGLSAKKGASGIMEVELYSTKMSLPLRGTDVRIITGSANGRIFFGGSNDIDINELYYQSEEKWFSNRCGKINHTNPGWASVVSLQSGFWSQKTPEHLVDIVIDDSRNLVYTLSSRSTIRTYHMDAPDRLTKVIEKERLHCLRDIAHMITQSKLLNDRTSIVSISPIPKQEASKLHLMALTNTGCRLFLSATNTSSIFYNPQSNLAPQSMQVQFIKFPPSEGGRPSGYPAGENIVDLESRLLTPSQQGMRFPPGYFLDFVAKGSNTNEDILFVAGPESARIKNTSPTTPLKYFEHGSWIEIGSRAEAVGLITAPFAAASQPIGFGNELAVQYEEPTSEFAVLTNTGVHIIRRRRFVDVFASAMRSTVGDEGLEKVCRRFISLYGRVETVSTALAVACGHGGDVRPGAARAIDQTTEDHARTAFVDFGGQPTIAETDGTTLTTESVKLSSRHDALALYISRLIRKLWKVTVVKQVVDPNTKGIVIESTVALNGLAVRQEQLERLRKFLHANRSIIQGLSGPSDLQRASSRQEEVALQAEHQALHALQKLMESISEGISFVLMLFEERVTDIFMRLEASARQQLMDLTYEKLFSTPEGKDLAKLLVKAIVNKNIESGSNVETVADALRRRCGSFCSPDDVVIFKAQEQLKRASDQHLNANQSRMLLHESLRLFEKVAGSLSFPNLQTAVEQFIELKYYAGAIQLCLVVAREKDRGNTALSWINDGKPTGDPRENAFNERKRCYDMIHDALTHLDAASSREPEMIDGKYTLIATKRLEAYNVVNNSEDEVFHFDLYEWYIEQGFTDRILAIDSPHVTTFLQRLSTTNIEHADLLCRFYTNRSRFFDAAEVQAALAEGDFPIDLKQRINLLSRAKANASVQTLGVSRQKQQMLNHQVTELLEIAHIQDDLLERLLADERLDAARKEEIKQDLNGKIAGLSELFNNYADQAGYYDLCLLIYHTADYRNPTTISSTWGNLIETIHAAVTSEMENLPRGAAPPPLPYESVSAKVQNIAHRTSLDSFVFPIQTLLPELCRYAVAYEQDATIGADPTWPVQLFLSLGVSHDMIIRVLENVFDTQDYGFSGPVRNRIIELIVFVVRDWAAEVRRRGGGGKGSGGIGMSVAELLQRCEAALPAPGHGSNHGGAELAEVRRGLKSLRREVAGLVERAPVGGSLGFM

SEQ ID NO: 2197 - protein, 178 aa, Unknown
  Kingdom: Fungi, Phylum: Ascomycota
MATQYEIEHNIKFTEARRGRRVDMASFFNLLSRVAEPDMNSTEPRHNPHATPTPVDTAALFRLLQDQLQTLHATSPDANNRGFLEDLILSLETDIHDPPARIQGVSQEFVDSLDRVDRKRLRKDDDCAICKVPYLEDEYCLVVELPCNGAHRQEMGKKKAVPVVEDDDEESDGDMMYA

SEQ ID NO: 2198 - protein, 746 aa, Unknown
  Kingdom: Fungi, Phylum: Ascomycota
MESADAQPRPRPPAATVRESGNGQPPSKPKQVTKSSAPDGDITPVKRRGTVACRRCRRLRTKCVHEGPEPPCEACRLAGDKAAKECLFPRRGEKDVDRQFRRRPLPAGSVDGTDPTKGSSPASHYSPGRLQSDIGSRIISSLVSTPNLTREEVLPPIDEVVEGCRIFVTSYFQLGFIPKAVFLEKLVRQSEAVSPFLICCILSISARFTPSLTKRYGGAREATDHFLEVSRLMVPGEMYKSSLERLQAFFLLSISQWGNGDRERSSIDMGIAVRMAALQRLHCEESYELGPNSTTEDVVEKESARRVFWMIQSQENLHSGYKTPAPFPLEDITTLLPCNEKDFAFGCIPAERAALPGTPPAIARPQLATSSSRCLFATLIQAHSLWGAVSRKASRPESTINKAPPWNPTSEYQASAEELQKWEKYLPPEHTFSVWNLRGWKSESLDLAYLAVTMVLRLTNIVSRRVYLDEMLAALSPGPVTERLEPSTPTMANASDQANSTAYPTPSSTVHDGHSPAPLGFWQNMSDEMFTNVWQLHEQIDAFLSMRAPDEGFPQILVFCIYMCGSVSSYLWRYPALCPKLSDRAQMMAQRSMEALRTLHAAWPTSSTWAKRLQKIATPLPGASSAEAKMLAASFTAQTDPSSGIAETSNNGSRAAPNVPQYSSIQPVLQQPGTNGTVVGGLTNILPSGVGGELAARFGGMQPGAMPGEVFDMELTAFMQGDFHFNPYAAMPQGGDSYMGNNGPHG

SEQ ID NO: 2199 - protein, 474 aa, Unknown
  Kingdom: Fungi, Phylum: Ascomycota
MDLATQVDAHLLRGCCVEAERSDVVAFQLEGLRAALNEPSNPHLTAVMEEVRAGSRTLRELADLSQVHQDRVPLILNPLNILLPCLSRSLRDVTSHYEDRTRSKVNRWRNMYHTMTNEAGGLSLPSRFMAYNQYLGCLRDLLVRSPNFDLNLLEKLRRQILRLRDARGIPLPPVQVGPIVRYDALPAVDLDPAVHWAENIFSLPLPSRTALGRQQMSKSLGPHRPWGHLDVPPNSKILFRRSFDDDQISLTVYRNSRDASPYLLLRIFDQGTPWFALRGVHELCIERNGSCLQFKRWSRSEKRSKTWAVLCFMTWEELVLMHSTFVSLKARNRLTVQLGPEEYTLKEEQKHFQARILDDGFKHSLIVYEDRATKALRLHAAVWDGELRQCPVWTAFVTHQSSSPTWLKRISRHRVRLADIQLYVFCRQYRQQNQRRGRIGAFEINFISDEAARRFEEFFYPPAAGPAVMAANGV

SEQ ID NO: 2200 - protein, 257 aa, Unknown
  Kingdom: Fungi, Phylum: Ascomycota
MFNTMYRFASRDGILSLWAGLSASIIRQSTYSTARFGGHTFLTEQLLAYTGERNLSVMSNIACAGASGGLAGVVGNPAEVVLVRMCADGAKPVGQRFMYSNVFEAFVRTAKEEGFQAFKKGITANIARSLLMNVSQIATYTSAKQYLVGSLGLADDVKTHAVSSLLAGTMATTVCAPADVLKSRLQSTAGQSGLIAVLQHGICKEGPRFLMKGWLPAWLRLTPHTILTFVFMEQLRRLSTMGLPWLKVNEAKEAVLR

SEQ ID NO: 2201 - protein, 113 aa, Unknown
  Kingdom: Fungi, Phylum: Ascomycota
MFGLLGPFRVTSPLSGGLLWKTPWRLSKFQKRRHRLRLRAVDNVVATVDAALAKKGQTLEALERWKAEMPTEAEMLPKDKYTMFDRKAKRYRKGIHKLPKWTRVSQRLNPPGF

SEQ ID NO: 2202 - protein, 500 aa, Unknown
  Kingdom: Fungi, Phylum: Ascomycota
MYILDDDTEKGRLIQDEQSQAQPQPQPQPRRRKVPFCRLLIVAAAAIATVNLFLPQLLGLLSAGTCGHHGLSHAKSVAKVQQCAIDNLKADTWFLDNAVPIKADEFLERRDRLAKALALNGVDAFVVEPGYTFQYYGNISQVDWEPWEPEERPFLMLILPQASDSGEVTAKTAFLSPHFEEGRVRMLGIPSREAELDIVIWEEHWNPYTTLLESRLFKDKTKSPPVLMADEEMRDYIVRGLQSTGFKTVGLTPEAELVRQTKSPAEVELIRAVNTGTVQAVRAMRPCLVPDLTEDEVTEILNNAMLSIGFQLFFNIVLFEEHGALPHGGFVTGGAKLTYDTMVVIDVGAHYLGYSSDICRSFLIDPPRKEYVSSDPMAEEKAQVWQIVLDAQTAAAHAFKPNHSAASVDIAARTVIEAAGYGYGFTHRLGHGIGIKAHESPYLNMWNTEAMLSPGMTFTNEPGIYLDGKFGVRHEDIYLVTEHGEAELLSGPRAKGLREP

SEQ ID NO: 2203 - protein, 564 aa, Unknown
  Kingdom: Fungi, Phylum: Ascomycota
MILHASLGTISSVLAPLATSIGANFTSATASPPLVSLSGIGSYSGSQVNQTLSGHALPRPVDAWLGVDYAIQPVGENRFRPIQGAPAPFPGVHDAGKYGPACTQDPAYVDLDKQDEACLNFNVYRPAGVPLTQKLPTLVWIHGGGFVLYSALTMDGASFVASSREPVMVVTFNYRLNSFGFLPSKLFERQGLLNLGLQDQTFFLEFLQTHLSEFGGDPKQITLGGLSAGAHSTAFQYFHNYGVSKGNPLFARAFMQSGAATARAFPPVDYPRYKSDFESLMSHIGCATDAGDKEQLSCLRKTPAREIEKITSAIYAEAEPNLNWPWQPALGGALLEHSGSQSLTEGTFHHLPLVTSHTTDEGKLYTPGYLQTNDDFIEFWHRMSPGLNRTDLAILNDLYPDPVAHPESAWAKSPNSTQYNRLSASWSDMAYICPSRQTARRTSGADVPTWRLRFNTPANPLSAQSWKGIPHASNMSYLWNDPSVPFKETARRYHAYMASFVATGDPNKLREDDAVAWPMYKADANEVPTQVVVNPESVDVEKDDMRVRQCEFWNDIDRAHRLNK

SEQ ID NO: 2204 - protein, 548 aa, Unknown
  Kingdom: Fungi, Phylum: Ascomycota
  misc_feature (135)..(142): Xaa can be any naturally occurring amino acid
MKSTSFGGLASIAIQASYATASSPESSPRLLSRQAAAPPADSFVRRADAAITVLGEYLYIVGGGVSVHVADDNADAEARVTGLNVTLALSLKDDWQSRDATYDVIEVPENFGENIGHALWTNAKDKEVVFWGGRXXXXXXXXDGNGGGKWTSKEPPPDIRRAAFGGFTECGGKGYFVGGYGGPYTDGPAFDGPRIAVPGLISYDFATGSFKNESTEGLTESGAFQKGSAVCVELPGREPKLFVVGGAEPRLTDVTDSDVSLQSFDNAYFYDLGTEKWYRQETQGSRPASRQGTCVVGASGSNGTYEIFMYGGFGEGGGPMDDAWVLSIPAFRWFKVDAKSDTRYSHACARVGSQMIVVGGNDNPVWNKKDPFPKGLGVFSLNTLAWKDGFEANSAEYQGPSEVREWYEERGLDTIPWGSDEIKQAFLSTNNEDGDDSSEPAGPTATPSAAESPNNTGAIAGGIVGGVLAFALFGGIFWWWRRRGQTNKKPHERIVEADESFAMKPYEMDSGFMPSELNSPATRRAAESSSGTKRAELDAQHHAVELPA

SEQ ID NO: 2205 - protein, 322 aa, Unknown
  Kingdom: Fungi, Phylum: Ascomycota
MEKYSQFRDRATGIAPFLPVTTPVSALAFIWHTFIFLFRLPFFFTYALSYFIFLHLLPIPVVVRKVALWGLMAIPGIWWVDLQLDGVKRGHLAEQPRDRFPHPGSVIVANFTSPVDAIYLAAIFDPIFTVSYPGSRQVRRVGLLGAIAQALAPVNTAPPKTKLTDLKQLLEANPNRIIAVFPECGTTNGKAILPLCPNVLELPADVHIFPVSIRYAPSDVTTPVPGLWLKFLWTLLSRPTTCIRVRVAEGQVNNSAALTNGVSTNGELKDRSAVNGAEIGPEGQRVLDRIGEALARLSRVKRVGLTMKDKQAFVTALRAKKA

SEQ ID NO: 2206 - protein, 1052 aa, Unknown
  Kingdom: Fungi, Phylum: Ascomycota
MPSASSKTGFRRMQSFKTDYAPCTITQYVSERSGMQVVVADRKGPKVNGYFTLATEIFDDSGAPHTLEHLIFMGSKNYQYKGLLDKLSSRAYSGTNAWTATDHTAYTLETAGWEGFAQILPVYLEHVILPTITDEAITTEVWHVDGEGNDAGVVYSEMQAVQSRSSEIMDLKARRLLYPENVGFRYETGGMTDALRVLTPERIRQFHRDMYQPRNLCVVIVGETDHENLLQILDEFEESIKDDLPPLDSPFKRPWIDSAQPPALKETILATAEFPEEDESVGEILVGFFGPNCVDLIATSALTILLTYLCGSSVSILENIMVEREELASSVSYWWDTRPNSVIWLQPTGVATEKLEFVEKRLFELLREVVSNPLDMDYMRECIRRERRQVKYHAEVSESFYATNIITDYLFGKRDGSTLRELETLSEYDTLEEWKDEDWRAFIRKWIVDAHHVSILGKPSLELATKLKTDEEARIARRKEELGPAGLEKLGKQLEAAKQKNDEPIPPEVIDQWDVPGTESIHFIESDTARYGRARAIGEGSGPAQKLIDHAAQSKLPLFLQFEDVPTNFVHITIHVGTAAVPDELKPLMPIFSDNFFNTHIMRDGKLVNFEQVVMELEKDTVSYGLSSARSLGDPDGIMVQFQVEPEKYAAAINWLRTMIYDSVFDPVRLKAAVNKALADVPEYKRDGRGMAGEVDSAIHLKKSCLTVAKRVLVRAVYLKRLRKLLEREPEKVVGWFNQVRSSLFTFQNSRLLVTARLNTLPDPLSAWDIFAESMKPEQDMLPIPKPVSLLNEEGQKPGSVGATIVPMTALDSSYTVSTAPGIASYEDPRLAAIMVAISYLEAPEGPLWNAVRGAGYAYGTHFARDVDSGVISYRVYRSPDASKAISASYEVIRKIAEGEVALDKHLLEGAVSQIVVMFADEQATMPGAAQQNYVLGVVRGLSRGWSKELMKRVRNVTQEEMKSVMREFILPVFQPGKSNIVITCAKLMQEGMETAFKGMGYKVQTHELSHFHDDYGLKTGDDDDEDEEEDDEEDGSGSETGSSDSEDDDRI

SEQ ID NO: 2207 - protein, 663 aa, Unknown
  Kingdom: Fungi, Phylum: Ascomycota
MRKAQKAQVSRQRWPTDVRRWGGPKVREASVASSCTLLGDENDEIIETDLIDLTSDQSDDGNHKILLEGEVVVSHLEMQNESIQIGDCIQVADTMLGKYKVNFVLVKAILRNNRGQKVARGIAFARTRCMHGKLPKKLNELCMILHLSRPSLRAQETPAFVDVSPHSIDGKRALIMTNELYPLHNPKQSTFLGFGDQATRMIAIEEHGTLVCRWKLQLHMLSTGRESKVCEEVFSRLLPQEISERMYRADETEIRKAWRGETLRGGSWSPQHRHQSAVQSHTVENQRCRGQQYTLFDSFSGAGGVSRGASLAGFRVQYAVDKSPEVWETYQSNFPGCSLYRGSVDDFVRTIGTRQAKVDVLHLSPPCQPFSPAHTHAAAHDDENMFALMSCFSLLRITRPRIVTLEQTFGISHERHGEYLRTLINDFTSQGFSLRWKIVRLATWGSAQDRKRLILVASAPGERLPPFPDPSHSDDDSQGLKPFNTIAKVLSQVVVGDDHHDLRGVRHHDPPKAPYPADRLSGTITTSPGGFYFPDGTRDLTVREYAALQGFPKHHTFCGTRTSILRQIGNAFPPNTVRHLYKHIEWWLIEQDGMTAYRPRDDEVVDVEIERPRHIQERRRQSRNDFTPRYEQATAVIGADTIDLDVEMIEVCAPRQTTIIDLT

SEQ ID NO: 2208 - protein, 430 aa, Unknown
  Kingdom: Fungi, Phylum: Ascomycota
MRDSDKSNESVKSGNSGASSGIPESLTFDKIINGGTCPPMTVRDFMNYLIYIEHSAENLQFFLWFRDYEKRFRAADTSDLALAPEWTQAMEDDAVAKMRKANAEKMRPDPKAAEIFKGTDFEKQGRELQPVDIYSPNPFNTPPRTPLNAADGDSMYTPSNTLSSTAPSSHQTQASNAFAAAGVRQPFTIQPFREEIDRIVATYIMDGAPRQLNLSSSEQKVAVQALSHTTHPTAFRGLIRIIESVLRHQAHPNFVRWSICNGNPARVLFARILGVGTIFLGLLAAILLTLSGASRGYRALPAIAFVLGISTLVAAYKGMCVVLHGMHHHHVRPWELFTQEDNEEGSESGFAGKESLESIGSSNSYEDEPWVVKYEKRNVVRKIFDREVWIQEPALRQIQDTIFVQAMLAAVLGAGVLTAIFVTVPGGHFF

SEQ ID NO: 2209 - protein, 856 aa, Unknown
  Kingdom: Fungi, Phylum: Ascomycota
MANHHPSPTMMQMQHQAPPPPPPGVQQGHYPAERVTIQAMNEAVWLQIGSFSEMLRSPDEAMFAYEKALNANQNSIPALNAIGMLLKGREAFDKALNYFRAITQLDANNGEAWGNLGHCYLMTEDLQKAYDAYQQALVNLRDPKDPMLWYGIGILYDRYGSYDYAEEAFSQVMQIQPDFEKANEIYFRLGIIYKQQSKFTQSLECFKYIVNSPPGPLTQEDIWFQIGHVHEQQKDFDSAKAAYQRVLEHSPNHAKVLQQLGWLHHQQSSAYETQDRAINFLEKSVSADNQDAQSWYLLGRCYMSQQKYPKAYEAYQQAVYRDGKNPTFWCSIGVLYYQINQYRDALDAYSRAIRLNPYISEVWYDLGTLYESCNNQITDALDAYQRAAELDPGNPHIKARLQLLRSGGSSGGQPASAPQPADVHPQAYQANGPVGPQWGGSTQQPPANGPPPAAQGAGENWAGRLSQVNPPPQPPNPYDGRGEPFRGQAPPIQRQPTPQGEQQGRPPFSEQNRGVPPRRTPPPGAPHPYHQAPPSQAPVGSAPSTGRSNRVPNPGYDGQAPQANQPANGPNGAPPPNGAAPFRGANQSPRPDGRDGRPPYDTRMPSPKSAYPQHPPPASAGYPPHPEAERPGAPENGPPPPVMADGPPSRVEERPPSVGPKRMREWEEESAAKKQANDENRARLDDMRHRRPSTPPRSDSFRRNSSEARRFEEQRRVEEPRKTEEPRPAANDNYHPSEAAHHTQNHPAPTSQLPPMQAPATEKPAAATPKEERPPTAPPAESSTAPSRPSAPPPEPERAARKMDVDEDYDDSAEEDKKPAIVTNGSGPASAAGDTKAASPTSTSANGAPAPATKTE

SEQ ID NO: 2210 - protein, 410 aa, Unknown
  Kingdom: Fungi, Phylum: Ascomycota
MAPDRYERGSSRSRHGVWGHWVPLVLTLTIATAGVAAWAWSQRKDSDEENEHEPDLDYENADYGDNPPYGSSRDYRAPPPDHSGPPPMQPGNDGYHPVTDGAGDPSQAGWGARMSGALRRTPSPQQFFDSAGKTVAAGAAAAGAVMGKALASIREEDKQYGESNPWSEEADAKKDRIIPPSGKRRKTVAIVVSADGGSAEAHDDGFQEHASILSHIPRHNDFSEIKLFILIYAPGLKDTGVETANSNLPPPSLASSYSNIGHDQAQTPGEESKNPMNQSTASPEYNAVYSQALAIVEKETMILPFTSSNGHVHILRHLSPEVIYLQESLSGDNGSIVANLQTWLRHDVILVVGAETGSGGLADSESEAERSDKVVQWWQKPERVGRGRGVVVVDGMRVADDWAKRVQGRD

SEQ ID NO: 2211 - protein, 2670 aa, Unknown
  Kingdom: Fungi, Phylum: Ascomycota
MSKPETNGAASGATLDLPILTKDLASSSTHARIARLQDMSEAVCQHPAANASDAALLQLLFHTHAYYHDRESRLAVQKCLSTILKRGPDPKALGLLVKAMRQESQKPGIATSSAFVLVEWCSVLMQRLAATPAWEALGNEILLTDAAALDKCLQPSTKRSVAHSATIVTRRAFRTLFASSSTREQHLSNAVKLLTSKASTPTPKHALLLGIISGVSARQEPLRPLLEAQKAQIYDFYTREIIGSKTAVPEHIASGLADFFASFATLEEIEKTLIPPMEKGLLRAPEVVLGSVMKKFIQSLPTSFDLSTVLQERLLKPILSNVKSSNATVRAGAADSFRVIVTRCHNQTSLAHVVGEIATPLKGGKLASPDHRLLHAEMLQAVALSDESAEAIAAATVTVAVKEGNEAALGAETSAMAKANTYLLKKRGELSKASIEAIVKGLTEKKPGSRRLWLLRVGDIASSLLDCEATSGIAAFVDAIIPKMIDVFNDAVANPPISAQNGTIVGAYILTALASIFESRSEKAGSLIAKASVFRHALSVGEKQSFLLNSRVYGKVTADEDLQWFCRALATVSPKLVEDGDDDVNQAWSEAIIHLVSNPSIPSGAQRAASRSLTQLYLQRPAVLSKLIIEALWVSLEQSQSLTEKEAKLEPQSLIEVLRAICLDSGAYSGDSKPSTEMLEEQACSLLVLARSELIPRSSWIDLCLRMGLDPGALARKYEDSLLREIGTRTSPDQKSDLIRLAASNAAAELAFVSPETIIPRLMKLIGHDLDPKQLQNVGPVEAAILRTPEGTCFVDVLAKKAQDTVPNKNSKDYDILKWEEELRSQIDKKKGQQRKLTADETAKVKAQLKKESEIRKNLQDVEARLMRGIGIIKALATGPPTDATLWLGTAVRLLLGVMDASANLIVGDVLSSAYLACSEKVNPKLGSARPFIGVATLRLREIRLPEQYSQEKVDDLVTRILYRLRFAAEQRPFDAVSLIYCLPLVVDILRKGGIGESADDRDAQLVLAVEFLAFHTDVCQDEATPRGELLSILIESMQNHAQHYKLIKDCFADLCRCIAPNIDREEILILTKGTIVSQASVRTTVLQSISTEIDMSEVGFCEEIWLAAHDDEEENQDLGREVWEECGASLDESVPLKMTPYLASKDAQLRRAAARALAEAVEANPGTSDSILEHLKATYIDLVAPKAQQLDEFGMPKKLDATDVWEPRQGIATAFKHLATIMNTAQANDSFDFFIEAGPLGDKNAVVRAEMLDAAIGAIDAKGKSMIESLMQKFESTLESADRHSEAADRVNEAVIIMYGALGRHLQAGDAKIPIVIERLLATLSTPSETVQYAIADCLPPLVKACHDRSSQYFERVMDELLNSKGYAQQRGAAYGLAGLVLGRGIHSLREYRIMSSLKSAMENKKEAHQREAALLAFELLSTVLGRLFEPYVIQIVPQLLSGFGDTNADVRDACLAAAKACFANLSSYGVKQIMPTLLNGLDDQQWRSKRGACELLGAMAYLDPQQLANSLPDIIPPLTGVLNDSHKEVRAAANRSLKRFGEVISNPEVKSLVDVLLKALSDPTKYTDEALDSLIKVQFVHYLDAPSLALVTRILQRGLGDRSNTKRKASQVIGSLAHLTEKKDIVPHLPILVAGLKIAAVDPVPTTRATASRALGSLVEKLGEDALPDLIPGLMQTLKSDTGAGDRLGSAQALSEVLAGLGTTRLEETLPTILQNVESAKPAVREGFMSLFIFLPVCFGNSFSNYLGRIIPPILAGLADDVESIRETALRAGRLLVKNFAARAVDLLLPELERGLADNSYRIRLSSVELVGDLLFNLTGVKATADGEEEEEDEDVARETGTSLKEVLGVEKRDKILSALYVCRCDTANAVRSAAMAVWKVLVPSPRVLKELVPTLTQLLIRRLGSANMEHKVIASNALGELIRKAGDGVLATLLPTLEESLQTSTDGDAKQGICLALKELISSATPEALEDHEKVLISVVRTALTDADEEVRETAAEAFDSLQQILGKRAVDQVLPFLLNLLRSEEEADNALAALLTLLTETTRSNIILPNLIPTLTTPPITAFDAKALASLSKVAGAAMNRRLPNIINSLMDNEINCKEEGLRQELEVSFDTVIQSIDEYDGLNTVMNVLLQLLKHDDHRKRAATASHLCNFFSAATVDYSRYNQDIVRSLLNSFDDGDMDVVKNSWAALTEFTKKLRKEEMESLVVSTRQALQRIGVAGANLRGFELPKGINAILPIFLQGLMNGTPEQRVQAALGISDIVDRTSEASLKPFVTQITGPLIRVVSERSTDVKSAILLTLNNLLEKMPTALKPFLPQLQRTFAKSLADPSSETLRSRAAKALGTLIKYTPRIDPLIAELVTGSKTSDSGVKTAMLKALYEVISKAGANMGESSRNAVLSLIDTDVDERDDSMTITNAKLLGALIKNVPEAAAMPLLKNRVLTTHFSTSSVLALNAVLVESPDSLLQSAAAEELPDLFCQGMVAKTPMIADNFILATGKLMLASPPKAFENIKKIFTTLATVIEPGNPTDSRRLALVVVRTLSRADRDMVRPHIATLAQPIFASVRDPVIPVKLAAEAAFVELFNVADEENKVFEKFMAGPGSELPANTQRSMGDYFKRVATRLGTQIRERREAEGGQGGLGLSNDEQEDEREIWSVGKVDLGEVFT

SEQ ID NO: 2212 - protein, 1454 aa, Unknown
  Kingdom: Fungi, Phylum: Ascomycota
MTEVGAADLSRLLHSKRNEYDAIVTSRKRKLRELFAVATHAESLPRDGFTNPDATEPTPAESQFLQANDILQDKLFDDATLPKRSEPNVGFFVQSLHNVLFPPVEPQPVPIAVATKTNVSTPSQAIKQSSTVVSTARPGQPALVVRGTPVSSVSSPLSAPVDPKSSSASPLSSVPNAPAAPVLSNREARPTPSVAISVGTVDVKTKQPTPISLPPGTKGSPSTAPAQSASNSTGGDRSGFAVPETNGRLGPNANALEARKASDAISSPGSTAASVATPQLHTASTDTSPDKEVSPKLIPAQEKLQPARTGGQQLPPVIQEHRGSDNAASSVVESAEEQLLQESRRSAQAATPQPPARDPLKPSVTPNSGTRASQAPSAATNAAAAKPSEIPDSQEEVSDKMDVDNVDPAKEAPAAAQTIQDRKPSIPSQSTVLPPPHSPSKETAHVSERAVTRVSSGAMRLKSVNEIVGATPKAAASTDRGLTQDFDNQLTPLTSTSQSPSSRYRHVRPQSRGQVSTVLFGKQPKRTEEKSAAPDEKDILKPEDDYFTPLFVQGFTNSSSWMQPMEKLLYQANKTIATPDALLALQDHQACKVLRRVYHLQQNDKWSLRQPKRCPEPTRQASQWDVLIKEVKWMRTDFREERKWKMALARNLAYACAEWHAASPEFRKEMQVPAHIPPKAHPVADVSMADADEDGLENQPTPDLVSSADSPQNIEELSEDFVETVAPSAIFALQEDDLVFGLRRSPTADRLLDELPMYSSPLQVPKVDPLNPDFDPDALWRRPALPLSKYVEGRMKVVAPVPPRKRSRFEYEDDSSDDEVEHLFPSENRVHHVRLPPASDAVSLFKPEMKHTRDRLHAGHQFRPPSEHPMPVQSFYECRSPSQWTQSEDDELRSLVREYTYNWPLISGMLSSRSQFTSGAERRTPWECFERWINLEGLPADMSKTQYFKAYNSRIEAAQRVIMQQNQLAAQQASASGNNTTPLRRRPSVPLRVERRRNQKHLTLIDAMRKLAKKRETQQQKQQQTAAQSAANKKSFDTSNQRLPTKTPRDYSLLRWERDQALAERMAQYAAKQDAQRRAAMQAARGQSQAGQAPTGQAQAAQGGVPAAQQINHAGAVNGVNGVQRSNIPSQAAIAAAAAAAAAAAQQGRPRMPLQAPVNGMANGGGVQAHMNGGLAAPVAHMNAQPQMQAALQAQQQQQHQQRVQMTPSQAELMIRAQRLAEQQRNAIQMQQQQQQQQLPQQHQQHMQQQQQAQAQPNNAGTPGSQGTQGSPPMRNGVANMNQQNFMNNAQNILAQYGANGGHGTPKAGLHMPSLAAGSPGQAQARPQPQFPNNISAQLAQLEANFLAKNPSLTPEQTRQLATEHLTRAMMQQRQSAMNAAAGGAAAAALANATPGITNGMTATTSPHQYAALLRQQQQQQANQAAQSASPVPQAQQIAHQRQSSEGSTPNVPK

SEQ ID NO: 2213 - protein, 235 aa, Unknown
  Kingdom: Fungi, Phylum: Ascomycota
MRSTNNSPTSDRQTAAAGQPANEHHQVPHKLVPQCHAQSFPSQASEPVFHLFPLLPAELRIQIWKACIHPRIVEISREPFSTSDGDLQYFWYPQPVVAIQQVCHESRNSGCYVKGFTLGTAPRYIWVNFSADTINLNQFAMDDPEMEYSRIEKLQIGVVSWDLFMDEEVLYLCRFKVLQSLSLLSPDADFEYWVCYRGIPGPHDWGCSPDKVTIVEKESGLQKSLAQCVRGRRKT

SEQ ID NO: 2214 - protein, 377 aa, Unknown
  Kingdom: Fungi, Phylum: Ascomycota
MAPAIPSWLNKRSLSKAANSAWGPLVGASHHLLARDDKDDDHDNKKQNPASGVLDPHDISNVGFFILFALIGVAFVLTIIWFFFWAKNGGFYFKENDWEDYKTTVLRRKGPNGTILSNATPSTNLGGGSVYKDMDDDNTTAITESTALSGITAGASDIGAREKRRQKQEQRERERQRERRKKRGSKRHVGEDGVEDDVAEKTARDELRQYRHEKAARVGGINKQSEGSNWDGSTNPSESTVSSELLSNRQETPTGTPTGTPTKKSTPSGNGGIRKVYSTADRNVDRESERIRAEARRLREEGRSARRDFSYQRSTGTGSELSGQSQSLLEGSDVGTKSYHHPMPELREAREARQKEREERRARRGGYRRGRGDDEDM

SEQ ID NO: 2215 - protein, 1069 aa, Unknown
  Kingdom: Fungi, Phylum: Ascomycota
MATSARLTGSQDQDDPTDASPGDEAHEPPAPIGRITPDIISGVYRGLRKLPSVRLPRNVSLPSLRREPSPAQIDTVYEKAIAEDPLESTPQNADRVNFLQSLDKPLPQPPSRETYIPHPREPAEQEKTSAARHEQSGDPSLLQGSTGTPLGYSERFQADSGRSAMDSSGSTSLSNGQGQYQQGVSGSMSSLASSLRQDGGDDSRDAPPTRLTIQTSAGPSPAIGSGRAPPTGNSSVGGPSQGSSSHLSGLMCNVHRTTGREPHPLVGATTTVLGDKLYVFGGRILSRSRPAPLTSDLYELDLIRRHWTKLETTGDIPPPRYFHSMCALGDTKMVCYGGMSPMAPAPGSTASTEQQSEVTVMSDIYIYDVPTRKWTFIPTQDPPQGRYAHCACILPSTASFSSHRAPLSALRHNPSSGNPNEGRIGINIDGSGGSEMIIVGGQDGANHYIEHVSVFNLRSLKWTATQSLGKSCGAYRSVAAALPPSISAVIGRGYQNGAQRPDQTPQTNTRDAMSSMLIYSNYNFLDVKLELQIRTSDGTLHERPMSGTYSPPGLRFPNGGVLDNHFVVSGTYLTSSKQEYALWALDLRTLTWSRIDAGGGVFGQGSWNRGVLWSRRNTFVILGNRKRSLVDDYNHRRINFSNVCMVELEAFGFYDNPRKSSPLSGFISASSPYTGPGLSIARKAGYTAGGRYHSKASEELGEKAFAMRELSDMDILCIGGERIPVNSRIVARRWGPYFVQLLREGTATQDGSDAATLRSGLSSNPLRASALTITPSSRAADSSASIASTLLSGGAGNAPPSTAGSSTTGSAPAPGDEVNPATLNTAPTPSSLPPNSRPRCLYLPHTYLTIQALLHFLYTSSLPPPSSPLCTPQILCSLLQVARPYRIDGLLEAVIERLHALLDSRNAAAVFNATAMAAGGGRGIDGSLNPNFFVGSLDPIGSPMSSSDFSLTGTTANGSFISDTDSRSESLQINTNVQPKRPSSGDLSASGSASGSEWSNSETGGETDRERNPIWNGELSSVIGLQKRGLRGLMEGRRMRERTGTGAGYGGQPAVQSQQQRIGLGIGSS

SEQ ID NO: 2216 - protein, 815 aa, Unknown
  Kingdom: Fungi, Phylum: Ascomycota
MVSIRSLVATLASVALLVPSSIAHSVDRNPLSYISLLDEPDIRLPSHRVHAHSHFDLTFSIHQGAQEVRLVLEPNTDVIPDSFSVTRIGSDGKPKVVKSVERAEHKVFRGKAFVRRQNLNGWHEAGWARIMIHRDGKTPLFDGTFRIDGDLHQIQRGPQYRRARLQYDPELEDNDENIMVVWRNSDIMPFNPADDEDAHLELKRQLNDRTSCAADTLEFNRRDDDLEYRNLAAVDSRDLLGRQADDGDAGGDGRGARLIDSIGSTDGCPSTRKVALVGIATDCNYWGEFDGEEDLRRHVIGLVNQASEVYESTFNISLGIANLTIIDSACPSTTQDSAPWNVACGNNVDISDRLNRFSEWRGRFQDNNAYWTLLTTCASDSAVGLAWRRQLCRRGAAAAGRNNETVAATNVVVKKSSEWQIFAHETGHTFGAFHDCTDRECPVGQSSQQCCPLSTSSCNAGGQFLMNPSTSDSHNRFSPCSIGNICTTLRLDTEVDCLTDNRNVNTIMGSQCGNGIVESGEDCDCGGQDSCGDNSCCDGATCKFRGNAQCDPRNEDCCTDSCRFASNGTVCRPSSGDCDPEEQCPGDAARCPADQHSDDGQDCGNGLKCASGQCTSRDLQCRNVVGETITSNNTEACNEDRFLCRVICTAPDRGGNTCVMYNQNFLDGTECGSGGRCQDGNCEGNSALNQIGGWFDRNRNIWIPIAAVVGALLALAILSCLWSSCRRRRRAAARAKASSQAPRPQMSNHWQSMNGHYGSPPPPGASGANGGGFQPPPPAYGQNNGVHGDMQSHMYEHPPPQQFGRWNRTRSMRYA

SEQ ID NO: 2217 - protein, 220 aa, Unknown
  Kingdom: Fungi, Phylum: Ascomycota
MRLTFSPLLLLALPALADAQLLFPFGARPSTKDTPPASDKNSIHRPLPFGQLPIMPPTTEKDGDMTIQPSVPLNDILGTLRSLTTFSSLTRMQTTTTTLLSDLGTNTTVLAPLNSAIESLPRKPWESPRDYDEHGVSAYEGDDGQDRANANLRRFVEAHLVTKNPWEKGEKVKTIGGRDVWWEEKDGKKVVMPDEIEVDRVANQVANGEVWILKGVLNYV

SEQ ID NO: 2218 - protein, 1200 aa, Unknown
  Kingdom: Fungi, Phylum: Ascomycota
MYIKQIIIQGFKSYKEQTVIEPFSSKTNVIVGRNGSGKSNFFAAIRFVLSDAYTQMSREERQGLLHEGSGSAVMSAYVEIIFDNSDDRFPTGNKEVVLRRTIGLKKDEYSVDRKVVTKSDVMNLLEAAGFSRSNPYYIVPQGRVTALTNMKESDRLNLLKEVAGTQVYETRRAESLKIMNETNNKREKIDELLEYIKERLSELEEEKEELRGFQDKDRQRRCLEYAYHHNEQVTVHAALEDIDNARQDGLDTTDSSRTDFVKGEKAIARIDAEMHKLEREIELLQIDRRQLEEDRRDGAKALAKIELRAKNLKDGQSAREQARAQHAAELESVQTEIASKEQELARILPEYQRKKQQEDELRRQLDAAEALRTRLFAKQNRGSRFKNKNERDAWLQQEVQELESTISVQKANLMDANEEVARVQKSIAQSEKDIANMRSRLSSWSSDRMAMAEQATKARDLLDKLNDERKLLRREDDKLNSVMANARQEKEQAERTLAQAMDSQTARGLATIRRLKQDQDIPGAYGTLADLLEVNEAYRLPVEQIAGASLFHYIVDNADTATKLADTLHRQRGGRVTFMPLEQLRPRHINMPRANDAVPLLSKITYDEEYEKAFQQVFGKAVVCPNLTVAAQYARSHGLDGITAEGDTTNKRGAMTGGYIDPRKSRLEAVQAANKWRSEYEVLVEQSRAIRRQIELKDQEITGAMSEVQKVEQKLRQVDDGFEPLKYELRNRSAHLENERSQLDSALRRRDAVEKNMSAFMEEADAHRSEIGTEFKKSLSPAEERQLEELSLTTQQLQMQWNELSSGRRDLERRKQVLEVDLRQNLQMRLDQLNSLAFEDSTSGESSGGLKAVQKELKKAQNVLRSVEESLLETEQKLEQLTSRIEEASQEKATLEQRQHELSTRIEKQQKRMEKTLQRKALLTAQAAECAKNIRDLGVLPEEAFDKYENMESKTITSKLKKVNEALKKYKHVNKKAFEQYNNFTTQQDQLMKRRAELDESQGSIEELVEHLDRRKDEAIERTFKQVSKEFATIFAKLVPAGHGRLVIQRRTDRRQQPADESDEEAKGSVENYIGVGISVSFNSKHLDEQQRIQQLSGGQKSLCALCLIFALQATESSPMVIFDEVDANLDAQYRTAVAALLDSISNEIGTQFICTTFRPEIVHVADKCYGVTFRNKTSSINCVSEEDALEFVEGQAKPN

SEQ ID NO: 2219 - protein, 521 aa, Unknown
  Kingdom: Fungi, Phylum: Ascomycota
MIYSSKRVELPYVDILTLLYVITKAHARKLTKSFAHFLRNHYGIGATGAGKDVVVGVSLGQSALACFFHGVLAAGGVYSAASPAATASELARQLRDGGARVLTCSKELQSVALRAAAEAGLPPSNVIILESYPEITLSNGDRSHVCDFQQSLDWELVTDPKALANRTACLVYSSGTTGLPKGVRLSHLNLVAETYLVSVLTRPTSDEWEKDGWEGRTIGHLPTAHIAGIQGYFINPMFEGHIVYWMPSFNFEQFVKYCATLKITGMFSVPPIWMAIAKHPSVKDQFRHLRSAISGAAPLSTEIQAAVGDKIDGDLRQTWGLTENGGSATYAPPDRTDTLGSLGQLLPNVEMRLVDEDGKDVPPGQPGEAWLRGPIVAMGYHNNDEANRLTFTSDGWMKTGDILRVEKDLVYVVDRKKEMIKYKGLQVAPAELEGVLASHPGVGDAAVVGILSEGNEVPKAYVVRAPGAADKVSAEALMQYVKERVAPYKQLRGGVEFLDVIPRSPSGKILRRKLRELQAKL

SEQ ID NO: 2220 - protein, 675 aa, Unknown
  Kingdom: Fungi, Phylum: Ascomycota
MSLWSLVWALCAPTLVGVLVYLLHQAFLPQPIPGIPHEAGSAKSILGDLPAVAKVSETGSMLEWLQQLCYKHSSPLVQVFIAPLGRPFLVLGDFREARDILLRRISEWDRADWAIDGLGGIGKHHHIVQKTGMQWKLNRRLIKGLMSPPFLRSVAAPNIYQGITDLLDLWELKADVASGLAFDPSWDVSFALLDCILPITFGRSALVSQSVRTLDFLKEADLKPYVAAAAHRDYLDFPAPVQALPDFVLSILRSSESIADSFSWPRPSWYWAWHWLWPSHWRTSSLRTNFVRQQVASSLQKLRQVSEGGALDEEERIGCAADFVLDRELEYARREERSPAYFSEMINDELYGFVIAGHDTSMTTAKWGLKFLSDNPVSQTKLMQSLHDGHPRALAEGRLPTYEEIMTASIPYCDAAVEEILRLAGSFSFLFRQATCDTMLLGHFIPRGTQLLILQNGPDTTLPGVGSVVQESDRSISSQKAALHRGVRAWDPATVREFRPERWLVPSSTSSAEGTLSFDGQAGPTLAFSDGVRGCYGRRLAYLQLKIMFTLLVWRFELLPCAPGLSSYAGDGRMLILSTVAHQGFPGENYTRWDDFILTSEDPFTLESWSDPLYLIIAEGGTRERHSVNVARSRSIEGPWAPCPHNPVLTAFENGDPIFQAVGRADLFKDTSGKQ

SEQ ID NO: 2221 - protein, 1201 aa, Unknown
  Kingdom: Fungi, Phylum: Ascomycota
MEGEEPTQATQDVLDPRRLGQQNSGFSDEDISDIICILYPHSDSARQEVLRLAHEDSPHVIGRSDADGVDPNYDLEDHASRFSLAEAEGNYALILRLSAAVKDPTAGFVFGRNALRCDIVFVKDPMKRISNVHFRIYVNQHGSVMVEDQSTNGTVVDENVLTSHPKDRTQEPISRWMLNSGSVIKLHLHQQIKDLTFRVRIPRRDADYDFAYMNKVREYFERHGLDNELSPEPAPAVAVPRHLRDENAAAKKQPRSPVQRRDTGVMRREWTGSGKYNRIGTIGKGAFAVVYKVASKYDGSPYAAKELDKQRFMKNGVVDQKAENEMKIMQCIDHSNIVRYIETIDWDDRLLIIIMEYVSGGDLGRHISERGPLPEDDVKLMAGQLVDALSYLHVRNITHRDVKPDNILISSLNPLVVKLTDFGLSKMVDSEQTFLRTFCGTLLYCAPEVYTEYGEYDEFGVRNRGKKVRRMPGQRYNHAVDIWSLGGVLFYTLTGSPPYPVKTGISYSELLHMIMTTQLDTRPLQLAGISNDGVHFLSRMLDRVPEKRATIHELVGHPWLTGPVSASVQASQSFDELTDDENDGGVDNGELEMDLDTFRQPTTDMYDEDRISDSILDYESEKENGHLDEPRQGPRLFGEVGSSAIGSSGVIPSEFLNLPRSSPSMGETEIVDSYDDEAYDSESHPTPRNNSRRIYQETSPSMARNQSADQLESLVYEVASQSLGGKDHPPQSMELRSISFKRKPPSAETSGEHDDESMLPGKPTMKRLKSETALENMPDDVLEELKLIASIPPIKRLHSGRQIDTPVNKVVFWAQDRKTWHLDYPEMTQLQKDAFVQAAEQRGEDFCPGRSSLWKLAMKYFAPTNTRGGSQARGVPAMRRNEQMLEDDHFPPTAAALEPTAATSVLYDSLPPTQNPDSQIVVPIRAVESSQRAIALLESTADSVVQGISLPVTTSLISFGRGPENMEVFQPATESRVPKYAFKILLWREGYDPSRDPAKVTPPWQQTDLNSSEADLYSFWICTKATVGIQINGYQLASSDHKNHGGPSQFWARLHDMDELVIWGGSDTENHTKLLFRCFWGGSSRPRSNVGRGFETAPRDVVQKLNDACQQTERRLRDTRDKEDLKNEAAKDHAFRLQFVERERERSRAFDKKRQEAVELLRQAQAARRGSPASVASTGHFRMNYGASSVSPDKRGAHSLR

SEQ ID NO: 2222 - protein, 527 aa, Unknown
  Kingdom: Fungi, Phylum: Ascomycota
MDAYKLTATQVLDKYKSDELTVEQYAESLLAHVRSRDPTVKAWAYLEPELVLAQARALDQLPKDKRGPLHGVAIGVKDVIYTKDMPTAYNSPIYDNNFPKVDAASIQILRHAGALIFGKTTTTEFAATVVGPSTTNAHSAKRTPGGSSAGSGAAVGDLQVPLALGTQTGGSTIRPGSFNGIYALKPTWGAISREGQKLYSLILDVLGLYARSTADLDLLAEVFDLHDDEASSFQGVTGAKFAFCKTPNWDHAGQGTMNALEKAVSLLRSHGATVEELVLPEAFDKVTLWHHIILAGDGHAAFLPDYRTNKDHLDQFLQGHAERIGGWTRKQQLEAFDGIANLRPVLDEIAGRYEAIIVPSVPDEAPEGLESTGSAIFNSMWTALHTPVVNIPGFKGANNMPIGLSLVAPRYRDRHLLKMLVYPIAILALTGAALAAPATSATNFTDVNVYSKASGYKPCIIRQPKCCPSNIVGFTLSGPPTLKCVDPESTKSQSKFLSSCEENNLIPYCCTPEIPLIGSRCRRILKE

SEQ ID NO: 2223 - protein, 262 aa, Unknown
  Kingdom: Fungi, Phylum: Ascomycota
MLHQYEWVRQLSANPENNVIGLVRNKTATYAKINSDPELEGRSNIYILEADLTDYNAIKQAAADTSEITGGKLDYLIQNAGVVPIFDAFDGPGTLSGQPEGITKSLRDVYEVHVISTVHVFNLFLPLIKEGSAKKVIATTTGYADDALTRDYGLYVAPFYSASKAAQNTIVAKYHAQYAEEGILFLALAPGSVDVGQFDGLTEEQQQKLAITGQKFMKYEPDFAGPITTDASIKLMLDVIKNATIEENGGDFLSQKGNKRWL

SEQ ID NO: 2224 - protein, 1197 aa, Unknown
  Kingdom: Fungi, Phylum: Ascomycota
  misc_feature (692)..(695): Xaa can be any naturally occurring amino acid
MATTSNMFMYSLTIQSPSNVVQAVLGQFAGTKEQLIASASGSHLSLLRPDPSQGKVVTLLSHDVFGIIRSLAAFRLAGSNKDYLILATDAGRIAIVEYLPAKNCFSRLHLETFGKSGIRRVVPGEYLACDPKGRACLIASVEKNKLVYVLNRNAQAQLTISSPLEAHKPNVLVVAMVALDVGYANPVFAALEIDYSEVDQDSTGQAMEELETQLVYYELDLGLNHVVRKWSEPVDPSASMLFQVPGGNDGPSGVLVCGEENITYWHSNQDAYRVAIPRRKGATEDPSRKRSIVSGVMHKLKGSAGAFFFLLQTEDGDLFKVTIDMVEDEEGNPTGEVKRMKIKYFDTVPVAASLCILKSGFLYVASQFGNYAFYQFEKLGDDDEELEFSSDQFPTDPKASYDPVYFYPRPAENLALVDNPPAMNPLTDCKVANVTGEDAPQIFTICGDGARSTFRMLKHGLEVNEIVASELPGIPSAVWTLKLNREERYDAYIVLSFTNGTLVLSIGETVEEVSDSGFLTSVPTLAAQLLGDDGLIQVHPKGIRHIRNGAVNEWAAPQHRSIVAASTNAHQVAIALSSGEIVYFEMDSDGSLAEYDEKKEMFGTVTCLSLGDVPEGRVRSSFLAVGCDDCTVRVLSLDDDSRLENKSVQALTAAPTALAIIAMEDSSSGGSTLYLHIGLHSGVYLRTVLDEXXXXLFQVTVEGKTCVLALSSRPWLGYADPITKGFVVTPLNYVDLEWGWNFSSEQCEEGVVGIQGQSLRIFAIDRLGDTLIQKSTPLTYTPKKFLKHPEHPIFYTIEADYNTLPPELRAQLLADPSAVNGDSQVLPPEDFGYPRGSRRWASCINVIDPLSEEGQALQRIDLDNNEAAVSVAIVPFTSQDSESFLVVGTGKDIVVNPRSSSEGYIYIYRFLEDGRGLDFIHKTKVEDAPMAMIPFQGKLLAGIGKTLRVYDLGMRQMLRKAQADVAPQQIVTLNTQGNRIVVGDVQQGLTYVAYKAATNKLIPFVDDAIARWTTCSTMVDYESVAGGDKFGNMFLVRCPQKASEEADEESAGLHLINARDYLHGTPHRLNLMCHFYTQDIPTSITKTNLVVGGQDVLLWSGIMGTIGVFIPFISREDADFFQSLEQHMRTEDPPLAGRDHLLYRGYYAPVKGAIDGDLCERFTLLPNDKKQMIAGELDRSVREIERKISDVRTRSAF

SEQ ID NO: 2225 - protein, 706 aa, Unknown
  Kingdom: Fungi, Phylum: Ascomycota
MASKGNSLRDRQIASLKKILNLNETVETSETDEAHANGLHAPVAPILDADGNPIWKVLVFDDMGRDVISSVLRVSDLRSMGVTMHMHIASSRHPIPDVPVIYLLEPTSQNLQSITNDLQKELYSPAYINLLSSLPRVLLEDFATQTATAGTSDKIAQLFDQYLNFIVSEPDLFSLGMQKEHTYWALNSASTSDADLDRMVDRIVSGLFSVIVTMGVIPIIRCPKDAAAKLVAERLDRKLRDHILNSKDNLFSSSRTGSSGTPSSRPVLILLDRNVDLTPMLSHSWTYQSLVHDILNVKLNRITIETPTDEANPSKGSTKKSYDLTASDFFWAKNAGAPFPQVAEEIDSELLKWKEDTQALTRKTGVQDIESLMQGDTGASAQHLKAAITMLPEMRERKSTLDMHMNILAALLTGIKNRQLDNYFQLEETVMKLAKSQILEIIKDSDKGTEPEDKLRLFIIWFLNTEQEVNRSDFQGFEKALADAGADVSSLPYIRQVRATTKMTQLATINNANQQAASSGDLFGRFSAISSRLTDRLKDSGVPTGLSANFESLISGVKNFLPADRDLTITKIVESIMDPSAAASSAIAKTENYLYYDPRSANARGTMPPPSATRGAGVGSTPGGLPGSQGPGQTASFGQRRQGFSEAIVFTIGGGSMDEYGNLQEWVARTGGDRGKKRIVYGSTELVNAGEFVRDELARLGKEVSG

SEQ ID NO: 2226 - protein, 503 aa, Unknown
  Kingdom: Fungi, Phylum: Ascomycota
MLVLEEQRYIHEDLERIEQAIADRIADEPRHIRDRLNRDHEIEQLLSQVQSQSKSLIDIYHDENKSRAQEIQRIGTGDPFEEFYRQLKEVRDYHARYPNEPAENSEQRYKAKRPDGELMPYIVDSLFSGEEAYGRFFDLNTCHEAFLNLPNARRLTYLQYLEFFDNFAPGYGGVKRGEKLTDQYFKYVGELASYLESFMRRTKPLENIEKILSSFDKEFEVAWDKDELPEWQAEKPNTEGGSKATSTAEAVFCEDCEKEFKNENVYKNHLNGRKHIKAAEARKQRQQDGSGGKLASTKGGFSATRLKERAVAEREFRVKRLASAMSTERGDTRVNVERKQGMTERERQQELDNLLNMSDTPQQAAADDEGEDEDGEEKIYNPLKLPLAWDGKPIPFWLYRLHGLGVEFPCEICGNFVYMGRRAFDKHFNEARHIYGLKCLGINNTSLFRDITQIEEAMKLWEKIQREQKRTTVDDGSVVQMEDGDGNVMPEKVYYDLQKQGLL

SEQ ID NO: 2227 - protein, 888 aa, Unknown
  Kingdom: Fungi, Phylum: Ascomycota
MPAHLSPDVIAVDPDEQDHLRPLNRSPHPYHHQSYELPHPSDRFQFQNSTARASKAGGDLDDGEGPGANGYTKYPDFSKESTPGSESGTEADDEHFLKGLPAPKARLHKGLRGRNEPLSGSGSPLPSPSIREEDETAAHDEQLRAAVEKARIIDILRRNKNLCRRATEAGILAALGGLVASNPKVTPLVNTWSKDLQTCVALYVGLLILYPLRVITWHHRKQPASSSLPLKLPHNFDPAPLLYPPAITLFVAFLVATDTPSVILPDVILALSSIPQQLIPKADRFAPYDPLHWLIACCPLVRAAWTGEPVLGLQLPAALPEETLVLLYPIHQTLCGVLHHLTTTSLLTAELQLLSIGLINVLLLAVSPQIKILKSLLWVGGLAILVSCGGVIRSGITLARVPRWRFRTATTSSKSTFWRNLYAVITWRRKTKHDLLSPAYDEGAYDTPCTSDGEAISPTRNALTRVRTLGLQGDPKADGDPSPSSPENPHGYAILRRHTLPHPDGAPSKRNTHTPSGRRKRATSVSVRPFLRLTYTQAVMRKWFYATYVYICMALTIVFGIRVFIQQEALNGEEPIGWGLGYAFGELPWFRFKVVNANLERWICLPPRTEEGESKHCDQGIVPRLRHDLGEANTRLAITGYWLVIFVTGLMVVFRLKDIYEVDTRRKVFHFMMVGMLLPATFVDPTFAALVLFLVLAVFLILDLLRASQLPPLSKPIAAFLAPYVDGRDFRGPVVISHIFLLIGCAIPLWLSLASLPRTGSGYLSGWEVPTRDVSMVAGVVCVGLGDAAASLIGRRYGHRKWLWGGGKSIEGSVAFAVAVFFGLAAAGAWLHLGGWVKSGDGLGPVAYVRNTAFCASIASVTEAVLTGGNDNVIVPVVLWTCVKALDV

SEQ ID NO: 2228 - protein, 376 aa, Unknown
  Kingdom: Fungi, Phylum: Ascomycota
MSAAEEHAYFSANPPPKNLQAHISLAQSFINHHAALSRRVVLVTSGGTTVPLERQTVRFIDNFSAGTRGATSAEHFISAGYAVIFLHREFSLAPYSRHYSHAKDGLLDFLELDEASEGGMKVKVRGQEGEKMKDVLKSYNAAREGRLLLTLPFVTIGDYLHELRAISRLMAPLGPNGLLYLAAAVSDFFVPPERMAEHKIQSTDAVKNFPNAQASQNAAEPQQAQEEEESFDNFDSSPTVPRSKRLIIDLDPVPKFLKSLVDGWAPQGMIVSYKLETDPAILVHKARYSLDRYQHHLVIGNLLSTRKWEVVFVSPGRDDQWIRVAREGGWGDAEGRPLRAEELPKEDPASEVEGLIIPAVMELHGEHISRTQKASA

SEQ ID NO: 2229 - protein, 729 aa, Unknown
  Kingdom: Fungi, Phylum: Ascomycota
MVYRTAQRTMASKPPRKTSSARSSSSRLPSTQPDPENNENEPPKPSPKKTASFRSDSSKETKLSIPTTGPSKPDAFETADQSDDDDHIEITRASVDLDELPIELVQLIDNFVASLSAKVHSAPPNIDRLSSLFQDFYATASSHIHTHMATVATRQSRNASPAPSVSSISSAASRLRARTASGNLMSARDKEAEQQMITTQELTERKRARKALEARKALLEEIVERRLCEGIYSRIYRHRSTQDEAQDDKLRSKTAALELVGIGPIDLGIDLGQDESGPISEEVKAKSKDIREWLEAARKDLIQMHNSRYPLGKVNHLKAAHKSIVDTLAHFHPSASADEIMPMLIYTLITLPPEHLNVISDMHFIQNFRWEPKLTGEAAYCLTNLEAAISFLQTVDLATLRADELPSGPPKQATVGDDKAETFPPAYQQALTEATQSAAGTDEATALASKPAESPAGLKAATVLRNRRLSDLVNTPAQAFGAASDAVITTADQGIKTISNSLGDSYKFLLGKLREHQQGPDQSIIVPRTLDDARKLVSTPPPDEDDNVGPLGARDQAELPKRQTSRAEDRVLSLFNGGRDRSADSNRSAGSAKRLLSTEDIPKAIPSSQGQNPAMLEQVRNLSNSFNPMARLGNIGPFRGFGRSAATTPVPPTKDVAKPATDGGDLATAFPDIAAALPPKQTPKIAPPNRRFMELQTPGDLRLGEVLDLLKDYRRLANALQEMGAFEEK

SEQ ID NO: 2230 - protein, 311 aa, Unknown
  Kingdom: Fungi, Phylum: Ascomycota
MLYDLNIHWSPSTTEAQLLQTLTLASSLGYGTVALSHTLTLPLPSQFKKPLPDVPASNGQTKLPLVLHRATLPLSDPSASNYRIPSLAAFYDILAVRPLTKDAFHNACLTLDVPLISLDFTQHFPFHFRPKPCMAAVNRGVRFEICYSQVLNPNADARARANFISNATSLIRATGGRGIILSSEASSALLLRGPADVVNLMSVWGLSNDKGLEAISATARGVVVNEGIRRSGFRGVIDMVKVPRDNPDSKQSSGRNDNKTYEHQKPESNHANQKRKTGEDASTGQAMSKRQAKKMKLAARTNTDAASQKSK

SEQ ID NO: 2231 - protein, 712 aa, Unknown
  Kingdom: Fungi, Phylum: Ascomycota
MAEQEDKTTFFAPEDHQVAYVFHPDDVEARPGRPVKRRKVSKPNLKTSSQAQAAMDFVPLLNGAEKPAAVHQRERLFGEGWGEVHGRVQTVLRESNSATLDQVKSFVGEAKVEITDKIPSAFIITGPDIAAQDLLFEQLSESLQQSLSSKFVRLRSSDGTTLKATLKKIIRDATAKGDDADEDDLRIGTGQNERRYLDYDLEALYSLVKQSDCEHVFVAFQDSEGFESGLLSDLILLFKYVLVKLAIQNHDTNHVQFMASKDSLHPAIWHRNVCGSASGETPQTGTILESVFRTAVAAKDVPMRLGAPLLRSLLDRQHEQVAGIQAFTSSLKYAYMCHFYANSLSALCDGKGTEVLQTEHIEAARNTPSFRREIDRLVASGDAANLVQAKELLENDDLLRQKIGSSGTERDAWVDKSLRALLISEAAGAQEGTFSEAYVHALEAGISAEDVSRVSSKVQRMEAEDVAKLVQRVVDILGTGDHSLRLDPSDVEMDHALHDALIVQGRALDQLRATATEQDIPLRSKYSGQSRVMRTTVIAQRVQLSRDTAALRDEDKRFTEIIDEVVKLLAGYLSLPSASSIFLSEAWLYDSRAPLRDVLVPRPQIVFKRCLTRPHDYLGCSCCKSNDDEGGIQATLPSTSILYQMYQETGNLINVADLWTAFYALVGSDEGDEGDERKALSAFYRGMAELRALGFVKPSKKKADHVAKVKWL

SEQ ID NO: 2232 - protein, 154 aa, Unknown
  Kingdom: Fungi, Phylum: Ascomycota
MVKAVSVLRGDSKVSGTVTFEQADENSPTTITWDISGNDPNAKRGFHIHTFGDNTNGCTSAGPHFNPHGKTHGAPSDEARHVGDLGNVDTDAQGNAKGSVTDSLIKLIGPHSVVGRTVVIHAGTDDLGKGGHEESLKTGNAGPRPACGVIGISQ

SEQ ID NO: 2233 - protein, 740 aa, Unknown
  Kingdom: Fungi, Phylum: Ascomycota
MADEGVDITTSRIKEWKSIVTLIVFVLTNCIVLCPFPVPIYVPRTWADKVHDLLVKWRIIVSRHDHPTHVARRTSRLTGLPKRFIRYNFPMNFITAPLIADLFLLAVGAIGRREVKEGTIGSDNIKPYDIMIFFITLAYIAISIDASGLIRYLAFKVLQWGGRVGHRLFFYLYALWAVLSAAVGNDPVILSGTAFLAYMTRVSSNIVHPRAWIHSQFALANIGSAILVTSNPTNLVLAGAFEIKFVEYTAYMIVPVALTVIVLFPFLLYIVFQDEALIPQSIKMHDLPEEARARKPVNPNIPNARGAADEDQNTDDNDQTKLLSLEEIMNPFLDKGGAAFGGIIMAATLATVLAINASASDDKEHFVFYVTLPAAFVMFSWDMVFGWIHRHETREIAARGRQELEEARREKAARRERGDQTPGHGQNALLAGAVLNAEEFHNGSDKATELKTLTPNATNSLPPPTLVISEDGDGPDNREKVPDESQDHDRSTPDPTETELPRNTNTEATSTDSAEQTREKQDMSTHVGSDAMAPQRISIDSLLRRGHRWAQETFPTPVAVLTHLPFALVPFAFAMFVLVQALVTKGWVPVFAHGWDHWVEKTGTVGAIGGMGFLGVILSNFAGTNIGTTILLSRVIQAWVEIHRSGNNNSPITERNFWATVYSMAIGVNYGAFSIAFSASLAGLLWRDILERKHITIRALEFARVNLPIIAISMTVGCVVLIGEVYIMYSDKKYYVVPES

SEQ ID NO: 2234 - protein, 152 aa, Unknown
  Kingdom: Fungi, Phylum: Ascomycota
MAPRKVNDGDASAPGLTAAENKFIKTMFDNMKTRPDADWDKVAEQMSLKDAKCAKERFRQIAQRHGWNNKSESGSSKITKKKPAAGRGRKKATPVKNREDEDDDDDEEMAPEEVKRLVKKQAAGPKQTPTKEESDTEEGGVKSEDDEKDWEV

SEQ ID NO: 2235 - protein, 486 aa, Unknown
  Kingdom: Fungi, Phylum: Ascomycota
MSTDVGPKNSSDEGKSSPAPSAEVAEVNEKALLRKIDRHLLPAVGVLYLLSFLDRSNVGNARIEGLTTDLNMTGNEYLTGLTLYFIGYVLFEIPCNIILKRTTPRFWLPTLTIAWGVVATLMGICQSMAGFFVARFFLGVTESGLFPGVVFYFSMWYKRRERQYRISLFFCAASLAGAFGGILAWGIGHMRGTVWHNSWRWIFILEGIATVLIAGAAYWFIQNYPDTATFLTPVERKFIHDRLAADSDATHDERFTWANVLSALKDPKCWLYGVGFHTMSLPLYTLSLFLPTIIRDLGYTAAVAQLLTIPPYAFAFITTLSIAVISERQGQRAIFIGGSALFAAIGYIILLANKDPIAKPGVSYVGTFFAAGGIYPATALVLSWPAINVSGQTKRAVGNAMQITIGNLGAVLGTQLYRSNDGPRFVVGHSFALGYLVANVLLCAVLRWVLKRENQRKAAITTEEVHSIGSIDSWPGDSDPRWRFEY

SEQ ID NO: 2236 - protein, 445 aa, Unknown
  Kingdom: Fungi, Phylum: Ascomycota
MSTAFRSITPFLRTARQGLRNGSANPLQYAMKKQTTAGALNICRTYAVFERTKPHVNIGTIGHVDHGKTTLSAAITKRQAEKGLANFLDYGAIDKAPEERKRGITISTAHIEYSTENKHYSHVDCPGHADYIKNMITGAANMDGAIIVVAASDGQMPQTREHLLLARQVGVQKIVVFVNKVDAIDDPEMLELVEMEMRELLTTYGFEGDETPVIMGSALCALNNQRPEIGQEKIDELMAAVDSWIPTPERDLDKPFLMSVEDVFSIAGRGTVVSGRVERGVLKRDEEVELVGKGLEPIKTKVTDIETFKKSCEEAQAGDNSGLLIRGVRREDVRRGMVIAKPGTVKSHTQFLASLYVLTKEEGGRHTGFGEHYRPQLYLRTSDESIDLTFPEGTEDASSKIVMPGDNVEMVVTMTHANAIEAGQRFNIREGGRTVATGLATRIIK

SEQ ID NO: 2237 - protein, 191 aa, Unknown
  Kingdom: Fungi, Phylum: Ascomycota
MFHNGLSLVALLAIISPFQIVLGDLVVNNHCRKDVTIVLSQNGGCDKGPHGCTRDGNAPWKLSGSKKKSVWRHAWQGEAVSVKIGKKGKDGILQYEYSHNGEGLWWNLSDLDGKGPGLVGTPFRSDRVGITPSGEGSGQGNCVKIRCKPDEVCLDSYQNPDDPKTRYCPKNTGDMTLDLCMPKQEFSRNFP

SEQ ID NO: 2238 - protein, 466 aa, Unknown
  Kingdom: Fungi, Phylum: Ascomycota
MAPAIANGLHDVALIQEKAYINGEWVSSMSGKTFDVSNPATGQIIGTAPECGTDDLDAAVNAASKSFHTWRAYSGRQRGRILRKLFDLIVENKVDIGKIITAENGKSKLDAEGEALFAAGFFEWFSEEAPRIYGDVAPHSAPNSRIQVLKQPVGVCGLITPWNFPIAMASRKVSAALAAGCTVVLKSDGVTPFATNVLAVLGERAGIPKGVLNIVTALENTPKLGLALCESEPVKKISFTGSTRVGKILMQQSSSTLKKLSMELGGNAPVIVFDDADIETAVASAIIAKFKVTGQTCVCANRIYAQDGIYDSFSKKLVEEVHKFNVGDGANSSVTHGPLTIGINKTEEHVQDAVKKKASILLGGKRLTSLGPNFFELTVLGDVTDDMAVMHEETFGPLAALSRFKTEDEVIKRANAAEVGLAAYLMTSDLNRQYRVSERLEFGMVAINTGVISDPAAPQVSRIRNT

SEQ ID NO: 2239 - protein, 319 aa, Unknown
  Kingdom: Fungi, Phylum: Ascomycota
MPPYASQYSPSFKKMDYARANRRKGIQMANVLGDPFALATISISMLAWVIAFIGTIVATVQVEDLSRFPWWAIVFNLFLTLGVFVVIASDTVHTYHVAVTTFSGVGLVLASTSVNALIYKPLPALQAAGAGYILLCMVAITWVFYFGSTPSSTPRAFLDSFALTKESATLHRQTMNAYGATGRPETSNSVQPPQMYTSAQLNGFENPSPIGGPGMNGPRTSQLNGGFNSTAPNGGTPGVGAQPTKTTSPGADTEVVPPTEYPYRAKAIYSYEANPEDANEISFSKHEILEVSDVSGRWWQARKESGETGIAPSNYLILL

SEQ ID NO: 2240 - protein, 491 aa, Unknown
  Kingdom: Fungi, Phylum: Ascomycota
MSVPHKSDNAEDSCLKNHTAALGQQGTETNSHGPIGPMRTGQKGDLPAASNSDEPPSESPPLEQTVGDAYDDKFPEGGIAAWLVVFGSFCALFAVYGLINTSAVFATYFKDHLLSDYTPSQIGWIFSLYLFLVFFAGVQVGPVFDRHGPRWLVAIGCLLIVASLMLLSLCKVPDQEPAEYYQIILTYSVMGGLGGALLNAPAYSAIAHFFNARRGLATGIASTAGGIGGIVFPLLLRHLLSPEGVGFPWSCRILGFFMLGLAIPANLFIRSNPKVQALEHGKPKSASLWPDFGVFRDVGFALASVGFFFMEWGLFVPLTYVVSYGTAYSVSLSDSSLLLSLLNAGSVLGRFLPGFLSDKLGRFNVIIVTIALCAVTVLAIWLPARGSYAVLIVFCVIFGVASGSNLGLIPVCLGQFCDAKDYGRYYATSAMFASFGTLSSVPIAGALLEIEDQDTGWTALVLFAGCSYVVALVCYIAARVLMVGWLPQTKF

SEQ ID NO: 2241 - protein, 856 aa, Unknown
  Kingdom: Fungi, Phylum: Ascomycota
MQPPPRSQARAPGSFSPLPGAASQGAPPGPGRPPPPRRVESSESDDSGAMAPPPPINVNKARSVRGGSPVTPIYTQFANSSSASLGGQHQNFSRPGGGTPGGRSGAAASSPLLKGHSRKHSATQGLFEPTLPSTSTSNLSQVSALTASQIAAQAAIMSHQNSQQQQQNQQQQQYHQNQQHGYHQYQHQHNRQRSQTVPFPGDSNDGMRRGSGSKAPLSPPTLSLTEASAPRESAFSHHGSQQAERPGGGSHSLAAAAAANVVFPRSGHSSPREPSVSPQTFPSMPPPPVPPIPEKQSRSEKAKAKLFSRPGKISTKGEARDKPLPSPGKIGSALSALQRANFSTSSLLDSSSHSMYNLNNSSSATIRALETPTEERAKEKERKHHFLSRQKHKLKDEYHLPLSSAASNSLPTDPNAPSSLYNFNVPASPGPNSTGFVKAKKEKRLGERSDSRLDNDSTLGSQSDWPGPSSLPSLSQQTSYMYDPVDPTRLGLHNHMTLDDAWPYLRAKLLVVFEGEDLRLPVEDFNRVVQMHIQYCIHKRSPNSMLEDLRDLLAAGFSSLDRTLRKAPEDRFIPTLVELWLFTFTSILPYIQAVFLPLDLEVSGCGTIMSREQARDFWGGVKASTGGNRQHRVAPAAAVLDVRRLVLVAYRDIVILPRYDTLKTIFSRLSLEFLPSSLANMALASPPLEAAALSTSPSESFSSMARPGTAMSLDPSLASYNSNSSTLLNDGSAGGRSRAISNVSFGSHASDGVLRPFTPGGGVPHQVLGSVREQNVEDSKQVTDMVGRMLQCMSVLSSLGGAGDDEREGGNQARMEELCKMLKLNWLGRGRTGRNRRGMVGGRVKREETREEVRVS

SEQ ID NO: 2242 - protein, 479 aa, Unknown
  Kingdom: Fungi, Phylum: Ascomycota
MGGGEAIPGFPHPNPLASYWQLPPHHLAQYRSTENLPVAQTWDYVIIGSGITGAAVAYKLLTRDPSLRVIMLEARTAASGASGRNGGHVRAGWHLNFSRNADAFGDDVAFAFERFEADNVADVAEFVRDNAVDCDFRDVETADVYTNPVAWADALDVMRRREEALRQRSTAVASAQWRVPERHVLHGEAAQARIGLPSAVGAIIYPAHTQNPYKLVCNMLELSLQKGMNLQTQTMALQVIPPSTSTEGTCHTKTWTVMTDRGNLKSSKVVLATNAYTNALHSRLRGTGFLVPARSQVSAIRPGSNIVRHPVMADTSVALNDIGLGDYFMVRDASLSGAGDVLYGGGRSISKSFNTVDDSILNEDVATYLKHAGFQTFGSEAWGDEGPSVRDWGGITCYTPDTFPLVGEDTFTYSHTGLWMSVGMNGHGMGLAFRCAEALVEMMMTGMTPDWLPEPFKLERVWRDARWGSAYATSGCSTE

SEQ ID NO: 2243 - protein, 361 aa, Unknown
  Kingdom: Fungi, Phylum: Ascomycota
MPRALTLTKVDGKPGEVYYPLRIKDVPRPKPGKGQLLVQLSAAALNHRDLFQRQLLYRAVSFENPILADGYGTVVELGPSVKQSQLLNRPVILTPMRGWEEDPVGPEGVMAVTGGTTLTEVGTAQDFVVVNEEEVMAAPEHLTAAEGAALPLVGVTAWRALVTKAACTTPGKNLLITGIGGGVALQALQFAVAFGVNVYVTSGSQEKLDKAIAMGAKGGVIYRNDSWEKELKSILPKDRPFLDAVVDGAGGKIISKVTRLLREGGVIAQYGMTVSPKMDWVMPAVLANIELKGSTMGSRREFRDMVAFVSKHKIKPVVSRVVKGLDNLEAIDGLFEEMEKGKQFGKLVIEIDSRSSSPSKL

SEQ ID NO: 2244 - protein, 258 aa, Unknown
  Kingdom: Fungi, Phylum: Ascomycota
MGINSHISEPLSVLDLACGTGVVTDLVQKCVQREVLERSRFRAVDASEGMVAVTRKRIELEGWVNVDTEVMDAKMMRFPDSSFTHLAAALALHMIPEPDVVVRECIRVLQPGGIFGATTFAAANSTQWFVRDLDTAFASLPIQVPRLVSIPMQMHNDGDWTDARWIESHLTKLGLQDVMARETPGSYRFESAEDWMTTFEGMMNWMMSLKWDGETRKKMPAAEVKEKVLHHLREKYNGRGWDVDWTTIVMTGRVPAHT

SEQ ID NO: 2245 - protein, 983 aa, Unknown
  Kingdom: Fungi, Phylum: Ascomycota
  misc_feature (706)..(714): Xaa can be any naturally occurring amino acid
MAHALLLRTDSSAAFNQFPQNVGSGSQPSMSNTPRASQLSGSTAFAGSSSSIASTVATATPQNGGNIVPTGNIINQKADASRSLYQICVSLKQRLSLVPGFEPYLEQLDPLDPVDPLWNLLRTGYPLLAIYNALQPTEPLKVEDLNASEAKKPKIAIFKFVQACMKELKVAPGDCFVITDLMGNDTSGFVKVIQVVNLVLDLAEERGLLMQSQPYPEDESMMPAVGGTMSYRDHIVKELVDTERKYVQDLENLHDLKRTLEQKGDVTGDVLHQIFLNINAILDFQRRFLIRVETTNTAAKENQRWGAPFVTYEEAFDIYQPFIANQRKAAHVAQQVFDKIQLSAHPVAADFNTLDGFLLKPMQRLVKYPLLLKDLAKKTDDMEVKSELVAGCDAAERVLHKANDAVNRDLLDEALEELIVRVDDWKNHKVESFGSLLLHGVYGVITGKSDQEKDYEIYLFESILLCCKEISPGKSKDKKDKTRSQGSKVRNKNAKLQLKGRIFMTNVTDVVSLSKPGLHSVQIWWKGDPGVENFTIRFTNEEAMKKWAHGLDIQRKENAPRMSAASPDAIAPDFAWTQAQASGLENPYLQQDDEDDEDHSNATAPSQFPLPRMGSSSNLRQRSMTSESSQSLASIARAPAPRYPLPAPPPPLSLQTQNNGANSPGARAMDSYFSPIDHSPASSRTSTASGAFSSQGYNFPKTATPXXXXXXXXXTMNGRNPRGPSLPAMASRNSDAQQQRSRSYSTPDINAQSGNQPRSRQPSQGHVPAVPGIPQHLHPAHDSAIPRSNTGSPRNELPIRAQTQSPGVQRERLHGHSGSLGGQMGQFPSQPIYSRSGTPGPPAGSLRVDSAAANSRTVSPALGTATLPPPSAHSLTSPDMPLPTQLKVRVNCDSGNYVTLVVAFNITYQSLIDRIDAKLARFTASSIGKGMLKLRYRDEDGDFVTIQSDDDIQIAFMEWREGVRNMYSGGVGEIELFCVGDTS

SEQ ID NO: 2246 - protein, 166 aa, Unknown
  Kingdom: Fungi, Phylum: Ascomycota
MSRFSRYDTDEERLPEGMTRVAYDADTQVYTFQDADGSYWESAPGNQFGQLTKVGEEPHHSLIYSNASRPRPSWRRDMMPLLQFGVIIGVFLLVLFWFLRVSAGGSALQCPEGTSKYIIQPDDTCWAIAQAQGIDIKDILTYNEGVDCEKLVIGSTMCLLASTSPV

SEQ ID NO: 2247 - protein, 729 aa, Unknown
  Kingdom: Fungi, Phylum: Ascomycota
  misc_feature (36)..(37): Xaa can be any naturally occurring amino acid
MDDYGLTMSWHFQQLHYHHLSIANSMLHSPWQHVCXXPRSSLGRASRYLKSLFPFLTWIRRYNSAWLGSDLIAGITVGAIVVPQGMAYASLAKLDPEFGLYSSFVGVMIYWLFGTSKDISIGPVAVLSTVVGNLVHDVNTSAPDVAPYAVAASLSILTGSLVLLMGLLRCGFIVNLVSAPSLAAFMTGSAITIIVSQVPSVLGLTGFSTREAPFKVIMNTITTIDQANVNAVLGFSALILLYLARSGFTLAAERSPKHRATLQLLNSMRAVSVIVLFTLVSWFAHYSTALEPTFDVLGTIPKGKVFVTSKSLEAYADVGAGFQQFGFPPVNPDLFITIIPYLPATIVVMLVEHMAIAKSFGRANNYSINPSQEMVAIGMTNLVGPFFGGYPSTGSFSRTAIQSKSGARSPLAGMVTGLMVLLALYLLTAAFFYIPTAVLAAVVIHAVGDLITPASTLRQYWAVSAVELLVFSVGVLASVMKSIETGLYASVALSTVALLYQSLRTRAGDAQIRLPLQLRRCVRNMKASRIPSRQYGTFEGPQEAGSQDYRLNLVDKAARLPHPGVVVYQLPTSLDYINSARSLHELTSFVLKHTLSSAEIPSNLPKEQSWSPPEFETEASRDNLMLSPLQAIVLDFSMTQSVDATGVQQLVDLKKQLDAYASPTVLEWRFVHIDSRQVQKALQGVSLVRSVDPSQTPIDERGSVETQLGCTLLTGMAPDEEPQGEQWQP

SEQ ID NO: 2248 - protein, 545 aa, Unknown
  Kingdom: Fungi, Phylum: Ascomycota
MTTEAKNPERGAVVHDKRGSSGDDDLIHGGVGGGDASTQNGSIIDAQEFLYSEDRKIGVTGAVFLILNKMIGTGIFSTPSGVFAATGSVGVSFMLWLVGGILTFCGLSIWLEFGLALPRSGGEKNYLERAYRRPRYLMTCVLASQMILLGFSSGNALAFGRYALFASGSASPDGWTARGLGVACTTFAVVLHATFPKTGIRLFNVLGVFKVVILLVIIFAGFAALAGHRRVPDPGNFHDAFAIQSGDGYGGGGAYAYSNALLNVIYSYKGWENANYVVGELKNPRKTLAIAAPLAVGGVTVLYLLANVAYFAAIPKSDLATSEVLVAGLFFRNVFGDSAAARSLPVFVCLSNLGNVLAVSFAHARLNQELAKEGMLPFSRFWASNRPFNAPAAALFLHWIITVIVLLAPPAGPAYNFIVSLYTYPGVWINTFVTLGLLYLQWTKSESWSSPWHTYLPVSVLYILASVFMIVVPFIPPEGSWNADGYPYYVFPIVGVAVLLLGVLWWVIWNRILPRLGGYKIVAERTFDELGAEVVRYRKVSVKHD

SEQ ID NO: 2249 - protein, 205 aa, Unknown
  Kingdom: Fungi, Phylum: Ascomycota
MARASKEPGKTTLMNAYGVGQPLSSSIGPVKDGPKPPKHGLILMDTPGYGFGSRTEWGQNILTYVEKRKALRGAMLLVSAEKKLTEEDRWILEQLASASTRVIVVLTRVDKLRGRWEETCCQMGHRLKEAAEDLERSLSLKFPVDIYAVSAHSAGDGTRGGIGGLRPAILDMAGIHVGETKVEQTKENVQYTGKIVSFDDIQWKV

SEQ ID NO: 2250 - protein, 153 aa, Unknown
  Kingdom: Fungi, Phylum: Ascomycota
MSDFGDDPIGNDGGDEPTYEDDELNEYYDPEVGDDEEQGQQNGAEDDNIIASGDPSAAANAARSGPGAIKDKKIPDEERTTTPYMTKYERARILGTRSLQISMNAPVLIDLEGETDPLLIAQKELKEKKIPLIVRRYMPDGYYEDWTCEELLQ

SEQ ID NO: 2251 - protein, 448 aa, Unknown
  Kingdom: Fungi, Phylum: Ascomycota
MDARRASSEDGPSSSHADEPSPPARRRTSMDEDFFYRRVMTSAPAPRPSRPPPYEDKVSAPAAGRIGSVGHSWLGGGGSDGRCDSAITDDEATADNLPRYSPSVAIEGVFTKKHEIENTIKRAEDRHWHTRFVTLNGTALNIYNAKKDWGWGRTRDGPSISPDNPPWIRKGKLEKSYSLLHADAGIAADYKKRRYVIRVRAEEDQFLLCCIELETFVKWLECLFAAIDVAAPIDDRDFPRDMSIPRIQRIRWFRGQSPVRISPENETREIGPRQEEDEVPSIPTPTTPPPRRRRSSTPDPLPSPDLLSETREPSSAPGDEPQSEPELDQELQHEPGNDPGSIPHIPHRIDPSYRLSTSSYPNPAINPHSGKWFPEHNWSSAHDLLYAKLCYSNLLFRSPRKSNYIISKGKQWYVDWGTGRMVRVLPPTYGEIDWFGPWQVVHTENRRI

SEQ ID NO: 2252 - protein, 457 aa, Unknown
  Kingdom: Fungi, Phylum: Ascomycota
MASVPPGSLFTGNAAPLLLRHLRHILPLPPRLHQHPALSSLLRSISIIPICHYRRRGLLPSMKSALLTAAALIGSAQAGVHKMKLNKVPLEEQLASSSIEQQVQGLGQKYLGAHRPTSRADVIFSAQAPKVDGVHPVPVTNFMNAQYFSEITIGTPPQSFKVVLDTGSSNLWVPSQSCGSIACYLHSTYDSSSSSTYKANGSEFEIHYGSGSLSGFISNDDVSIGDLKIKGQDFAEATEEPGLAFAFGRFDGILGLGYDTISVNKIVPPFYQMVNQGLLDEPVFAFYLGDTEGESEATFGGVDKSRYEGKIEWIPLRRKAYWEVDLDFIAYGDEIAELENTGVILDTGTSLNVIPSSLAELLNAEMGAKKGYNGQYTIDCEKRNTLPDITFSLSGSNYSLPATDYILEVSGSCISTFQGMDIPEPAGPLAILGDAFLRRYYSVYDLGNNAVGLARAK

SEQ ID NO: 2253 - protein, 327 aa, Unknown
  Kingdom: Fungi, Phylum: Ascomycota
MAHLTNPLATPDQLYNRNSLSSLPQDVQEAVFIATQCLTQAAGLLLDLPQSVTAQANVILARYWLVESPMAHEFSVRDPHVSWQALRHPEIQTNKKQHASAASIFIVSKMGPIPRSPRDISNVYGYLLSQDSALFKTESSATNNPKSYYQSESDYYAFHNHVLAIEPRILYALSFDTHVSLPHPLAITYLQTLDFLAQPKKRIAEQVIHHLNTALLSPQLLYLTHQPNALATAAIYAAARDVGAKMPECAWWEVFDVDREELGFLVVALRSLEGWIRTRRQEMPWMGDGVVTRKIVVSELKKRGLQVGNGDQVVDEEQAVMDMLDNR

SEQ ID NO: 2254 - protein, 472 aa, Unknown
  Kingdom: Fungi, Phylum: Ascomycota
MADQQSLHREQLADDQLQGGSGQGLSQRTETDTSVVLRSQARAGAWWSRWRSPLLFAGLAALLTPLAYLFNMEGPIDPTNYSERTKRVLCGTPLIDGHNDLPWQLRIELHNRLYDNKVDFTQRLLGHTDLLRMQQGQVGGQFWSVYVDCDVAQQHFEDPSWVVRDALEQIDVTRRFIEQHPKHLAYCDNAACVRKEFRAGRISSMIGIEGGHLLGGSIAAIRQMHNLGARYITLTHNCDTAWGTSASTVAAGHPDKGLFTLGAQAMMRDVMSIVRAPVIFSHSGAYSVEPHLRHVPDDVLRSVKKNNGIVMATFVNRFLNMKNPEQATIHDVVDHILYIAELIGWEHVGIGSDFSGTPHVPLGLEDVSKFPDLIELLMKRGANDDQIRLLAGDNILRVWAEVEERAREIQATGELPVEEEYEGKKWHKGLKDSPWMLRQSRTEAQTNGAADKPYMFNVDNEGKHNPLVKNNP

SEQ ID NO: 2255 - protein, 104 aa, Unknown
  Kingdom: Fungi, Phylum: Ascomycota
MASVFALGAGAAVAAFLGRAGLVAWRRSRGGVGAMGKAFYKGGFEPKMTKKEASLILSLNERAITKDKVRKAHRTIMLLNHPDRGGSPYLATKVNEAKELLDKA

SEQ ID NO: 2256 - protein, 269 aa, Unknown
  Kingdom: Fungi, Phylum: Ascomycota
MPLYKPENPDAPVLPQFSLRGKVAAVTGGAKGIGLEITRALAEAGADVALIYSTSTDAEAVAARIASQTGVRVRAYHSDVRSRAAIAATLDQVVADFGGGRLDIVVANAGVCADVPALEYTEEQWRANNAVNLDGVMWTAQAAGRIFKSQPGGRGNLIVTASVSATLVNIPQRQAAYNASKAAAVHLAQSLAVEWVDFARVNCVSPGFIETDMLYTQPKERFDKWLSMIPGGRMATASELKGVYVFLASDACCYMTGANIIVDGGYTLT

SEQ ID NO: 2257 - protein, 498 aa, Unknown
  Kingdom: Fungi, Phylum: Ascomycota
MPTTSSRNALMGWLRNLFDKDRHAAKPSKKHKPKARSHTDTSDSDTFISSLNGPDPSPYDKSKPSETTRGPPPVNRPSIAIIGGGIAGLALAIALTKRNVPCTVYEAGDSLATVGAGIGLGSNSLAALDLIDPRLRGLYDLAKTGNERDAFKNCVFDALLAEPGLGMYREPPWRKGIVSAPYFERSSAHRKDLLNILESFVPEGTVKFSRRFSKATQLPNGKVEVLFEQGERILVDAMIGCDGIYGASRKAVLGDIAPDAVPPSYCNMYIYRGIVPMPDAKSILGEHGGDSKRFMGRRRGAVIYPIARGCDANLMFYVRHDGEWTHGSRTVPCTREDMKREFEGFDIRLMKLLETVEPVRWPVYTHRQTPTFYHGRMCLLGDVAHATSPHLAAGAGQSLEDVVVLANLLALVRNPDQLETAFQVYDTVRRPRSTAVAESSYRAGLMYCFEGPEGDDMGRIVAQANRLFRDIWEHDLEADAREAERLFTKSLAAGDAKQ

SEQ ID NO: 2258 - protein, 626 aa, Unknown
  Kingdom: Fungi, Phylum: Ascomycota
MDEVQMTLLDMSANVQKTASLKRSHDAFANDSVVKPENEPSLRAIPPTTEQPSLESANLQDQRSPCLSPGLTDGGSSTPARQSPSPLTPSKNETSLKPSPFNAAAQSSTSPKATHASTNGPAPKRKRLTVEEKEKREKEEAEKKKEREEKQRQKAEEKAKVEQEKAARAAEREEKRKKKEEEDRIKAQQRDEKKQQREEELKRKQEAEEKKAKSQPSLKSFFGAPRVAKETNAGPSSSPQNAASSSTVTKAMSSEYAKMFQPFFVKEHTRMARPANQMDVETREVKSKILDEYISGQRVHELSPFDPVKLLELPSRPPRRGRVHDPVRHIMETAYKAMETAQNSGGNEADNIMRETRRKLAKIPVKVIAFSRDVRPPYYGTATYKPFLLGRPNLRILAQKPVERTLELDYDYDSEAEWQEDEGEDVDVDDDEEELDDEDDMDGFLDDSEDAGLARRIFANTMEPESTGVCFEGDRSPDPILQEHKMEYIHELLGSDEAIDPWSTAYWEPDPKKTTVTKTIPPTEQSTKMAPPPAPANAFAMLSKSVSASTDGVKLVRDDILNDVKRAILANKLLSKVGMVDVVYQQFRDRSSRAEVKNTIEIVAEKKKGANKLKEWELKPGHELKL

SEQ ID NO: 2259 - protein, 625 aa, Unknown
  Kingdom: Fungi, Phylum: Ascomycota
MAQPQHQVPPRPFSPAQHSPSPAASQPGFALPPNKRPRTDGAPSQPESPYPGSPYAASPAAVATPPATTASPTYPQAANTPAAYATPYTNGNTTPGLSLPNAQATGIPPLQTPQLPQQVQQQYTAATMAPLPHAATPAQAAGIMGPPQRPADRATKDYQYDPMDSLAGTGIDLSAEEKFMSELYANAFDSEARTGFPQHPAGSKGSFYGAGSANQGAETLAESEQDKVARESAERAWSESAMRLAVQRTQEIKDPFLLVALLHRKADKIAREHSIGLNLEYKNNVPGMGKMKLPDQFPAPKVTVTTKPGPDSTALVHTTGSFVPHDAYLVDQLALLSIASKHRVRELLEDASLIATTRQKTSHGEIPEDWAVAAAPLNRDPIGESGGAVAAESAPSPGTNPLKRPANGAMPNGTSASKLPKIASFMTATMREQAKKEREWEEARLRMRQKRKDGTVDRGSTTSRANSATPATPGSVAPEPEKAMTKKEMKKNQAMKAAEAHSHANQNMTSSMFAGLGGRSGLFGKKKAGKSYDWMNVGRGGSGTSTPTKGSLGAGKGVGAVPGSPAPANMALTTEGRNRLGTWREDKEKGKKIQLRDWVTALERDGREAKALQRAYLALDLSDPR

SEQ ID NO: 2260 - protein, 467 aa, Unknown
  Kingdom: Fungi, Phylum: Ascomycota
MASRYSAARPKRDGENFARTHHNDADGLDPKRVKFDVRNPSTLAADAREDDAILDADVIGGGIATKRGAVNLDGYDSDSDNENFNARANRRKKGNVDIIEKLDSYEKGGPTENSQADQADNDDDDDDMFRVDDDDDEEAKGDDEPSEFDKSGRKKKNVQFLDVQDIAGQEFDSKTGSTIRIDDQESSDDEADVDLAIEEEGVDEEVGAGGLKRNAPKVEAFNLKQEMEDGQFDEAGNYVRKAGDVDAVHDGWLEGLSKKDMKKAAEAHQKREAEARKQRFEDDAVQVSELLKQLILRLEKAETPLEALARLGKGQTKTKKVPKWKLKKRSGMDVDEKKDEAEQDPEQVRIKEAIDTITDAADKLLSRDYEDIYDQEREMLVREYRKETGEEWVEPQVAQEQAGSEDASSEDAEWEFRWTDGRDGGGTQGPFKGPMMKAWQEAGYFGDGVEFRRVGGEGQWSRAVSFT

SEQ ID NO: 2261 - protein, 240 aa, Unknown
  Kingdom: Fungi, Phylum: Ascomycota
MMVLNPFKACQGSPTFQEEYRHPEYTPGFIQRGYSHDIVGPDTPYVAVAGTRQLYFIDTRHDPSTAAHIKAQIEHAFTGEDDEYIKVDELKATAEVRNRKTGQTTFVFDPPYARVLFAAGINQRNPDIKLPEHKLAGDWLVTYSPPPTGTSTLEKRRPCTDYQCDSNADCRRMTFDVCTVCAQYRLDDICHSGTSNAIGICHPACGRKVDTPRHDGETDAEYYQRMDKLHWGDESSEPAV

SEQ ID NO: 2262 - protein, 271 aa, Unknown
  Kingdom: Fungi, Phylum: Ascomycota
MPTQMSKRLHGKTILITGASSGIGRSTAFEFARTSPESLKIILTARRIDTLREVASEIVKEVGNGVKVHPVQLDVSNADQVREFVKSLPEEFKEIDVLVNNAGLVRGVDKAPEIKEEDISVMFATNVTGLINMTQAILPQMLARNNGEGSGDIINLGSIAGREPYVGGSIYCATKAAVRSFTDSLRKELISKRVRVISIDPGQVETEFSIVRFYGDKSKADAVYAGCEPLTPDDVAECIVFAAGRRENVVVADTLLFPNHQASATILHRKS

SEQ ID NO: 2263 - protein, 217 aa, Unknown
  Kingdom: Fungi, Phylum: Ascomycota
MPYNTSAILPRKEPTGTNQLPLSRVKKVISQDSDIHMCSNNAAFVITLATEMFLQRLAEESHNQAKLERKPRRNIQYKDVANAVASHDHLEFLEDVVPKTVPFKKIKANALNTQARLNDDQAAEAQISSSAAAAAAGRPSTAVSNGVASVNTSPKMIVNGEAAATGTFSVPPRVEPDINRRVSIGAVMTEDDPSQQLAMEMRQAAGSGRDSDVHMTG

SEQ ID NO: 2264 - protein, 378 aa, Unknown
  Kingdom: Fungi, Phylum: Ascomycota
MFGTLPDFTPRDSHSLWYISTRNPGPPPGLFESLNAEANINGQHGAHTRQQQRDHHKLLERTALARLGADEVYMHRRRLNIQNFGSGWLKPPGIPKTLHQLREEKREQEEHQEALRREQLQQELAEAEAGGMPGDEDGTMDDVQLDGAQDLDDMIPEAEDEFEVDDDDDEEEDEEEEEQEEEDEDANDADETGNIDEEHLREVRQNELMAARVRSNNDAFREAIVRGDPDGDDMYGGAEELVEEVQGHMLDEDDFADNSLLQPGANGSLLDDEDMGVDLDDEIPEAESGGYEHTDSEAGLSSEEEEDDDEEDGEEDEEIGFAPRSALLAPPRSPTLRGRTSASGPRASMNLSGLLSQDESSFMDSSPAAPGRWAQGRQ

SEQ ID NO: 2265 - protein, 603 aa, Unknown
  Kingdom: Fungi, Phylum: Ascomycota
MPSYTTLADGITEVDVILAGGGTAACIVAGRLAEADPGLSILVIESGPDNRGVESIENPVFFLDNLAPTSRNTHFYKANKAEQLAGRECVVPAGGVLGGGSSINFMMYTRAQRHDLDSFNAPGWNSKELLPFLKKLETYHGPGSKDVHGDSGPVNVSYGTHRSKIAAPEFIRALDTLGHRTVIDLQDLETNNAASAWLRTVSPDGKRQDTARCYLHDKMENPAYPNLHILTESKVVRVLLDDDNRAVGVEYTPSAEHQPAGLSTTIRPLKQVKAKKLVVVSCGAIGTPPVLERSGIGNPAILKRAGVPLKVDVPGVGTDYQDHHLILYPYLTSLPEDETIDSILRNPASRPELFKAKDARIGWNGIDMSSKLRPSEKEVQNFSSALQKRWDSDFRDEPNRPVMLSAIVNGFLGDPQSVPKGSYVTAGNYTAYPYSRGHVHVTGPGVDDPIDFDCGFLNDEGDTDLELQVWAYKKSRDAMRRTSMYRGELAVGHPAFPPDSPAACQAASGPSDQPFQYSAEDDKAIEQWVRENVNTTWHSIGTAKMAPRDQNGVVDKDLNVHGTKGLKLADLSILPVNVGANTNNTAMLVGEKAADIIIKELRL

SEQ ID NO: 2266 - protein, 328 aa, Unknown
  Kingdom: Fungi, Phylum: Ascomycota
MSKNILITGAAGFLGPKLASRLLSDSNYKVFLTDLNTPSVPSNAANPDNCTCIQADLCDPTSVAGLLSAATGWHAIFIFHGIMSVGAEENPALAERVNLDATRALLKAIADLDTPSGRKPRIIYASSQAVYGPPYTTSGSITDDTPPTPAGVYGTHKYMMELYVNDMHRRGRIDAFAVRLPTVTVRPGAPSRSAAAWLSGILREPLQGLECVVPTRDRTIRNVICSPRVMIENFIRLMNAPSDAMPSNVRGVYAPGIVVTVQEMYDAFVKVCGEEKLELVREETDEEAERLLKGWPQNAEFGNAKRIGLLFDETCAQIFQEYVDSLKQ

SEQ ID NO: 2267 - protein, 257 aa, Unknown
  Kingdom: Fungi, Phylum: Ascomycota
MHKGLFILAYFGIFSSVVAYSHDSLFQLDIITPLPQSAGEQELRFQPGLDYDSDGCYNTAAIDPNGNTNPGKKATKRVEGECRSRAQLDNSNAYSRKRCNNGYCAIMYEYYFEKDQAIGGSFLGGHRHDWENIIVFIKGESIMRVAPSCHGDYKNAKNTFQIQGDHPLLVYHKDGWGTHCFRHATDDDQLHIENPFGVWFRSPLVGWNNWPSNDLRQKLIDTYNGAATPKLPDDRFGNVLKEAAGSSVPGFDPYLDE

SEQ ID NO: 2268 - protein, 601 aa, Unknown
  Kingdom: Fungi, Phylum: Ascomycota
MPQTTTSLYPPASTDLFKFPSRRSVIHSTEGIVACTQPLAAKCGLEVLRAGGNAADAAVAVAAGLNMAEPCSTGIGGDMFILFWDAATKSVKAMNGSGRSGAKYTLDTIRKDLGLDESSRGDIPSSSAHAATVPGAPAGWVDTVARFGSGKVSMSEILAPAIKMGEQGFPVSEAAAISWSQSEKLLRNASPNYAEMLKADPNAEGGVRAPAAGEIMKNPTLAKTFRALAEQGKEGFYTGRIAEEIVKVIQHLGGHLELEDLKHHLEVGSEPVEPISLKFTGLGLGDDGLELWEHPPNGQGIVALMALGILQELEKQRKIPTFGPRDFNTAPYLHAIIEALRLGFTDAQWYVADPNVVKVPSQGLVSSEYLAKRAELFDASKVMGDIEPGKPSFSSPALRSSDTVYFTVTDSMGNAASFINSNYEGFGTGIIPKGCGFTLQNRGSNFSLDKDHPNKLEPRKRPYHTIIPGMVTNIKDGSLHSAFGVMGGFMQPQGHVQVLLGQAVGGLNPQQALDAPRFCISADKPNEKGIVEWTVNIEDGVPETTVDGLRKLGHNVKVLTGLQRAMFGRGQIIRSSQDPVDGTHVWSAGSDMRGDGAAYPA

SEQ ID NO: 2269 - protein, 413 aa, Unknown
  Kingdom: Fungi, Phylum: Ascomycota
MAIGKSSPVAVVGGGAWGLSTALHLVESGYTNVTVFDRSHSVPSPYSAANDLNKIIRAEYEDPFYTTLTLEAIERWKTPLFGPNLHQTGYINCTSGRAPQRSVDTLAKNFASASCLPTFANEIRILREKKDFNNVAWQLTGEVTGFNGYFNRLAGYAHSGNTLARVQAFCASKGVRFLLGERVGKVEAFIYNVCGRCTGVRTADGSTHDAVVTICALGANAATLLTEDEVNLLRGIPVVNVRDLGFFFEPDPHTRLLKLCPLGGGYTNTGVDGVSLPPGSVSEPGWGSFVPPDDERKLRALLREVLPWLADRPFVDNKFCWFSDTPDSEYCIDFVPGSSNSLVVLAGDSGHGFKMMPTVGKWVLELLDAGRQALPRWQWKSNQGKAAWEGGVSWRVGNSKEMRDLIDPGLENN

SEQ ID NO: 2270 - protein, 578 aa, Unknown
  Kingdom: Fungi, Phylum: Ascomycota
MDVDTVPREAKRKRSNFEDALNAEPSNAGAISRINTQSNTDNGAVKVKTTRPDLKSRHEQKKARRQREADAQYGRGKKINTKSIHDKKLKRNLKRLEGKYQEAALKAKDAEILLEHTSGFLEPENEVERTHEVRQEDIVDSVAVETAQKRFDLKLDHFGPYICEYTRNGRDLLLAGRKGHIATMDWREGKLGCELQLGETVRDVKWLHNNQFFAVAQKKHVYIYDRQGVEIHNLRKHRDVTHMEFLPYHFLLSTIGATGVIKYQDVSTGQLVSEVPTHLGQPVSFAQNPYNAILHAGHQNGTVTLWSPNTGTPLVKLLAHNGPVRSLAIDREGRYMVSTGQDRKMAVWDIRMFKPVHNYMTRQPASSVAISDTGLTAVSTNTYTTVYRGLFDKNAAVQQRVSQPYMRWGGEGRRMERVKWCPFEDILGVGHDAGFSSLIIPGAGEANYDALEVNPLETAKQRQESEVRGLLNKLSPEMIALDPNFIGQLDLRSEEKRRAEQDLDAGPVDVAEEIRKRARGKNGALSKYLRKQRKKNIIDEKRLKVDQIWEERQQKNKDKREEKQADLGPALARFARKE

SEQ ID NO: 2271 - protein, 201 aa, Unknown
  Kingdom: Fungi, Phylum: Ascomycota
MSMIVCKARQATPFLRLTEEGPLLEPLEFSGKLLQGLEAAVKADLEPDRVTKIQILALMHLNNDGVGGNDRSSNHLAHAISTAWSLSLHWRVPGIPNQEQCSYLWWSLTSLDRLNKPLMGAAPFMIDDADVALERPEKTCNTYRSHVINVTLTMGDLMKKATKVYKATSTARCDDQGDFPLLSDVTSGTSFNEFLRSHQGQ

SEQ ID NO: 2272 - protein, 717 aa, Unknown
  Kingdom: Fungi, Phylum: Ascomycota
MLPKCVFALGLASLVGAQCPFADPGRLAARAEGREGGSRSHLEEYEIDDNDVYLTSDVGGPMEDQESLKAGERGPTLLEDFIFRQKITHFDHERVPERAVHARGAGAFGTFTSYGNYSNITAASFLSAEGKETPIFIRFSTVAGSRGSADTARDVHGFATRFYTDEGNFDIVGNNIPVFFIQDAIQFPDLIHSVKPAPDREIPQGATAHDSAWDFFSQQTSTLHTLFWAMAGYGIPRSYRHMDGHGVHTFRLVTDNGDSRLIKWHFKTKQGKASLVWDEAQHIAGKNADYHRQDLWDAIESGNYPEWELAVQIVDEEDALAFGFDVLDPTKIIPEELAPLFPLGILRLDDNPVNYFAETEQIMFQPGHIVRGIDFTEDPLLQGRIFSYLDTQLNRHGGPNFEQLPINRPVVPIHNNNRDGAGQNIIHRNTAPYTPNTLNNGSPKQANQTQGRGFFTAPDRKASGSLVRKRSSTFADHWSQPRLFYNSLTKVEQQFVINAMRFEMSHLSPRVQENVLVQLNRVSHDVAERIARALGLKAPEADDTYYHNNKTADISIISSELPTIATLQVGVLASISSNGSLSDAAAIKEAFKSDNVTVTVVGETLANGVDVTYSQAEAVGFDGIVVTAGALSLLDPRKRSSLYPPGRPAQIVADGYNWGKPLGFLGDAKASLQSIGVGNGDGVYIVSGTDEVVKDLRKGLATFKFVDRFALDDESKN

SEQ ID NO: 2273 - protein, 242 aa, Unknown
  Kingdom: Fungi, Phylum: Ascomycota
MKYTYLFAVVIAALAGETAGTPTGQDIVARGKPVATLCKKYAYHRDNGYEILNNLWGSQSATGGSQCTYYDGRVGKGVAISSDWSWEGKPNNVKSYIYANRVFTRPLISKIASLPTKVQWSYNTTNIRANVAYDIFTDNDPNHPNSSGDFELMIWIWLHRFGGIWPITDSRLGQPVGRVDIAGYSWDLYLGWNGPMRVYSFLSAEGPIYSFSADVLDFFDYLRDNYKFPVKSQYMLTLLKIV

SEQ ID NO: 2274 - protein, 302 aa, Unknown
  Kingdom: Fungi, Phylum: Ascomycota
MPRFFDPVSLTLRFLTKPSNLTHSLTLVRSMSSSSASGRLAGKTILVTGASSGIGRSTALEFARTAGPASNLRLILAARRVDSLRELADEIQKEVAGVKVLPVKLDVSNADEVRAFVGSLPEEWRDIHVLVNNAGLVKGLARSPDIAEEDMATMFNTNVTGLINLTQAILPIYLSRPNGGSGDIINIGSIAGREPYAGGSIYCASKAAVRSFTDSLRKELIATRVRVIEVDPGQVETEFSVVRFYGDKEKAKKVYEGVEPLTPDDIAEVVVFAATRRENVVLADTLVFPSHQAGAGVLHRKS

SEQ ID NO: 2275 - protein, 409 aa, Unknown
  Kingdom: Fungi, Phylum: Ascomycota
MKLSSIVSAYWLAATAAAVPALVPRADAEDQAAVAELTDSIRASILAELDEGEEKLAKRGETATCHAGNVVFRREYGSLSKAQRLDYVNAVKCLQQLPPRTPASVASGAKSRAGPTAQFDDFVVVHIQQTLQIHFSGIFPPWHRWFVYQYEKALREECGYKGYQPYWDWAKWADAPQDSPIFNGDPYSLGGNGEYIPHDGPVIVPPPGVGGGNISLPAGVGGGYVTTGPFANMVVNLGPVGGMADSPPGVDGGLGYNPRGLKRDVGPAMNMRYANYSTVLNLLLKPNLEQYRLLSEGVPYTPEIGPHGGIHYTISGDPGGDLFTSPGDPAFWVHHGMMDRMWTFWQSLDRQHRLCAISDGDYGHITWANEPPSRKVRLTDVIDMGYAGDSTTIGEVMDTLSGPFCYFYI

SEQ ID NO: 2276 - protein, 1780 aa, Unknown
  Kingdom: Fungi, Phylum: Ascomycota
MANRMSMYSMASEAMGGPRAGGPQTAQVSTTTLLNAVHNIYLNGQAHGLDASTSLVVNTWLTAARSGGTVDATLASRAFEHARRRAEDGCIVLGSLHGSTPSLMGPMLSSLPFPTPSMLHKALEVVQPFVRCCTPYNPAMSRHVALAATLTLNLTGKLESASLSLSQGGIDTTNGLLSIPAEAGYRAFDVFYYLLTSVSTPAEREFLGLKSASAYALLEKSGTYFPPSYLPTADDAAAADDFRQALKDIGIKGSAHRNLISILAGLLKLGNTLDYDLDVEALEEMCEDVGGLLGMDPEVLVQQLSTEDRRTLVGGLYEALVDWVISKANTAITAQMGRIKDGVESLDGYGTHASVSGDDNGDTVTLTVIDIPDPTLGKAFSMKSIFDDSQGLNAEMIADGIEISPTGSSVMKEVQQAVAEVAPDLGIMTGPTGRDRQRDLEKREVVLEKVGFAAEEDGFLKKLLFPIEGEGINLGLAGRFDLMHVLASSRVWYHLSLHPTDDSPANLAGLPSVTSAWSAGVVSRQLRSWRLPEWANRRNRVCDYTADFDVDEFVRRYGVLGCKDGREGIEAWMLERGWSNGEVFIGKERVWIREGAWWEAESMLDVGSNMPQNPFDTGFDTGYSANGSGYFPTPFADQFNESNDQLHNRNVSQVSLGRNNLAVAPSIAPTAQRNVSNGDYGLGNKGDTYKDDVFYTAEGDFTGTIDADLAKGKHIQTKEVGMDRRIWVAVVWALTFWIPSPLLRYVGRMRRPDVRMAWREKVVLCFFIFLINAAIIFWIIWFGDLLCPNKNKVWNTQEVAGHSSGDSYYISVRGKVYDMTDFWRRQHSDSTIQTTNDRMMDLAGFDMDDYFPMPLDRACRGLGIKETTRLITNNTPEFEIAVHSSGFYADRSSKKLQNENWYWDDFLPAIEEYYKGHLVFKTSTVQSQGTNEQRKWVRYGNEIYDLTNYFNTQNLQPDVAIYEFLNQQVSDLWANNPGDDIKDQLDDIILQSKGTNNEASIRNSWTCIQNIGFKGYTDFRDSARCQVNNWLLLAFACILCAVILIKFLSALQFGSKRRPQPQDKFVICQVPAYTEGEDSLRKALDSLTALQYDNKRKLICVICDGVIVGQGNDRPTPKIVLDILGVDPKIDPPALPFKSVGPGSEQLNYGKVYSGLYEFEGNVVPYLVIVKVGKESEQQKAKPGNRGKRDSQILLMSFLNRVHHRSPMSPLELEMFHQINNIIGVDPELYEYLFMVDADTSVAEDSLNRLVSACAHNAKIAGICGETSLENDEKSWWTMIQVYEYFISHHLAKAFESLFGSVTCLPGCFTMYRVRTADKGKPLIISDEVIKEYSICDVDTLHKKNLLSLGEDRFLTTLMTKHFPSMSYKFMPDAQCKTAAPESWSVLLSQRRRWINSTIHNLMELMRLKEMCGFCCFGMRFVVFIDLFGTIMLPATCVYLGYLIYVIATGSGPFPLIAVVMLAAVYGLQALVFILKRQWQHIGWMIIYIIAFPIYSFVLPIYSFWNQDNFSWGNTRVVVGEKGNKQIVAVEDEGFDPRSIPLQRWDDYALMNNLPGRRGGNEKPEVYGDQYDTMDEMKSVYSVGPQGSVMTGLQGRNTFMPPQSPAFNMTRASTMTGFQNQPLMSHRQSLMSMGTGVDRQQTQSPYQDFPANRAGSTMSLRQPGLSPGLGPMSPGLGASRSASALGYSHSASVLGYSGGHRPPLGEGMQSTTSFDFQRGTVGPDDHAIVESIQSVLAEVDLDTVTKKQVRALVEQRLQTELVGERRTFMDKQIDRELEMM

SEQ ID NO: 2277 - protein, 461 aa, Unknown
  Kingdom: Fungi, Phylum: Ascomycota
MMLSRTPGVVAAAVALLPTMVSGQSPYSLASPDAIKQTASDAVWDLMQYYKGNLTGQTPGILPGPPPAGPYYWWEAGAMWETLIDYWLYTGDSSYNQEITAGMQWQVGPNQDYMPPNVTASLGNDDQGFWGMAAMTAAEMNFPDPASDQPGWLALAQGVWATQANPDRHDKTCGGGLRWQIPFANNGYDYKNSIANGCFFNLGARLARYTGNDTYAQYANETWDWIEKIGFLDNSTYAIYDGAHVETNCTDINKAEFSYNNAVFTLGAAHMYNYTGGSDLWKNRVQKLVDHGLSQFFPHGIAVEPACETQKTCTTDMLAFKGFMHRWYTTATKVAPFIAGQVLPVLQTSANAAIKTCTAGNNGRQCGFVWTTGAFDGLMGAGQQMDVVGAASSLLVDNVHPPLTAKTGGTSQGNPNAGQQRDKFNANFAPITTGDRAGAGILTALVIGGIFGLFGWMSMGD

SEQ ID NO: 2278 - protein, 442 aa, Unknown
  Kingdom: Fungi, Phylum: Ascomycota
MRPSLASGAIAATLLPSLISAQTPYSLDSTAAIKQTAATAVWDLLQYYHGNVTGATPGILPGPPPAGDYYWWEAGAMWGTLIDYWFLTGDSTYNQEIMTAMQFQVGPNQDYMPPNQTASLGNDDQGFWDQPGWLALAQGVWNTQASPDRHDETCKGGLRWQIPFANNGYNYKNSIANGCFFNIGARLARYTGNDSYAKSAEETWDWMESVGFIDPNTYAIYDGAHVETNCTDINKAEFSYNNAVWTLGAAYMYNYTGGSDVWKTRVEKLVEHGLSQFFPQGIAVEPSCETHDTCTTDMQSFKGYVHRWYATTTKMAPFIRDTILPVLQTSAAAAIKACSGGALGRQCGFVWTNGTYDGKIGVGEQMSVVAATSSLLIDQAPVPVTANAGGTSKGNINAGSNSDNLNRHETPITTGDRAGAGILTALILGSACGLFGWMSTGA

SEQ ID NO: 2279 - protein, 706 aa, Unknown
  Kingdom: Fungi, Phylum: Ascomycota
MSGGLTCAWTLEEALHGLAGSPGVNFAPSGEWSYATSFPAPIVMGAAFDDELIEKVATVISTEARAYNNVNRSGLDYWTPNINPYRDPRWGRGHETPGEDPFHIKSYIKSLLRGLQGGVNPQTLKIIATCKHFTAYDIEDWHGNERYGFDAIINSQDLAEYYMQPFQQCARDSKAGSFMCSYNALNGVPTCADPYILQDLLRTHWNWTDPGNYVVSDCDAVQNAYLPHGFKPTREETVAAALQAGTDLDCGQYYPLHLPHAFSQGLFNETVVDNALVKLYSALVRLGYFDPESSSSYRSLGWTDVSTPDSENLARQAAEEGIVLLKNNGILPLKIPKDTNSQKLSIAFIGGWANGTTIMQGTYAGPAPYLHSALMAAQNRTGINALYAGSPGDPTTDGYPRAISAAQQADVIVYMDGPTTADESESNDRNLIRWSGERIDIMTQLAGMGKPFILAQMGDQIDNAPFLMHENVSAIIWGGYPGQAGGDAILNILTGEVAPAGRLPVTEYPADYVNQVPMTDMSLRPNKATGNPGRTYMWYDNATLPFGYGLHYTNFSVSVENAKGGNKKSEWAISDLATGCSETYKDLCPFLNVTVSVENTGQVTSDYVALGFLAGDHGPSPRPLKRLVAYTRLHDIKPNSSSKTTTSLSLSLGSLARHNERGDLVLYPGEYKLLVDVPTAAEWTFELTGEELVLDKWPQPRERAGT

SEQ ID NO: 2280 - protein, 486 aa, Unknown
  Kingdom: Fungi, Phylum: Ascomycota
MNTQTTLAALMLAGSAVAETIHGVVVFSRHGDRTAKWYGNAKLTSLGAEQVFQVGSEYRARYLNSSSPQQILGISEDQYVGSQVFASAPNQPVLLNTATAFLQGLYPPLKDLDPELASQTLNNGSTSTSPLDGYQYVVLQGVGDNSPDTIWIKGDDACPAYTNASKSFSQSDEFKTRSEETRDFYAKFYDMLHDGVYNIQPENLTYANAFNIFDLINVAHIHNETSPAANVSESDLFQLRTLADSAELDRNYNQSQPARAIGADTFSGAVLSHLNQTVASQGKMKFSLLAGSYDTFLSFFGITGLVNVSNDFNGLPDYASTMSFELFTEATMTSFPQDQSDLRVRWLFKNGTTGELKAYPLFGSKVADLPYSQFVDEMGKLAITDVGTWCSKCGSPDDFCAAYNKDDSASTKSDDSSSSSSSSGSGSGGMSNAVAGVIGAFVTLGVVAVVGGVAFLFMRKRRGNAVQHAPAEKRPSVGSDGNSGHV

SEQ ID NO: 2281 - protein, 400 aa, Unknown
  Kingdom: Fungi, Phylum: Ascomycota
MRFAPSLVALAGALAGLPGTALAGYNANANNNIAIYWGQNSYGQGSGPLAQQRLAYYCANTNINIIPIAFMNGITPPMTNFANAGDSCTAFAGNSWLLDCPQIEADIKTCQSQYGKTILISLGGATYTQGGWSSPSAAQAAAQQVWDMFGPVSASSSVQRPFGSAVVDGFDFDFEATTNNVAAFGQALRTLIDSRSVSKPIYLTAAPQCVYPDAANGPALQGVVAFDFIMIQFYNNWCGTSNFQEGSSTQNAFNFDVWDNWAKTVSANPNVKLLLGIPANTGAGGGYTSGSKLRAVINWSKQYSSFGGVMMWDMSQLRISTTATSNNNNNNQDDFVFRPKNNVIFWSKNNNFIVFQDEHNFSQDEHDNVNHQHTQNHLHDHHLASCTDQFPRERMGPVRR

SEQ ID NO: 2282 - protein, 551 aa, Unknown
  Kingdom: Fungi, Phylum: Ascomycota
MRFSSSALALGAAGSAAAFQDQKVLGGNAIKPIINADLGADRASWFGQLEKVFGEATDEVKAIWDEVSMLAPDAMEAAKKSLLGVPPKPHTRRPNDKWDHVVKGSDVQNMWIEGEDGESRRKVGGKLENYDLRVKKVDPSKLGVDDVKQYSGYLDDNENDKHLFYWFFESRNDPENDPVVLWLNGGPGCSSLTGLFFELGPATINKKLEVVQNPWSWNRNASVIFLDQPVNVGYSYSSQSVSDTWSAGKDVYALLTLFFEEFPEYAKQDFHIAGESYGGHYVPIFSEEILKHKDRNINLKSALVGNGLTDTYTQYAYYGPMACGEGGYPAVLDESQCQSIENAVPRCQSLIQGCYDTESTWRCLPASIYCNNAIMNPYMRTGQNPYDIRSPCEDSDSLCYSALGWISEWLNKREVMEALGVEVDSYESCNFDINRNFAMNGDWMKPIFRVVPKLLEEIPVLIYAGDADWICNWLGNQAWTEALEWPGKKGFNDAKLKPLKLDSESDEYGKVKSSGNFTFMRIYQAGHMVPYDQPEASSDFLNRWIFGEWLA

SEQ ID NO: 2283 - protein, 526 aa, Unknown
  Kingdom: Fungi, Phylum: Ascomycota
MHGLPRAPNHFFLIFSLLTLLLVLIADMSPLSRSAAAGFILGVFQLVQPAAGADVDVSWYAPSSRNVNNLTEAVDGQGTYGFIFDTSKTPDKLYGTYNWCNMPHVRKREYPRAARGYELRYVELIQRHHKRTPYSSNAFPVEPYTWDCDDALLHYYGEPVHGQSAARAYRQGTISSINPFVPSGWIGSCQFPQITAEGLDDSWVHGKDLYAVYGEMLGFLPRKGDKNLGEKVKYRATNNLITHQVAGMVINGMWDTTDDFPLLVQAANVDSLEPQYPCSTGSSIFSNIKSSNNPAWKKHLDLSANLFSTLDAISGVSPSDGGFHASFDHYYDNLSARQCHAGKPLPCKVNATGPCVTQDLANAVYRMGQWEYSQMYRDSPNSLAASVSSYGVWVAELAAHLRDVVAGKTKTLYFHNVAHDGSISRVLSILQFDEMVWPGMGSEIVFELYENKGVPPPPHGTPAPAHHPRRPESKGKFYVRVLFGGKILKSSSPTLGVMDMVPVETLLAYLDALVGENASKVQAKCN

SEQ ID NO: 2284 - protein, 423 aa, Unknown
  Kingdom: Fungi, Phylum: Ascomycota
MLSILAKSVAFLATLSVASPISFPAEVSAPVERQSSGYANAVYFTNWGIYGRNYQPADLPASKITHVLYSFLNLRADGTVYSGDTYADLEKHYPDDSWNDVGNNAYGCVKQLYRLKKANRGLKTMLSIGGWTWSTNFPAAAASASTRQTFAKSSVTLMKDWGFDGIDIDWEYPKNDQEAANMVLLLQAVRDELDAYSADHANGYHFQLSIAAPAGPDNYNLLKLQELGALLDHINLMAYDFAGSFSDYAGHQANLYPNPDNPNSTPFSTDVAVKAYIAGGVPAEKLVLGMPIYGRGYTGTDGLGKPFTGIGQGDWEAGIWDYKSLPKSGATVEYDNVAHATYSWDPSTKELISFDTPDMVSEKVTYLKDLGLGGSMFWEASGDRTGAQSLIGTSESALGSIDGTQNCLTYPDSQFENIANNLE

SEQ ID NO: 2285 - protein, 726 aa, Unknown
  Kingdom: Fungi, Phylum: Ascomycota
MYYKPLTAFTIATQLLARALAQDWESAYSKAQSALGRLTLSEKVGIVTGVGWNPGGECVGNTHPVGSIGYPSLCLQDGPLGVRYASSITAFTPGVQAASTWDLDLIRQRGQYIGEEFRGTGAHVMLGPVAGGLGKIAEGGRNWEGFSPDPYLTGIMVAETIDAVQGVGVQTAVKHYILNEQELNRETMSSNPDNRTTHELYLWPYVDAIHAESSSVMCSYNKIHGVWACESDFAINTLLKDRLGFKGYVMTDWAAQHSTALSANAGLDMTMPGSNWDGGDVYWGPQLQTAVTNGQVPESRVDDMVTRILAAWYRLGQDTSYPNVNFDADVAGNHAENVRACARDGTVLLRNEDSILPLTSPSTIAVIGSSSVVGRHARNQCQDGGCNDGALGMGWGSGAVDYPYFVAPYDAINERASAEGARVVLSSSDNTGSGASAARGADVAIVFITADSGEGYIEVEGNRGDRNNLDPWHGGNALVEAVANANENVIVVVHSVGPIILESILAHDSVKGIVWAGLPSQESGNALVDILWGDANPSGKLVYTIAKQRGDYGTQVVSGNDDYDEGLYIDYRHFDRAGIEPRYEFGFGLSYTTFEYGNITIEAVQPIAPGPATGEVISGGPSGLFEDVAVVSVPITNTGDVDGAEVAQLYLAYPPSAPATPPLQLRGFDKVRLAAGESGTATFTLRWRDLSYWDTGSDTWVVPSGSFGVSVGASSRDIKQEGTIEV

SEQ ID NO: 2286 - protein, 583 aa, Unknown
  Kingdom: Fungi, Phylum: Ascomycota
MRVLQLFALGLQACSMASAVVLEEVQQLPQGWHQVSGKPAPDQSMLLSIAVRQPAIENIGRSMVRKDARHLTRDEARKLQQPCPQAVSSILEWLEQNGVSDGQPIEDFVQVRTTVQKVESLFNATIQNYTFKDKTPVRRTQRYSVPDELAQDIKFVHPLANFMSPKKELTTRMPADDEDANRLAARDTPCSTTTTPQCIRQLYGINSTAYAGHNKTVRLGIAGFLEQNANYVDILTFLNRSAPEIAAKGYNFSTELINGAQNEQNPAYAGDEAALDLEYVMPLAYPAEITYHLAAGRGPQLDDSGEPVPDEFATNEPYLEFLEHLLEKSDDEIPHVLSISYADDELSVPRPYAERVCSMFGLLAARGTTVLGGSGDGGARGARNSSCLVNDGSGRKAAMATFPATCPWVTSVGAVTNEAELTGAAFSTGGFSQYFTRPSWQDKAVEGYVDTLGGHLEGLYNGSMRAIPDVAAIGTRFSVLISRQVTKLQGTSASTPVMAALISLVNEARFRRGKPSLGWINQVLYSDKVRAAFADVTNGTSQSCEFADGSAPGGWPAEKGWDAVTGLGVPQSFQKLLNVLIDV

SEQ ID NO: 2287 - protein, 387 aa, Unknown
  Kingdom: Fungi, Phylum: Ascomycota
MASLQQTLALAASLVALPFATAAYDPSATDNIAVYWGQNSYNQGSGQFAQQRLAYYCANTDIDVIPVAFLNGITPAITNFANAGDNCTAFASNPQLLDCPQIEEDIKACQATYGKTILISLGGATYAQGGWSSSSAAQDAAQQVWDMFGPVNSASNVDRPFGSAVVDGFDFDFESGVNNLVPFGQKLRSLMDAASGKHFYLTAAPQCVYPDAANGPALAGAVAFDFIMIQFYNNWCGTINFNQGSTVQNAFNFDVWDNWAQTVSANPDVKILLGIPANTGAGGGYTSGSKLAAAIQWSKKYPSFGGVMMWDMSQLYANNGFLDEVKNAINAIAPPPTSTTTSSGGSQPTGALVPQWGQCGGQGYTGPTQCQPPYKCVASGQFWSSCQ

SEQ ID NO: 2288 - protein, 886 aa, Unknown
  Kingdom: Fungi, Phylum: Ascomycota
MIPLTIIFLLATVINCQAFNLKTTRADFPKLNTQRHNGTDPNLAYSPPVYPSPWMDPEANGWQEAYAKARDFVSQLTLPEKVNLTTGVGWMGERCVGNVGSIPRMGLRGLCMQDGPLGIRFKDYATAFPVGMTAAASWSRNLWRDRGKRMGRTHYQSGVDVQLGPVAGPLGRNPTGGRNWEGFSVDPYLSGIAFADVITGIQSEGVVATAKHWLGNEQERFRQAGEARGYGFNISESMSTNMDDKTLHEVYAWPFQDAVHAGVGAFMCSYQQLNNSYGCQNSKLMNGILKDEYGFQGFVMSDWQAQHAGVSTAAAGLDMTMPGDTTFNSGLSFWGGNLTLAVVNGTVPEWRIDDMAMRIMAAFFKVGRTVGNQPEINFSSWTQDTFGPANMAAGENIEQINYHVDVREDHAYHVRESGAKGTVILKNKGVLPLQKPKFIAVIGEDAGPNSHGPNGCSDRGCADGTLAMGWGSGSVEFPYLVTPDSAIQAQALQDGSRYESILDNYDWEKISQLVARPNATAIVFAYAGAGEGYINVEGNEGDRQNMTLWRSGNELIKNVSAINPNTVVVLHTMGPVEVDEWYDNPNVTAILWAGAPGQESGNSLVDILYGKQSPGRTVFTWGHAHEDYGVDWLREANNGNGAPQDNFEEGAFIDYRHFDRDYPPGSDKAPIYEFGYGLSWSTFEFSNLQVEKRNVQPYKPTTGQTIAAPVLGNFSTDLADYTFPSDVRYLYQFIYPWLNTSSSGEEASADPHYGQTAEEFLPPGATDGSPQPRHPASGPNGGNSQLWDIVYTITATVTNTGSVMDDAIPQLYLSHGGEGEPVRVLRGFERVERINPGESRTVRMELTRRDISNWDTVSQNWVVTPFEKTIWVGSSSRNLALSSVLP

SEQ ID NO: 2289 - protein, 228 aa, Unknown
  Kingdom: Fungi, Phylum: Ascomycota
MAKDQIIQRYEATIAAVFYGHTHKDEFEIAYSDYTNQAASTATMMSYIAPALTPTSGNPSFRVYDVDPVTFGVLDVHVYYTNISSPTYQNGPKWELLYSVKETYGSLLGYTDPAAELTPAFWHNVTALFESNDAVFQQYIGRKSRDYDLSTCDGDCKTTEICQLRAAQAQYNCVTVSPGVHFKRDLHGALRAGECDGSKAIPILSAMTSPEGIRTLRASLQNMAGQSQ

SEQ ID NO: 2290 - protein, 399 aa, Unknown
  Kingdom: Fungi, Phylum: Ascomycota
MKLGSTLTLLGVVVKWSSARVTNPETRGSVSLSTSTSSSIQQRDVLSDLLNDAKNLTTCSACESLLLVLQGLAHLGNKDFVNVITSFCQDLHVEDPDVCAGAIGLEGPILAHDLRQMKIGSDTSKLFCLTVFGLCPWPSIDTSYDLSLTPKPNTVRPAPSGKTPLKVAHFSDIHVDLSYTPGASYNCTKNICCRPYEQDDEPGVTDYPAGPYGNPACDSPLSLEQSMYEAINQLAPSRSFSIFTGDVVEGAVWLVTDAEVTNDLNNASSTLASTLGGKVYPVVGNHDAAPVNSFPPAAVDTTITTQWAYDTLSSDWAAWIGSQSSGQVSSNFGSYAVQDPSGLKIISVNTNFWYKQNFWLFEEPMEHDPSGVLAWLVSELEAAESAGQRVWILGKYTKS

SEQ ID NO: 2291 - protein, 521 aa, Unknown
  Kingdom: Fungi, Phylum: Ascomycota
MKHHPARHSLVRKPGHESAVMHRDGNQTIISTRNAGYPPSSPGIPHEAATIYDSSDAGGRVEGLDDAGDDPLMTSADEEVSGVCLLELTLQHIASNSSSFSYLLHTARRSNMKASQLILAYGTAELVSAATLSRRLDNGLGLTPSMGWSGWNVAQCNSASEKYALETANAFVSLGLKDLGYQYINIDDCWTVKSGRDSNGNLVPDPNKWPRGIKAVADEIHGLGLKFGLYGCAGKLTCAGYPGSEGHEQQDARSLASWDVDFWKYDNCYTPCNTGDGDVQVCSSPDPSTKVWYGAMRDALLAVKTTHDILFNMCSWGVEDVWQWGKTYGNSWRIDNDNWQDWASVQRIGSKAAGISQYSAPGGFNDLDMLIVGNGVLTEPQERLHFGLWAIAKSPLILGTDMTKIPSSTLAIVSNKGIIDINQDSLGVAATTFQPPGAPAPVSGQIYTYWAGPLSDGVAVGLTSVGSAKTVSVNFADVPGLGKGSWTWKEMYSGKTGTGESVSFDLAEDDMAVLKVTSASK

SEQ ID NO: 2292 - protein, 596 aa, Unknown
  Kingdom: Fungi, Phylum: Ascomycota
MWQPPESEDKTGANLAAAQQSRRRKKFIWLGIAVAVVLVAAGVTVGVLASKGIISTRSSSNKSADSDAAADAEHSGSSSVENNGIADVADIITSTTVTATATPSASSTKTQTTATATASACPSKDDIPKASRNTDLDTSTWMDMTDFNCTFTTETVGDLPLVGLNSTWSNKAQANPNVPSLNQSWGDYAARPARGVNVGGWLSLEPFITPSLFDYPASAGVVDEWTLCKHLGDKAAAVLEKHYSTFITEADFKAIADAGLDHVRIPFSYWAVQTYDDDPYVPRISWRYLLRGIEWARKHGLRIKLDLHGVPGSQNGWNHSGRSGKPDWIAGKDGAQNADRTLEIHDRLSKFFAQDRYKNVIAFYGLVNEPARSLNADALNAWTDKAVNLVVGNKVNGFPVFSEGLLGLDAWAGAFRDLQKDTLIVDAHQYTIFDEYLLSLEPTDRINYACNKFSAITAESIKDYGPTMVAEWSQAHTDCTTHLNGFDMGNRWTGTFPGTPGPSCPTKDKQCTCSVSNDESLYTDAYKVFLKTFAMAQMDAFEKGWGWFYWTWKTEDAPLWSYKHGIEGGFMPKKAYQREWSCKNPIPDLSGVRDYE

SEQ ID NO: 2293 - protein, 775 aa, Unknown
  Kingdom: Fungi, Phylum: Ascomycota
MVAVPLLLVCGLSGLAALGGSTSGSRDLRSDKGLILDDAYFYGDSPPVYPSPNMTGVGDWAIGFNKARDAVANLTLEDKIKLTAGVDHDSGCSGFVPAIHKIDFPGLCLSDAGQGIRGTDFVSSFPSGIHVAASWNKKLTYLRGNAMGGEFRNKGVNVLLGPVVGPMFRVARGGRNWEGFSPDPYLSGTLVALTIEGVQDRGVMTSTKHFIANEQETNRNPGTDDSVTIEAVSSNIDDKTMHEVYLWPFQDAVKAGTANIMCSYQRVNNSYGCSNSKTLNGLLKTELGFQGFVVSDWDAQHAGVATALAGLDMAMPNDQGFWGDKLIEAVKNGSVPETRVDDMAIRILASWYQFGQNTGFPKPGIGMPQTITAPHSIVDAREPAAKPTILQGAVEGHVLVKNTKDTLPLKKPQMLSLFGYSAKSPDLFGPADGVLGISWMIGAEPANADYIISGSSEGHYLDIAVNGTMINGGGSGATTPANFVSPFEALKWKTNADNTALFYDFRTADPAVVPVSDACIVFGNAWAAEGYDRPALRDDYTDNLILSVAGQCQDTGPALVSLLYGETNAWGKLPYTVPRNESDYGYAELLGPTLPEGKFERFPQSNFTEGVYVDYRHFDRADISPRYEFGFGLSYSTFEFGNLSASLIDGARTAEIPTGAVISGGQADLWDELVKVSATVRNTGGFAGTEVAQLYVGLPSGKGLADSPKRQLRGFEKLMLGPGEGGEVVFLVKRRDLSVWDVTAQKWRLQPGKYSFWVGNSSRTLPLNGTVEFSP

SEQ ID NO: 2294 - protein, 1563 aa, Unknown
  Kingdom: Fungi, Phylum: Ascomycota
MAAAWFLPGLILRSSASCNAKPECGQYAVPAGKTCPLNVCCSEFGFCGTTSQFCDASAGCQSNCGTPSVPPGKSSKPVTHRVVGYYEAWSARRECYPFPPAAIPIQGLTHLNFAFAYIAPDSYEITPMDGATPASLFTRTADVRTLKSGLSDLQVYISLGGWTFSDNGTTTQPLLSEIASTESNRKKFANNLVDFMKKYGFDGVDIDWEYPGAPDRGGVKYDTSNFVELLKTLKETFEASIHGPYGLTFTIPSSYWYLRWFDVPRMLKYADWTNMMTYDLHGVWDKENPIGSIVQSHTNLTEIKQSMDLLWRNNVPPEQVVLGLGFYGRSFQLQDKNCAKPGCEFAGAAEAGSCTKNGGTLAYFEIQDIINDQSPKIIHDKAAASKYFVYSKDQWVSFDDGDTFKQKVDYANSVGLGGLMIWSIDQDDKAFSALQGLLGMSLQSYSVLLKRAESTDAGKWTSLNGQKCIISDCGNPATCPEGYGVAPGGGGFPDNCRSTKFRIICCPLNSMPESCLWRGGEGTSGRPSCHGQCHIGETTLFHSRHATKHCLSPGWQAFCCTAQTWARQIDACKYSKCRGSCGATSDTKGMTKVATISDDCIFGYKEICCPPEAAFENCHWVGKGSCDDNECADNDVQLALDPFGNSGHRCGLSRNKVLCCNTPKNLNPFLPVALEKVFPILPAETDYPQFDLQALGSSDAVSNDLDHNVFGLVIIVGPASTVQTLRRRDGSDAYVLDCHKIKRDGLSRIRLVCENGGSDSSCNKIHLGGPEGTILRLPEGCSPGHYVVLHSARDISQLSTLPGNVARSVPANRTIVELEISHDFSKVKRDTGDVSIRIDYSNSNQYWSDIVQGDPSKHKRDMALDMRKRFYSSAASDWKEKFDHLRNLDQPSSLNSNGQLGKDNIKVTLSAEQKEKCSADGDDGFLNMVISGTIKEDLEFGFTFVGTIAPTFHIEEANGYYDTSISFNAELDFDGKGSLDIPTGLSSQKLFHSPISAWGFSHPGICDFGPTINVEAAMTGSGNINAKFTASFSIANGKAIIDSLPTGTGPHGGSVFNELLDLDFYGKESVAADTQFNQTIESLFRINRDSKGDALVTFSNYQATIESYTAGDLPWGDDDEQRVVDRGDDLVIHQGNSTPQTRTAPDLNGYPIFGGHDFMSCSDDTGNSGGGSHLKTCVCWNDLDHYDRSLDLDPDTGGPYENINLRKKRRTRRDDLLLADPALALNPDTGKSYDDGLIIEILEGRAPIQYGSAESYSVTGPSGRRWDIVMRRYPQGRDGDSLSQLNPSAGRYDAEDCYDCSNIAVTSSSTNPDIRVVTEHINERQTEPRAQEFMMNAQAENSNGALIRSDYSAIPERYMDDNSYLHQAYSVWDPSGPYGAHGRPIDEITNAYGSDTNPTVLVNTEAVLNSIKARMWVGHQPMGDTLWSDNGFDLPDPTRASGALSYIRATMQVIVYLNDSVVNGNWARIVRDVLAAYRRYAERVQAVDQVTIHPAEMYQEYMLHVVISNIESTEDWMLRRLNQLDAVWRHSTTVEAPSIRRQIAETIQQISELLIDTSQLDLG

SEQ ID NO: 2295 - protein, 1274 aa, Unknown
  Kingdom: Fungi, Phylum: Ascomycota
MRHHLASAAGAVSLLLSAVSTNAEHFTPKHEPGRCAFRGHCGKQSFFGKELPCVDNGEAQDPDEELRKELVDLCGAKWADTPVCCTLEQVQALKSEMGTPNTLIGSCPACKDNFFNMFCTFTCSPDQSLFVNITQTAEKGGKQLVTELDQLISEEYGSGFYDSCKEVKFGGANSKAMDLIGGGAKNYTEMLKFLGDKKPLVGSPFQINYPQSYPDKSMRALDMKPKKCNDEDPEYRCVCVDCPEVCPELPKVKDSSSCKVGVLPCLSFASIFTYSMLLFAIITFAFGHVAWRKYAERRIERTRLLHEASHSDDEDEGGPVQTEAMRDRPTKRYWINDKCDKAFYQLGHAAARFPAITIGSSLVVVAILSAGWFRFELEVEPAKLWVSPTSAAAQEKAYFDSNFGPFYRMQKTFLVNDTQPSGPGPVLSYDTLKWWAQVEKDIEKIESPTYGKYLHDLCFKPMNDACAVESVTAYYDSLGGLNRNTWQDDLRRCTKSPVDCRPEFGQPIEPALVLGGWEDDVAEAKAITTTWIVNNAPEGSDALLRAIDWEIALRDRLLKAQEEAAERGLRLSFTTEISLEQELNKSTNTDAKIVVISYIVMFIYACLALGTPLKHAFRNPALLLVESKVTLGLVGILIVLMSIAASIGFFSWVGLKATLIIVEVIPFIVLAVGVDNIFLLVHELERVNVSCPDQMVEERVARALGRMGPSILFSALTETVAFALGAAVGMPAVRNFAAYAAGAVLVNAVLQMTMFVSFLSLNQMRVEDHRCELWPWWQITKARIHLNGSNGYTAGGRAADVEEESFLQVIIKNRYAPMLLGKKVKLIVITVFLGMFAAALALLPTLQLGLDQRVAIPDGSYLIPYFNDLYDYLEIGPPVYFVARGLDATKRHEQQEICARFTSCESLSLTNTLELERQRPDVSYIASPAASWIDDFFLWLNPIYEDCCIEKGRTCFADREPAWNTTLSGMPEDKEFVHYLEKFLKTPADDVCPLGGQAAYGEAVVLEEDGKSVRASHFRTAHTPLRSQEDFISAYAAARRIADDISERTGTDVYPYSLFYIFFHQYLSIVPLTAGLLSAVVGIIFIVAAILLGSVATSAVVTVTVVMSVIDIMGTMAVVGVSLNAVSLVNLIICVGISVEFCAHIARAFMFPSRTVMESNNNAFRGRDARAWTALVNVGGSVFSGITITKLLGVTVLAFTRSKIFEIYYFRVWLALVIFAALHALVFLPVALSIAGGRGYVDPESEGTAAQDLTDRRWRAIRIHDHSDSEDEEF

SEQ ID NO: 2296 - protein, 408 aa, Unknown
  Kingdom: Fungi, Phylum: Ascomycota
MLSFKSLLSVILLLQTAAAAGYVNAGYYASWKTYAGYTPEKLNYAAMSHVFYAFASISANGTVYPTDPWGDYQQPHAGDVAEAGNNAYGAVKQLYLQKKKNRKLKVLLSIGGATANGGFLNATTNSASRSRFVNSAIKLMLDFGMDGIDLDWEFPTTTTQANNYYLTIKQMRDAIDKKAAALGQNYHYLVTAALPAGPANYNLLDLASMSYGLDFFNIMAYDFSGPWSTVGAHASNLYNDKSNPSSTPVSADKAVRDYIAKGVPANKINLGIPLYGKSFANSGGLGKSYKGTRSPNADFSIPFNQLPKSGAKVMERPDAGALVTWDSNTKELVTLDGGYSARLKAAYLKQLGLAGAFFWETSGDKTGSSSLITIVKNALGTLDQTNNQLMYPSSEFVNIRNGVPTSRK

SEQ ID NO: 2297 - protein, 323 aa, Unknown
  Kingdom: Fungi, Phylum: Ascomycota
MSSSLDQLKATGTVVVSDSGDFASIAKYKPQDATTNPSLILAASKKAEYAKLIDVAVDYAQDKGSDIDSKVDAALDRLLVEFGKEILKVIPGKVSTEVDASFSFSTKASVEKALRIIDLYKEQGIEKDRILIKIASTWEGIKAAEILQRDHGINCNLTLMFSPTQAIAAAEAGAYLISPFVGRILDWFKASTKKEYSKEEDPGVASVKAIFNYYKKYGYKTIVMGASFRNTGEITELAGCDYLTISPNLLEDLLNSNEAVPKKLDASAASSLDIEKKTYINDEATFRFDFNEDQMAVEKLREGISKFAADAITLKDIIKQKLA

SEQ ID NO: 2298 - protein, 639 aa, Unknown
  Kingdom: Fungi, Phylum: Ascomycota
MHLFSSAVLLGAAALHSVFARPGLSDVHTIQPPVLKQSVEDFIQSETPIALARLLCNIGADGCHASGVSHGLVIASPSKEAPPYFYTWTRDSALVFKSLVDRFVNSYDADLQRHIMEYIAAQAHLQGLSNPSGDLSDGSGLGEPKFNVDESAYTDNWGRPQRDGPALRAIAIMSYGEWLIDNTYIDTARDILGPIVRNDLNYVAEYWNHTGFDLWEEVEGSSFFTVANQHRALVQGFYFANRIGQGSDHYKATGASLLCFLQEFWNAEGGFVQANINSEHGRTGLDANTILASIHTLDPLLGCDDATFQPCSDKALSNLKAVVDSFRFYDINSGIPNGTAIAIGRYPEDVYYEGNPWYLNTLAVAEQLYGAVYVWQQQGAISVTETSLDFFTELVPNILIGKYERGCDTFSTIVQAVSLYADGFVNVVATYAQEDGSLDEQFSRIDGRPLSAVDLTWSYASFLTATARRAGIMPKPWAAEVEPVPDVCSAISYQGSYTAATVTVFPPSQTPVAGTTSPTTPTAILPPGTSTSCDVASEVTVIFKVRAVTQPGEVIKAVGDIERLGGWIPDAAVELDASDYRANNPVWKGSVQLPADETIEYKYVRVQGDGQVQWESDPNRRYRIPRSCETIVTRSDLWR

SEQ ID NO: 2299 - protein, 449 aa, Unknown
  Kingdom: Fungi, Phylum: Ascomycota
MSAPAHKFKVADLSLAAFGRKEIELAENEMPGLMQTREKYAADQPLKGARIAGCLHMTIQTAVLIETLTSLGAEVTWTSCNIFSTQDHAAAAIAASGVPVFAWKGETEEEYNWCLEQQLTAFKDDGKLNLILDDGGDLTSLVHSKYPEMLKGCFGVSEETTTGVHHLYRMLKEGKLLVPSINVNDSVTKSKFDNLYGCRESLIDGIKRATDVMIAGKVAVVAGFGDVGKGCAMALHGMGARVIVTEIDPINALQAAMAGYQVIPMEKAASIGQIFVTTTGCRDILTGVHFEAMPNDAIVCNIGHFDIEIDVAWLKKNAKSVQNIKPQVDRFTMASGRHIILLAEGRLVNLGCATGHSSFVMSCSFTNQVLAQIMLFKAADQEWAKKYVEFAKTDKLEVGVYVLPKILDEEVARLHLAHCQVELSQLSKVQADYLGLTVEGPFKSDIYRY

SEQ ID NO: 2300 - protein, 360 aa, Unknown
  Kingdom: Fungi, Phylum: Ascomycota
MRFSTTLSILTAISSPIAYAAQSFSGSSLYYAAGLTSSQRQTLFSGMRDAGAKVLRVWLDGASPPQKGTDIQGFGALETDSPGQWDDTVLNRIDDLMVDAASYGIKLHISMHSYNALSGNWDFYGKWYGTGSFYTSDDAFGYFGNRLKHILAHKNQHTNKTWAESSEYIFAFEPQNEAMHGLENPSALTAWQCRVSQLIKDNLKSDILVSTGGGMNLANSVLDDYFECAALDIIGIHVYYYDEFSASRLQPYIKKAQSAGKILIMQEWGVCYYDSPSQSCSRSGVLNSSTRDSNIRSWAGSMNSVGLPWMYWQILPNADPHGVDWDYEIGINDVNWGALKEMGVKAGQSQCAFDLSKRLL

SEQ ID NO: 2301 - protein, 185 aa, Unknown
  Kingdom: Fungi, Phylum: Ascomycota
MYCKQTIIALSLALTGARAQCVGPDINAASVDLIKSFESWQPDIYIDPTGNPTVGYGHLCADGSCSDVSYSIPLSVADGESLLRDDLTRFQNCITLDTTSNVVLNANQYGALVSWAFNVGCGNTGSSTLIARLNNGETVNTVISEELPKWNKGGGEVLPGLTRRRAEEVALAQTSTGDGALPACS

SEQ ID NO: 2302 - protein, 283 aa, Unknown
  Kingdom: Fungi, Phylum: Ascomycota
MASRLLVSIALAGIVLAGEPQSCPSDLPLSCQNTTVVEDTCCFITAGQLLLTQFWDTDPATGPSDSWTIHGLWPDYCDGTYPANCDNSRAYTNISDIIGSQATNGTLAYMNKYWKDYQGDDESFWEHEWSKHGTCISTLEPDCYEDYDPTEEAVAYFERTVALFKTLPTYEWLEEEGIVPSDTETYSLESIQSTLKEKHGAEVTIGCKGQNLNEVWYHYNVQGSLQEGDFVAVGPDGTKGSCPDQVKYEVKSGQPSRKSRNKRGTRKEHGDAEMHIFSGIKAV

SEQ ID NO: 2303 - protein, 499 aa, Unknown
  Kingdom: Fungi, Phylum: Ascomycota
MADIIAQLEVLSRDSGCLLDLSAIIDLGVCKKIDIKTDRPHKIEKKDDYVCVTPTGPKPKPKPTKPVHTGHYTKRCEKPGGCYEVTEAVCKKPTVVLDLELLVLLGLLTEEQLEEYMKTTGQIGEGDKVYVEDDEVTVDPLLSVQLGDNGDILNLELLGEDGLLNLDLLNDLKKRNYGSGYGSDSGSHYDDGEDDYEDGSNSNGGGIDQLIDIDALGQTDKGKPALIDVDLLNHDRRSYSDQLLNLQVGGKNKGGKPAIIDIKALTNQKRADRPLLDLDALGEAKDNNALIDVDLLTTLLGGDKTGSSSGSPSGSTGGSPSGSGSGGDRPLLDVDALGDAKDNNALIDVDLLTNLLGGDKGKGSESDSGVSPVSPVSPPVKKPCKACHSKGLQKRDNYITHYQPICGKGFKKEHRDAADACHATDVNHCLSLCQSKAALATINAKVQVGDIANIQVCAAIEFNSNEAGDNCHYITGPETEPCHDDQLEPVEDCTAFVRN

SEQ ID NO: 2304 - protein, 279 aa, Unknown
  Kingdom: Fungi, Phylum: Ascomycota
MGDNKNMSAYYAPRGGLPPQTQLLTDRAMFTESYAVIPKGCFSDIVTSFLPFWEKTRLWVIARPLSGFAETFSQYIMEVQPGGGSERAEMDDSAEGVLFIVEGEVTVKVAGQEHTLTPGGYAFLPPKSGWTLRNKTTSDARFHWIRKAYEYVDGLDAPDPIFLNDSDVPPTPMPNTNEAWATTRFVDPTDLRHDMHVTIVTFQPGGVIPFAETHVMEHGLYVLEGKAVYRLNQDWVEVEAGDFMWLRAFCPQACYAGGPGKFRYLLYKDVNRHAKFRLH

SEQ ID NO: 2305 - protein, 614 aa, Unknown
  Kingdom: Fungi, Phylum: Ascomycota
MLRSVLSLAAAAGLASAVTIAEINGAKYLSALNGTTVTGVKGLVTAKNAQGVFLRSTEPDDDERTSESVFLFNTAVRSQVQVGDIVTLDATVEEYRSNNLYTYLTELTKPLNVKVISSDNKVTPLILGEDTLSPPTELFSSLDEGGIFGVPNDVTRVSAQNPTLQPDKYGMDFWESLVGELVTIKDVVQVARPNQYGDVWVRAGSLKATGVNSHGGLTMLEGDANPEAITIGTPCDGSKNPSDTKMGDSLGDVTGIVFNAFGFYRILPLTAVSSLESASVDFPSASFNSTGDCRGITVGSYNAENLNPQSAHLPGVIDQIIEKMLTPDVIFLQEVQDGSGDANDGVVSGNATLMALSEGIESKSGVVYEWAEVAPVNNQDGGAPGGNIRTAYLYRPDVVELYNPNQGGPNDKAEIVTDEENPSWPVLSYNPGRIEPAAEAWSNSRKPLVAQWKPLKGTGKTFFTINVHFGSKGGSSSLHGDPRPPINKGVEKREEQATITANFIAEILAIDPKARIITAGDFNEFTQVAPLQKFMSIGSMLELDDVANVAPEERYTYLFDMNSQQLDHIFVSENAAREGQTLLEHLHLNTWQNYDDQVSDHDPSVAKLNLCGCA

SEQ ID NO: 2306 - protein, 341 aa, Unknown
  Kingdom: Fungi, Phylum: Ascomycota
MRFSILSAIATVSLSATSVFAQATGTIAKGPFPKDLNGSNFTYPFPVQVFKFKSQNEDQQMAFMDVKPKCKPNGKTAVLLHGKNFCGATWETTIRVLAGKGYRVIAPDQVGFCKSTKPKGYQFTLRQLAWNTRGLLDAAGVDNVTVIGHSFGGTLSTMFSLQYPATVDEMVLINPIGLEDYSAKGVPYISIDDHRVNEAASTYGSIRGYEQAVYYLGEWKAAYDVWVNMLVNVYYGSQRDAFVHCQAKIVDLVLTQPIAQYFKLLKPRTVLMIGDKDTTAIGAQWAPPDVAAKLGHFDVLGPQVAAEIPNGHLINFPNEGHAPHISEPEEFHEKLLAWLSK

SEQ ID NO: 2307 - protein, 424 aa, Unknown
  Kingdom: Fungi, Phylum: Ascomycota
MPSLLNLLIWASLSMVTAGQLTVLLSNVPPIALNTDRAVTSATELFRQSCPEEVAETLNYTAEVLMSSFVDFGEDDSNTFPEGSVYPSSDSLVRGAVEAWAQHQNLVLRPDEIWFEILAQLNFYMTAHAEDVRHMFVTHEGKEEIQVWDFTWKDVIARFGDEIQQRVLTDWLLEWIMPGFSTSTENDGMTATVLMMGLMQHYFEFSGGIICGIPKVTLLGVKEDWVRLSEKLRHLAEWGEEPAQYAENLAPILEMFVATWDEPDSEEVTNFWQQIVRTHKKFTCGAGPTEYDVSGWITGFLHWREDGSLRVYDAGSIQPSEYTTTIGNVTYAQAALDDLPTGYAKAPLKMLDYPVPGKSTQAFLLAGNIGVQRSGASEGGWVTAQPMSAWFMYAPVDANATTPRRYGSTLELQAITEGVRSCQL

SEQ ID NO: 2308 - protein, 624 aa, Unknown
  Kingdom: Fungi, Phylum: Ascomycota
MWTLKVVSAAICLVSFASASFDDNLNYASPSRRHTGLGIDVPLLERRSWKRDSVSYQSRDLKFTHGVASGDPWANSVILWTRVAPSKKSDDSEVTVEGTAPLYDHETEKYIKASANPICVEWKVFESKKGKATGKVVKRGKAYTTSDIDYTVKVEAKGLKPLTEYFYQFNVCGSDNKSAQGRTKTAPRADDSVSSLSFAVFSCSNFPNGYFNAYGNAARKDEQDFVIHLGDYIYEYAATGERASDPTNEIFSLYDYRTRHGQYRLDKDLQLLAQNHAWITTWDDHEFANNGYRDGFSGLNNTEESFLNDSPHVTVDTRKVHATRAYFEWMPIRQTDLDDGLRVWRSFQMGKLLDLVVLDTRNYDRSITSLGWNDEYIDMIRDDPSRTLMGSRQENWFYRSMSESQERGATWRIVGNQIIFSRIFENDDGDMSEDNWNGYIANRNRTLEHLYNNKITNSIFLAGDSHQNWVSDLAWLGNKDYDKQTGEGAIGVEFAGTAVSSSGQSGPIEPKAGDYARGMIRRNDEMQWQEGYYRGYFILKLSPKEATAKFYGSPSVATRNPWDIPLANFTVKAGANRLQRPIAGGRVESGAVRDGSVKHTNLTLNTNTGKWKVIGFDTMFIPKK

SEQ ID NO: 2309 - protein, 335 aa, Unknown
  Kingdom: Fungi, Phylum: Ascomycota
MHYSASFFAGAAALSFGVAQAQYTLTNTYDASNFFDSFGFFNGQDPTNGFVEYVDGPTANADNLAGTVDGAVFMGVDKTTVNPPNGRRSVRLESHDTFTKGLFIVDASHMPASECGAWPAFWMFGDGSPGWPNQGEIDIIEGVNNQVSNINTLHTGPGCSITNDGAAEGTHLEGTDCNAGNGNIGCGQKTSNNQNYGDGFNDIQGGVYATEWTADFIAIWFFPRGAIPEDITSGNPNPSSWGPPQARFNGGQGCNIDEHFYGHKIIFNTTFCGDWAGAPDVWNNNPECAAKAATCIDHVSNDPGAFEEAFWTVNYVKVFSANQTKRDTVPAAFKA

SEQ ID NO: 2310 - protein, 396 aa, Unknown
  Kingdom: Fungi, Phylum: Ascomycota
MRTALYNLGFVAAVAAQQPQARGTPGCGKTHDDHDGTFSRSIKSGGMQRNYSIHLPPKYSPEDSHPVILGFHGSSSIGAFFEADTRFSDAADKTMNSVIMVYPDGLGGAWAGASYSEASVPQDLQFVSDILGDLRDEYCVDNDRIFATGMSIGGGFVNTIACNDTVGGEFAGFAPVAGAYYTDNDENYEKCQPNKGAYLLELHGLKDESVPYEGGKASGGEVPDVHDWVERWVDRLDCDRKTSFEENAFQDKDYGWRIWYCEGEGRMVHVPMKGRNHSWPADWPNFSQPISNDKEAPFDSAELILNWFLEPKWQDRYWAPWRNDTERPSSPSDTASAPALAETSAAETETKTGSGDSAESTTSSADEPEPSIAGAMRADLGLLLCLVVVVQVILTL

SEQ ID NO: 2311 - protein, 266 aa, Unknown
  Kingdom: Fungi, Phylum: Ascomycota
MPQGIPSASRLLDLFNMKGRVVVVTGASGPRGMGIEAARGCAEMGADVIITYASRKEGAEKNVEELIKDYGVKAEAYKCNVSDYKDVQRFVDEIVSKYGKIDAFVANAGATADAGVIDGTVEQWDKVINIDLNGTAYCAKAVGTQFKKQGHGSFVITASMSGHIVNYPQEQTSYNVAKAGCIHMARSLANEWRDFARVNSISPGYIDTGLSDFIDAETQELWRSMIPMGRNGDAKELKGAYVYLCSDASTYTTGTDIVIDGGYTCR

SEQ ID NO: 2312 - protein, 251 aa, Unknown
  Kingdom: Fungi, Phylum: Ascomycota
MAPRALLLTAALLSSLAASQSDANPDASGACTPTKGGDGACGPNGSEEWLNSGLRDGGWGPPFLDINKLSHVSLDDYYGGVGAACAKYNDNFRASGEKYNIDPAILAFIAMQESSCNADAGGPTPGLMQCAPSNCPNGSGSCQYPVQDNVDCGAQVLRNYLDNAGGNAVHALGAYNGWFTADDNTGLNGGKGLTQDYPCSGEGQSHGVPQNLDYLHEVLNGWFQGYDIYGDDAGLGGSYDCQGNCNNGGLC

SEQ ID NO: 2313 - protein, 429 aa, Unknown
  Kingdom: Fungi, Phylum: Ascomycota
MWQHTALVGLFAQIVSAWLPESRELAAFNQTARFEQLGKRFEPSLAAGVTKIRGVNFGGWLISEPWMMGDHWKVDMGCGSTSSELDCMKSVYGSNRDNGNTAFQKHWEEWITPDTVQSVHDVGLNTIRIPIGYWAYKDIVDYSTEPFADSGPMLAALDKVVQKAADLGIYVIIDFHGAPGAQQEDAFTGQIKQPAGFFTEDNFKSAEKWLSWMTTRIHTNDAYKTVGMIEVLNEPVSSHDGSRYPAPGQNPGLLQSYYPGALAAIRNAEKALNISDSQRLHVQFMSEKWGSGDPRTVNEITADSAVAFDDHNYIGFALQGSDRSDQYKLMHSACTDNRVVSGQDLIIAGEWSMTSDVDWSDTDFFKKFFTAQQQLYEKPGIAGWVFWTWKTTLDDPRWTYEKATSENLVPLDAAALENNVYQDVCSAFT

SEQ ID NO: 2314 - protein, 295 aa, Unknown
  Kingdom: Fungi, Phylum: Ascomycota
MMKSTFVLAGLAVLGVEGVRIIQSNDDGWAESYIRTLNDALIKAGHDVVLSAPAENKSGTNSDPRARTKPCQYDSCPANAGPVGTDPKRPDLNWVNSYPVTSIRYGIDTFGPQIWDGKAPELAVTGPNVGSNLGIVVPFSGTVGAACYAAHEEGIPAIAFSGASEGNVAYTEPAPKRSLVYAELATKLTNKIIKSGKPYLPKDVFLNVNFPEVETGCEKVSDFQWVLSRINPGFFSLPDVEWCGDDRLPTERDVVGEGCYVSVSIGDASDKSTMNDPKKQNEVLKKIEDMLVCLP

SEQ ID NO: 2315 - protein, 169 aa, Unknown
  Kingdom: Fungi, Phylum: Ascomycota
MASFTTTLRAVRPAVMRLAPRAAPVARVLFRSFSASRATLVRRYTKDHEWVDLSADGKSGVVGISEYAAEQLGDVVYVELPESGEWIEQGDTLGAVESVKSASDINAPIHCKVTAVNELLEEKPATINRVPEDDSNGGGWISKIEVDEKGAEQYEKLMDAETYQAFVSE

SEQ ID NO: 2316 - protein, 437 aa, Unknown
  Kingdom: Fungi, Phylum: Ascomycota
MKSFASLSLAATAFIGTVAAATSGSLSLLTINVAGLPDILQGNDVPGDKEVNARQIGTYFAQYNYDIINMQEDFNYHAHIYATDNHEYRTATSGGVPFGDGMNTVSNHWWFDFRRIKWNVCSNTDSADCLTPKGFTFMRVHVDEGVSVDVYNLHADAGTTAKDLEARASNIQQVADYISTWSEGNAVIVMGDTNTRYSRTGDNIRVLASQNDLSDAWIVRERNGVVPTQESLCSNPSLVNNCEIVDKILYRGNDVFSLDATYFNYESSKFLQPDGNILTDHNPITVDLAWKSSNTRRQSDFHGGPHGNWFNDISSLGNNPKTSVITFRGASRVDSVGLTLASGTKFVHGGNGGSEVSLQLGSSEYWTSVRLCQGKFNNTTRIFYIQATTSTGRTLASGTLSGECVTYTAPSGWQIVGYSGQSVNEVDLLSVIYAPQV

SEQ ID NO: 2317 - protein, 330 aa, Unknown
  Kingdom: Fungi, Phylum: Ascomycota
MRSITNFVAAGLLLAGQPVLSKPLADTRDDSDDTPLPLVIWHGLGDSFDAEGIQQVGKLAEEIHPGTFVYTVQLAKDGNGDRSATFFGNVTQQIESVCEALAAHPILSTAPAIDAIGFSQGGQFLRGYVERCNFPPIRSLVTFGSQHNGIVEFKACGTTDWLCRSAMALLRFNTWSSFVQNRLVPAQYYRDPSTLDTYETYLENSNFLADANNERLLKNTTYADNIAKLKNFVMYMFEADTVVIPKSTSWFQEANGTETIPLRERELYKEDWLGLKRLDKKGGLHFKTIADAEHMDIPEDVINKTIVDFFGPYRRKFESGAADLGLSVEL

SEQ ID NO: 2318 - protein, 328 aa, Unknown
  Kingdom: Fungi, Phylum: Ascomycota
MKTASFCSLVALAQAPIVLAQGLRQVTGGVGDASYTHQWYPVPTEEVSECEAKLITTLCDYKEPLSGTAVAAKGPKGCWEFCNKNQPCNFVIFVAGNPYTGTGTCWLYPGEEFEPSEGKEGCDYMSVFDKPVCAGDATPTSGACEATSSPSAVAEVCDYPTPDEKCWDGCTASSGAVDCLSQCVEADSCNFAVFNPHNEMESQYYSGSCWMYPEGKFDKSKAKTCKGKPEQYVYENPCPKPKPSTTTSSSSAARTSSGGDDGDSADSSKNSKSDDDGAEGAEQNKATEGDNKNGEDGDDDDNGSTMMGVSLSGAMAAGLAVLLWQGVQ

SEQ ID NO: 2319 - protein, 297 aa, Unknown
  Kingdom: Fungi, Phylum: Ascomycota
MGLIQATTAALVLLAQTGAASPLVNRAEASSTILDVPESTSTVSPDYDWSSKWETKYQIHHSCNATLRHQLEAALGETEQLAKHARDHLLRFGHKSEIVVKYFGNGSTAEPAGWYDRVVGADKSDVLFRCDDPDENCKTQDNWAGHWRGENATSETVICDRSFEIRRWLSGMCGMGYTVAGSPTNTFWATDLLHRVLHVPEISEGIVDHFAEDYADALRQAKEEPEKSGRDSDVLQMFAVDAWAYDIAAPGVGCTGEQEVEEKPASDKATSTSSAAASATSDADSACHTHDDGFVHC

SEQ ID NO: 2320 - protein, 149 aa, Unknown
  Kingdom: Fungi, Phylum: Ascomycota
MADSLTEEQVSEFKEAFSLFDKDGDGQITTKELGTVMRSLGQNPSESELQDMINEVDADNNGTIDFPEFLTMMARKMKDTDSEEEIREAFKVFDRDNNGFISAAELRHVMTSIGEKLTDDEVDEMIREADQDGDGRIDYNEFVQLMMQK

SEQ ID NO: 2321 - protein, 451 aa, Unknown
  Kingdom: Fungi, Phylum: Ascomycota
MKTFTLALAAMAVGASAHAGHQHGHLHKKNASPVVNKREPAVVTKYAAAATNVVYELNGKILSPDEAKQGIKGGDFVVVGETEPTYTPPPPPPEPTTTSTPEPEPTSSSVDLGAQFIESLTPEPETTTSEAPPPPPPTTKAKPSPKPSPKPAPSPEAPSSGSGSGSSSGQGMDREFPDGEIDCSSFPSEYGAVGLSWLGFKGWSGLQFTPNFSFSVKSIAEIHTGISGQGCSKGCMCSYACPPGYQKTQWPAAQGATKQSIGGLWCGNDGKLYKTRESSNTLCEKGAGGVSVQNKLGVEAVLCQTDYPGTEGMYIPSVAAPGSTIEITNPVQDEYYQWDGMATSAQYYLNPKGVSKEVACEWDSPNTPANTGNWAPVIVGVGKASDGITYISIFQNKPTSLEKLDFNIEIVGDVSSSCSYDAKSQKFYGGNDPDGCTTGMKSGGRATIQFS

SEQ ID NO: 2322 - protein, 465 aa, Unknown
  Kingdom: Fungi, Phylum: Ascomycota
MRGSSLTWLLGASLVLAAPQPVADVCAPVTVTSTVFVSKTVAGASTVSKTTTSTKATSPAAVSSAASVPTNNKATSGYRNMIYLTNWGVYGSKTYPKDLPVDKLTHVLYAFGDINSNGEVISSDSYSDVSMQLPGQKIDWNSATKQAYGCVGQLNELKKKSRNLKVLLSIGGWTYSQAGKFDNPASTDAGRKRFAESAVKLMADWGFDGIDIDWEYPKNKEQGKNFTLLLKACRVAMDNYAKRNKQSYHYELTVAASAGASHYNLQDLKGMDNYLDAWHIMTYDYSGSWDTTTGHQANVFKDPKNPEATKFDSDSAIRDYISRGIAPSKIAFGLPLYGRAFGNTQGLGKPFSGPGNGPLEGGMWLYKDLPQPGGKPKFDSKTGGTWSYNPSTKELVSFDGPKSANFKAKYIMGKNLGGSFFWDASGDKKGDQSLVSIMAKNYQGKLQKKQNMLSYPESQYANIKK

SEQ ID NO: 2323 - protein, 420 aa, Unknown
  Kingdom: Fungi, Phylum: Ascomycota
MVAFTVHTAVAAVSAAAIALPGAAAAAVGSKLPAGVIAVPLSRDDGLTAYFAELEVGTPPQKELLKIDTGSPRYSFLDPRNPVCKTKGNSCRQYGTFDNKTSSTCHYAGANFADDLGWVGSGDYLKDTVVVGEVSTKNMYFGYTSGYSFPDKVTGDVYTILGLSLECGFTGPKCTDRVSSYMLPELKNASKINYLATSLYLGPDNKQAANAQMLLGGAYDKAKIDGDLITMPMVDPFNQQLTGGQTNVANVTSIEIVVGTGKKSKTTKETYGKKDVGVPVLLDSGTASFYLTDKTLAPIYHAFGASGDPPFGKQYLDVDCKYADPKRTDGYVLVEFGCAGKIKVPFSALVSKFPNGKCGTFIASRGDALAIFGDPFLRSVYSIFDQENFSISLGQVKHTSVQNIVPFPKGGFKPAKEGGK

SEQ ID NO: 2324 - protein, 381 aa, Unknown
  Kingdom: Fungi, Phylum: Ascomycota
MKLNAILFATTALAARPFLEEPDTGLDLVFGDTKFGSLPDLENIAGLPDFQWAARNYLPQRNFTYYRNAAGGEWSYRNNMEVFSRYTLKPRFLRDITKVNETMKTSILGHNFSAPFFMSPTARAGFGHPDAELNFVRAAAEQDILYIPSLEATLSIENISDAKASEQVTFQQLYLPSDGKLPKELLKRIEASGAKAIVLTIDAPSNGNRQRAYRDRGRIPEPEYRYLTWDTYDEIANQTDLPIVLKGIASLADAREAVKHGVPAILLSNHGGRQLDTSPSSLEVALEIHQEAPEIFDQLEVYADGGVRYGTDVIKLLALGVRAVGLGRPFAYANVYGLEGVKKAIEIMKREVAVDAASIGVEDLQKVDSNLVNWKPNNWGQ

SEQ ID NO: 2325 - protein, 446 aa, Unknown
  Kingdom: Fungi, Phylum: Ascomycota
MKFYQSVVALTVMPNKLNIDSPYSIRNVAATLAFDAMKYYNGNVSSDPIQTGDLQDPYYWWVAGSLWGTMLDYYHFTKDPTYNDVIIEALLAPSNLGENQDYVPKEHELEEGNDDLFFWGSAVMSAAERNFPQPNKDLPSWLQIAENVFNSLHSRWHTEKCGGGLLWQIYEANPNGLTYKNSVSNGGFFHLAARLARATGNDTYLDWAEKIWDWSVDTGLVEKGRYRVYDGVDIADDCGRVNYQSFTYTSGIYLYGAAVLANYTESKTWATRSQKLLKGGNWYFSPYENATDIMYEGGCEGYERCTVDMSTHKAVLSRFMWQSVQMMPSLRKDVERKMRASAKAAAKSCTGGDDKRTCGLKWYTGGYDGNPGLGQQMNALETIQGLLIDQAAPPLQGKQIKTVRDTKWKPLDTYKPDKPKEQPKNDDGDKDNKNNDDDDEEDSAYC

SEQ ID NO: 2326 - protein, 288 aa, Unknown
  Kingdom: Fungi, Phylum: Ascomycota
MAPTGTGHEADAAHSNPAPPAPSSQRDIADTSSPVQAQSPPRGAAGNTRQSVKLVPSSGSNNANAARWSLPAENLAPRIFFALSALLLAAYIIFAFPSTPPSQLSSEFCSCPNSDSQLLIPKQHTSSTSVPNITMSSAEQTFIAIKPDGVQRGLVGPIVSRFENRGFKLVAIKLVTPSKEHLEKHYEDLAGKPFFAGLIQYMLSGPICAMVWEGRDAVKTGRVILGATNPAASAPGTIRGDFAIDVGRNVCHGSDSVENAKKEIALWFKEGDVVSYKASQFDWIYEKA

SEQ ID NO: 2327 - protein, 302 aa, Unknown
  Kingdom: Fungi, Phylum: Ascomycota
MGVLWLLNFVLIAFPIGTTVGILLGVQTHRIATGQAPLFRDNGIKHKNYCQKTLGISPPSKYDHYTLNPNQWGLTEDTVTTFNNETYATEATAPEFAVTWKFDPGPETAPVHAFPNCKVASQVLPAAFKNIDKIMMDLEWTYGIGNNTAVSTSKADLEDALVNTNVAIDMFTDPNKDTAGHTEKAAIEIMVWFAAYGPATQPLGMATTGIVESKTLNGTKFDLYAAENSVGQKVFTWYSDTPIHKFNGDLMPLMDILLEKDDADYPKPGDYIGYMSLGSEALSANKTVTFHVPTLSIDVQTK

SEQ ID NO: 2328 - protein, 395 aa, Unknown
  Kingdom: Fungi, Phylum: Ascomycota
MSHLSNPMAILSLLATVALVSASSSYDIDVDLSRRQDTCNAVHLFLARGNNEPYPGRQQAMVQAVCDGVSNCGYEDLIYSALYTDLSCQTAYDAVHAAYAQVSEYACRCPDAKLVLTGYSQGGNIYTDFLGGGGGELFNECIQPDTPALDRKTFPGNRIDAVVVFGDTRHTADQPYNVGGGSGIDGIFPRPDSQLEALKDWTDILYAYCGANDPICAADQDKENYNVTQHLSYYDTHAGEAAAWIKKVAKIEDDDPGFVTEVPISLSGTAQDYSTIASDYVPGGTVASVAISTATCSTTSKAPSTKASATRTTESVPESTSADAESTPASTTATSSSTEESTTEESPTEEESTTSETETETSAAAAETTASDDGAASLGSVGLLGSFFLAAAAIL

SEQ ID NO: 2329 - protein, 495 aa, Unknown
  Kingdom: Fungi, Phylum: Ascomycota
MGFKTVAFGALTVAGLTSANGAGTLLDPVKPVLTPNGRWAQNPLGHVGANGPWQPGPNVFGISSDIPDGCKVDQAAYVSRHGSRYPDTGAYAGWVEMAKLFKEKTYKATGPLAFLHEWEPPLSDPDIQIAQESKTGYKEMYDMGYSLRIRYPDLYDEGDDFFVWANNYTRVIQTAQLFVHGYLGTNSSLGTVVSVTGKGQPQHLGDTLAPSDMCPTFKDDSSKQTAAWQAKWMPSYIKRMSKYIKGDLKLTDDQWNSFPYICGFESQITGRLSPFCDTFNDQELAGYEYQQDLRYYYGVGPGTDVAAKMMVPFLESLIQRFVNGPEAQGTDFDGGKFQVPKLLMSFLNDGQLNELAVATGIFDKQKPLPTDRIAKDRLWRSSRISPMRGTLAFERLTCKGRSPSHPHSGSYNQAQESSYIRIRLNDAVYPLPSCQDGPGKSCSVAKYAKYIADKNKKQGNFAKICNATDPATPTQVKGASFFTDLAQSHLQAVEP

SEQ ID NO: 2330 - protein, 916 aa, Unknown
  Kingdom: Fungi, Phylum: Ascomycota
MTSQHSNTDDSVGHQQTMDDHHFNEKKLGSPDTDVQRVDTEVVNLAAKLGDREDGLAPLDDIAFVMPKIETMTVEEAREIIEKLLKDHKYDYNFAEAQRVKLRKLLEGVPEGQTSDEWSLEIRTEAAINRYYSPYPEVRAVTNPTDDPSMPCETIRAHLLGYIWACLAQFTNSLFNSRFPAITISSVVIQLLLYPCGMLLAAILPDWGFNLRGKRVSLNPGPWTYKEQMLSTIIVDVGLTSAYCFWNIQTQTVYYGDKWLTPGYGILLLLSTQLMGLGFSGLLRRFVVYPTEALWPSVLPSVALNRALLVPEKQETIHGWTISRYRLFWLLGGTMFVYYWVPGYLFQALSLFPWMTWIAPNNFNLNAITGSQSGLGVNPIPTFDWNVMSVYSLPLSYPFFSTAQQYVGTWLGFFVIVGLYWTNTRWTAHLPVNSSGIFDNTGARYNITRVLNQGTAVLNEAEYKKYSPPFYSAASLVSYGAFFAFYPFTFVFIILDMWRPIWKAYKSMAKDAVSTTTRLIVSIKRSTVCLLKGDFRGAYNSINIKDGSSIYDGFDDPFINLMRAYPEVPDWWFLSIALVAFIFAIVIIENWPQLGTPVWTIFFVIGLNLVFLVPMSYLFALSGTTEGLNVVTELIVGYALPGHPEALMFVKAFGYNINGQADNYISDQKMGYYAKLPPRAMYRGQVTSAVITALVAYGVVQFVDTSIDGICTPDQASGFNCENGSQVYYSSSVVWGAIGPKRTFSQLYPELKWTFLLGFLFALFWWTIKRYGHHVRAGARSSLSPSIFSPLNTVFFYPISTLEHIHPSLILNGMLLWAPYNMSYFTGGLYVSFAFMYYLKRYKTAWWEKYNYIISAALTGGLAFSGIIIFFAVQYHPKNISWWGNDVLGQTVDGGGASGQAALLPPTEPFGPKTWY

SEQ ID NO: 2331 - protein, 646 aa, Unknown
  Kingdom: Fungi, Phylum: Ascomycota
MTGPAVGIDLGTTYSCVGIFREDRCDIIANDQGNRTTPSFVAFTDTERLIGDAAKNQVAMNPQNTVFDAKRLIGRKFSDAEVQADMKHFPFKIVDKATKPVIEVEFKGETKTFTPEEISSMVLTKMRETAEAYLGGSVNNAVVTVPAYFNDSQRQATKDAGLIAGLNVLRIINEPTAAAIAYGLDKKVEGERNVLIFDLGGGTFDVSLLTIEEGIFEVKSTAGDTHLGGEDFDNRLVNHFDLSSNARALRRLRTACERAKRTLSSSAQTTIEIDSLFEGIDFYTSITRARFEELCQDLFRSTIQPVDRVLSDAKIDKSQVHEIVLVGGSTRIPRVQKLITDYFNGKEPNRSINPDEAVAYGAAVQAAILSGDTSSKSTNEILLLDVAALSLGIETAGGMMTKLIPRNTTIPTKKSEVFSTFSDNQPGVLIQVYEGERQRTKDNNLLGKFELTGIPPAPRGVPQIEVTFDLDANGIMNVSAVEKGTGKSNKIVISNDKGRLSKEEIERMLADAEKYKEEDEAEGARVAAKNGLESYAYSLRSTLQDPKVDEKIEAADKETLKTEIDKVVAWLDDSQSASKEEYEEHQKELEAIANPIMMKFYGSEGGAGMPGGMPGAGGPGGFPGAGGPGGAPGQGGDDGPTVEEVD

SEQ ID NO: 2332 - protein, 222 aa, Unknown
  Kingdom: Fungi, Phylum: Ascomycota
MRSLSLLVAGLGLAHAHEKVVKVPCCPRKATITYDKSVPDKTPFYLTQVDLCYTPTTLELTFTAYNETNFYFNSSQGTNDDIWAYEVMEAFIHRGTNDPQTYLEFEVNPNNVTYQAFIYNPSKVRAEGAAFDHFFVSDPAADGFSARTTLDREAETWISEATIPLGIFNVDEGKGKGTEWRMQFLRTVTSPETFPDQELGAWNPPDIASFHITPKFGHLKFV

SEQ ID NO: 2333 - protein, 144 aa, Unknown
  Kingdom: Fungi, Phylum: Ascomycota
MSSTTQSVQCFGKKKTATAVAHCKAGRGLVKVNGRPLSLVQPEILRFKVYEPILVVGLDKFANVDIRVRVTGGGQTSQVYAIRQAIAKSLIAYYQKFVDEHSKNMLKQALVQFDRTLLVADNRRSEPKKFGGPGARARFQKSYR

SEQ ID NO: 2334 - protein, 692 aa, Unknown
  Kingdom: Fungi, Phylum: Ascomycota
MADQDDTRMSGHFNDQHRPHQHQQRGVSIPGVIPIPHGPHAESESDDDYPVHDAATSHERRIFSHVTRPDDSYTPDGVYWADLPWLQRAKFVTKVDRQAAAEELQTIGRMMKKDPLSPISWYFRNAVIPGAGLGLEGYVLFSIGNLEPLFAKVWPECWEDNNVCSKNWVSSVTYLEIIGIMVGQVGVGIIGDWVGRRWGLIQDALIMFVGLLMITASWGLTLQGWVICYAWSLFFYSLGVGGEYPITATSSLENAVSAGRLSTREDRLHRGRRVTMAFLMQGWGQFVNQVLLIVLLVIFNSGDGGPPYTKSAAQFCFRLSFAFPAIGTAWLAYYRTWKMPHASKKLAEAKTRAKVTGYDVNSLKYCMKHFGGRLLATAGTWFCNDVFFYGNKLFQGQFIKVISSNPDSLMTTWTWNLVNITVSLAGYYLASLLIDNKLYGRRTMQQVGFFMCFLMFVIPAFDYEHYTSPAGIHSFQAMYFLSSFFNQFGPNSVTFLIAGEVFPTPVRATAHGFSACIGKAGALLASVLYNYIDTRTKFYVVPWFGLAGMLLTWIFLPDTTGLDLKEQERRWGYLTSGRADEYHGVAVHPKHLSLWERLWGVGKTYDPELDWKAKIEDMRREWQDFQEANADLKAAENGNQALPEDGEFSQEIHDYFQRSSPKVPARGGVLEKEKAVEPSDGGSSASGAKKES

SEQ ID NO: 2335 - protein, 520 aa, Unknown
  Kingdom: Fungi, Phylum: Ascomycota
MVHLATIPAHEKEEGESSASGNEHQKARLQLSDYADEFTTSVYGSKFARNDLPRHEMPDGQMPRDVAYRMIKDELSLDNNPMLNLASFVTTYMEDEAEKLMAESFAKNFIDYEEYPQSADIQNRCVNMIGSLFHAPSDGSAIGTSTVGSSEAIMLSVLAMKRRWKNQRKAEGKPFDNPNIIMSSAVQVCWEKAARYFEIEEKYVYCEKDRYVMEPKQAVDLVDENTIGICAILGTTYTGQYEDVKGINDLLVEKKLDTPIHVDAASGGFVAPFIVPDLEWDFCLERVVSINVSGHKYGLVYPGVGWVVWRSPEYLPQELVFNINYLGADQASFTLNFSKGASQVIGQYYQLIRFGKQGYRSIMSNLTLTADHLSDALEELGFVIMSERSGAGLPLVAFRFKTAEEGGEEKHYDEFSLAHQLRSRSWVVPAYTMAPHTDHMKMLRVVVREDFSKSRCDMLIKDIKLCMDMLEQVDADTIKRMKEFTKTNVINSHQATHSHHKFKKEKHSLQGKTGKTHSVC

SEQ ID NO: 2336 - protein, 365 aa, Unknown
  Kingdom: Fungi, Phylum: Ascomycota
MADCNGDPVDLGQRGLRIGAIFIIMAASLLGALSPILLARQSKMHVPKFTFFIFKYVGTGVIIATAWMHLLEPAVDNLGDECLADRLGDYPWAFFIGLMTIMLMFLVELLASRADNEDDAHSHSSFDSEVDPSMDILALKKSANKKNTDVAEPCIHNTDDIERNGAFQGPDQRTIPGLPDDVSYPPGGKDHLAHGREHKEGDSHGSLASQLTALFILEFGVVFHSIFIGLTLGTTDELVILLIVLVFHQLFEGLGLGSRLAVAHWPEDKKWLPYLLAGIFGLATPIGIAAGMGARTDNANTQKLVNGIFDAISSGILMYTGLVELLAHEFMFNPHMRRAPLKTQLFAFGCVLFGVGVMATLAEWA

SEQ ID NO: 2337 - protein, 270 aa, Unknown
  Kingdom: Fungi, Phylum: Ascomycota
MGNEDAVYLAKLAEQAERYEEMVENMKIVASEDRDLTVEERNLLSVAYKNVIGARRASWRIVTSIEQKEETKGNSSQVTLIKEYRQKIEAELAKICDDILEVLDQHLIPSATSGESKVFYHKMKGDYHRYLAEFALGDRRQDSADKSLEAYKAATEVAQTELPPTHPIRLGLALNFSVFYYEIRNEPDKACHLAKQAFDDAIAELDTLSEESYKDSTLIMQLLRDNLTLWTSSEAEGAAPASGEASKEEPAAEAAEPAAAPAAEETKAAE

SEQ ID NO: 2338 - protein, 415 aa, Unknown
  Kingdom: Fungi, Phylum: Ascomycota
MSVRCVPSLLRRVGASVDASRCIDDLILEPELPLHHSFFSPPPLLPLLHSSITTSLLKSIFNLLYTNFSSSHNRSFTMAPIKVGINGFGRIGRIVFRNAVEHPDIEVVAVNDPFIETHYAAYMLKYDSSHGVFKGEISHEADSLIVNGSKVKFYTERDPANIKWSETGADYIVESTGVFTTKEKAAAHLKGGAKKVVISAPSADAPMYVMGVNEKTYDGSADVISNASCTTNCLAPLAKVIHDKFTIVEGLMTTVHSYTATQKTVDGPSGKDWRGGRGAAQNIIPSSTGAAKAVGKVIPDLNGKLTGMSMRVPTANVSVVDLTVRIEKGASYDQIKEAIKEAANGPLKGVLAYTEDDVVSSDMNGNTHSSIFDAKAGISLNDNFVKLVSWYDNEWGYSRRVLDLLAYIAKVDASK

SEQ ID NO: 2339 - protein, 416 aa, Unknown
  Kingdom: Fungi, Phylum: Ascomycota
MHFTSGVVAGLGLAGLVSATPCGVGGVSPIKKIDLGPRPFFLVDDMDEGPLKKKLNSCKEMDMKASDFSIGHRGGGTLLIPEHSKESNLAGARMGAAVLECDVAFTKDRELVCRHAQCDLHTTTNIVAIPELNAKCTKPFEPASDGTDASAKCCTSDLTVKEFKTLCGKMDSFNASATTPEDFLGGGPDWRTELYATCGEVMTHMEHIALVEGLGLLYTPELKTPEVEMPFEGDYTQEMYAQQMVDDYKKADIDPSRVWIQSFLYDDILYWLEKEPEFAKQAVYLDENGDTPETFEYAVGNLTRYKEDGVKIVAPPFNYLLTVEDGEIVPSSYAIKAKELDLEIITWSLERSGPLADVEENEDYYYGTFAEAVKKDGDMYKVVDILVQEVGISKLFSDWSATVTFYANCFGLGLRD

SEQ ID NO: 2340 - protein, 288 aa, Unknown
  Kingdom: Fungi, Phylum: Ascomycota
MLVSQSFVTIVTLFCAAVSANTPPSYDGFRGKWSDHFNAAADAAPVSSKWNTISTSAVFNNEWQTYTNKPANVRHTGEGRLQIMPQKDSSAVRGWTSGRIESKYTLTPTPGKITRVESQLRIGGAKQSQKQGIWPAFWMMGQSYRNGVLWPASGEIDIFENVNGDNICVGVIHCDKAPGGVCNEPIGLPGRTTIDTVSWVVWRVEFDLRQSDWKKQAIVWYKNGKEFHRVTGAAVNSQAVWKTLAAQPLYIIFNVAVGGDFPGPPNSQTIGGKTQVLELGYVAHYVSN

SEQ ID NO: 2341 - protein, 345 aa, Unknown
  Kingdom: Fungi, Phylum: Ascomycota
MSGDMMEVEKVEEKMATMEHSEQHYFKSYDHHGIHEEMLKDEVRTRSYMNSIMQNKHIFKDKVVLDVGCGTAILSMFAAKAGAKHVIGVDMSTIIFKAREIVKQNGLSDKITLIQGKMEEIDMPFPQVDIIISEWMGYFLLYESMLDTVLYARDKYLVKDGLIFPDKAIIYFAGIEDGDYKDEKIGFWDNVYGFDYTPLKETALSEPLVDTVELKTVVTDPTSVLTLDLYTCTTADLAFNVPFQLNVKRDDFIHALVSWFDIEFTACHKTIRFSTGPHTKYTHWKQTVFYFKDVLTVQDGEKVECNLMVRPNSKNRRDLDVQIDYALETDDANRNTKGSLEYRMC

SEQ ID NO: 2342 - protein, 543 aa, Unknown
  Kingdom: Fungi, Phylum: Ascomycota
MIFPIVLASLGGLVGSVVAQTSSNYEPADFNVTLALEELGIEVSQLPPLSNLARRDGNACSAACSTLALLYNKDSVLTKDDAAYDVFTSSYWSEIQNDVSPRCIFKPAEAKDVSAAVLLSRLTQCPFAVKSGGHAAFAGGSSSEGGITISLEKLKAVRLSCNKKKVTIGPGNRWVDVYKKLDPRGITVAGGRVSSVGTGGLTLGGGISFFSNVHGWAVDNVVKYEVVTAAGYIAQVTAKSDPELYWALRGGGNNFGIVTAFTFQALPLPKGEMWGGTKTFLEPSFDEVSEAFSDLIENSPEDPNAGAWVAWLQNSGMKLAATELWYAKPDGDKAAIFDGFNNITAIADSTQNQVLHEYTEALDVSNPKGLREVYYGLTVKANADIAKAARKIFYEELPSTSSVTGANPVLIFQGITEGQIAHMSKNGGNPLGISPSDGPLYIIHVASWWQNSSDDKTIYTFISKVLSRIKAESKKLDVASDYIYMNYASTFENVIAGYGKENVARLKKIAGEYDPTGVFQKLQPGGFKLDRAPTPDSRYFSGQ

SEQ ID NO: 2343 - protein, 414 aa, Unknown
  Kingdom: Fungi, Phylum: Ascomycota
MPRQDVTIGQGTDKRTGFNSAVNTFCSKVDGLTVEAGGYLSMSTEVFLNGGKNPSTYGVIGFVDFEVHNKIKTDHKIAKSSCIQYLEALSVPGGKCSGATNADTKGGTWQVGNNGISYHALGNKVPPKQDAINKLYRGGALETQSVNKRNGAPLNPWPFNSINNVKPVACHSHNDYDRDIPLWAAMSAGCIAFEADVWYVGGELLIGHILPGISRTLKAQYVDPLRAILDHNNGGSPGPKGLYPASPSQSVVLMIDFKTSDERTLDTVNTALQPLRDGGYLSRVENGKFVEKQITVVASGSSSFDRINAGDGVPNRDIFYDAKVDGWNSKYTSINSYYASANFKDAIGNPGSVEAFTQEQKDKVKSQVEKAHGAGLKVRYYDLPGEYMWEAIRDLGVDRLNADDMLNTARLRRI

SEQ ID NO: 2344 - protein, 460 aa, Unknown
  Kingdom: Fungi, Phylum: Ascomycota
MGKEEKTHINVVVIGHVDSGKSTTTGHLIYQCGGIDKRTIEKFEKEAAELGKGSFKYAWVLDKLKAERERGITIDIALWKFETPKYYVTVIDAPGHRDFIKNMITGTSQADCAILIIAAGTGEFEAGISKDGQTREHALLAYTLGVRQLIVAINKMDTTKWSEARYQEIIKETSNFIKKVGYNPKTVAFVPISGFHGDNMLAPTTNAPWYKGWEREIKGNKQTGKTLLEAIDGCEPPKRPNDKPLRLPLQDVYKIGGIGTVPVGRIETGILKPGMVVTFAPANVTTEVKSVEMHHEQLTEGLPGDNVGFNVKNVSVKEIRRGNVAGDSKNDPPLGAASFEAQVIVLNHPGQVGPGYAPVLDCHTAHIACKFAEIKEKIDRRTGKSVEDAPKFIKSGDSAIVKMVPSKPMCVEAFTDYPPLGRFAVRDMRQTVAVGVIKSVEKAAAGSGKVTKSAAKAGKK

SEQ ID NO: 2345 - protein, 290 aa, Unknown
  Kingdom: Fungi, Phylum: Ascomycota
MLRPTALLALAALFAGAQAQISDDFESGWDQTKWKTYAPDCNQGGSISLDTTTGHSGKSSMKVNGAGGYCGHIFFGTTAVPSGDVYVRAWIKASKALTDSHVTFITMPDSGLGTNKHLRIGGQNSILMYNRETDDATLPDLSPQGVAASAKLPTGDFQCFEYHLGSDGTIQTWLNGNAISALQAGPGANNPNGAQWERGSYKPKVSAIYFGWESYGGDTNTFWYDDVVVSSSRVGCTGGDTPPPASTTRATSTSATGGAGPSTTLTTTRTTSSASVPVTTTSSAAGPAQT

SEQ ID NO: 2346 - protein, 169 aa, Unknown
  Kingdom: Fungi, Phylum: Ascomycota
MRFNMLSLLPVVGLSLAQLQPNWTSPAGVSIYNPEDFFDTTGPWSLMSSAGDNLYVAGMRGIDPVTSQLVETGLPRVRQAYKNMKTLVEMQGTDVYSCLRLVVYVTDMAQYRPMCNQVQEEIWGSDPSRYPPRTIIEVTALNQDDIVEVEGTFYAPHLSQKKCPGKKRC

SEQ ID NO: 2347 - protein, 383 aa, Unknown
  Kingdom: Fungi, Phylum: Ascomycota
MQNYDQKRGAAPTNFYEVDYDQPYDRPSRAVQTSMPWWNPRYWTKRIWIVLTIIVVAIIAIIVAIAVTQSRSSSNAYPNYTNLSYSLVDTYGGETFFDDFEYFTGFDPTFGFVHYVPQAQAEQLNLTYATSDSAFLKVDTSVGPESEPNASTGRFSVRITSKKTYDSGLFVFDVRHSPFGCGTWPALWLTDPSNWPEHGEIDVMEAVNQADDGNQMTLHTSDGCSMKVRREQTGKAQQTNCDATKNDNVGCGVEGDTDSYGQAFNQGNGGIMAMEWRKEGIRMWQFSRSNIPSDITDHKPNPGSWGEALADFPSTDCDIGNHFKNQSIVANINLCGQLTESAYSSDNCPSNCTDYVANNPDDFKNAFWEFGSFEVYHAADQSS

SEQ ID NO: 2348 - protein, 426 aa, Unknown
  Kingdom: Fungi, Phylum: Ascomycota
MRLTLGVVASALAASASVAEAKNYLGFNSGAEKVDKSAKFKEDFVAEFETAQNLKGAPGTFNAVRLYTNIQAYSQDDPIEAFEAAIDTKTHILLGAWASGTDNIDKEITAIQKAVKKFGKDFTDLVIGISIGSEDLYRDSVTGLKNDPEGKGNTPNGIIGFIDDYKKAFAGTALAKVPVGHVDTWDVWSNSTIKPVIDAVDFVGVNEFPYYENDKGNDIKRAGILFDNAFNAAKAAVGDKPIWITETGWPTSGIDWDEATPSVKNAKYYWDEVGCRQLFNKVPTFWYILRDSNGANKQKFAITKDLSTTPMFDLTCPTKFDTPKLQAAEEAKTKTTSEAVSTTAAAQSSTSAAEASTTTGASSDEDNANESTSASSSQQTSGSGDSDSSDNSNDSDGDADGAASGLSVSAFTYGSLLVAAVIAVMA

SEQ ID NO: 2349 - protein, 466 aa, Unknown
  Kingdom: Fungi, Phylum: Ascomycota
MALSTLFTLALAGAHLVNAQASGSADAHPGLTTYKCTTAGGCVSQKTSVVIDYQYHWIHSPTGTLASCTTNSGVDSSLCPDQATCDKNCVIDGTTNYTSSGVTTSGDTLTMYQYVQGENGLQNASPRLYLLAADGAKYEQLQLLGQELTFDVDVSTLPCGENGALYLSEMAANGGSKGQAAFGSGYCDAQCPVSTWRNGTINYSNNGFCCNEMDILEGNSRANAFTPHPCNSAGTDCDKGGCGLNPYAQGQKNYWAPGGTVDTSKKMTVITQFITDNGKTSGTLSAITRKYIQNGREVASSTQGGDTITTQQCNAWDSSAAAFGSLPAMGQALGRGMTLIFSIWNDNSQFMNWLDSGSNGPCSATEGDPALIMKNFPNTHVTFSKIRWGDIGSTTGNTGGVTTTSKTTLTTSTTSKSSTTSATKTSSNVQTTTTTGPSQPKQTHWGQCGGSGYSGPSVCEAPYTCK

SEQ ID NO: 2350 - protein, 493 aa, Unknown
  Kingdom: Fungi, Phylum: Ascomycota
MVGLGPRVPPSRKGSKADIPQNLLEQVKKLEEQFTVPTEKLKSITEHFISELAKGLTVEGGSIPMNPTWVMAFPDGYETGTYLALDMGGTNLRVCEITLTDQKSEFDIIQSKYRMPEELKTGDSEELWDYIADCLYQFVETHHGDATKLPDHLPLGFTFSYPATQNYIDEGILQRWTKGFDISGVEGKNVVPMFEAALVKRGVPIKLCALINDTTGTMIASAYTDTKMKIGCIFGTGCNAAYMEEVGQIPKLAHMNMPADTPMAINCEWGAFDNEHKVLPRTSYDIAIDRDSPRPGQQAFEKMIAGLYLGEIFRLVLVDLHDNKDVEIFKGQDIALLRKAYTLDSSFLSAVEEDPWENLSETLDLFTSRLNITCNRGELELIRRLAELIGTRAARLSACGVAAICKKKNYTTCHVGADGSVFNKYPHFKARGAQALREILDWPEKAAGSKEEDPIEVLAAEDGSGVGAALIAALTLKRIQAGNSAGVLHPENF

SEQ ID NO: 2351 - protein, 308 aa, Unknown
  Kingdom: Fungi, Phylum: Ascomycota
MKFTTTAALVAAALGASAHPSGHAHKNAHRSLEARGNFVMNLKPLPPAPTTTEAPAPAVTTEAAAPAAPKPKKEKPANKQKPSTPSTGSGQAKPFCGGASYTKSYSNKKRATTADIFYKGNIGTASDYGCNLMMVDEDVKDDYQHITTFTNAGDKTQECACFNKIGPVGGEVNGFFNGKQALKFNIGPGETKYLAADDNTQGGCSCGAGSVALTTWGEFADTWLEFDFNSDINNGWSGADASCLVAAAEGMPIQGMKVCGHDTCSTINPGGTGTNAYLGGMEAEDGVGLNIAPGKVRLEVTLAYSGSN

SEQ ID NO: 2352 - protein, 792 aa, Unknown
  Kingdom: Fungi, Phylum: Ascomycota
MAAPRSCSSLSRHLLTASRPRTQASSWTSAASCQKTRRQQRCMSSAPSGLRSLLRVSEEVADAVATKKPVVALESTIYTHGAMGKQLAKEHDELVRKHGAIPAIIGILDGVPNVGLTPDEIVRMIEDQDTVKVSRRDISYLVGMGLAGRKINGGTTIAGTMVLARLAGISVFGTGGLGGVHRDGHNTMDISADLTELGRTRVAVVSSGCKGFLDIPRTLEFLETQGCLISTFADGRTGNIDFPGFWARESGSKSPSVVQNEKEAAAIIYSQEQLGIESGMLFANPVPEGMGIPLPEIQAAIETAVTEANEKGFTGSRNTPYVLGRLKELTGNKAVVANIALVESNIIRATNVAVELSRLQSERGGSTSARSQPSMRAAQAAPVSHAAKIEPSPKKADILVAGAVALDLNCDYASKKAGDVAPHAHVSNPARIGQSVGGVGHNVALAAHRASTKNHVQLCSMVGDDVAGSTILAAVEASGLDASHVKRLGQEYKTGNRTAQYVAVNDGEKNLVMAMADMDILTTHSFPDHWRSIVETSKPEWLVVDGNWSGKDIREWVRAGGDNGCKVAFEPVSAAKSRGLFAPQRGLPKLGIYPNTTLSLASPNTYELEAMYEAAKENGYLESMEWFQVVDWFGMRGARERFVYLTNTALTDAGVPVQTIQLLPYIPTIITKLGADGVLLTELLGKEDPRLTDPDSEEYILTRCHSPNSPVGGIYMRLYPAAEKVTDVVSVNGVGDTFLGVMISGLAQGGKVEKLVDVAQKGAVHTLRSAEAVSPNLGQIEEELTRVVSRKY

SEQ ID NO: 2353 - protein, 296 aa, Unknown
  Kingdom: Fungi, Phylum: Ascomycota
MFASQVAILFGAAGLAAAAPLEKRAGITDDVILNYALTLEHLEDTFYREGLAKYTEQDFADAGFDSTFYNNIKRVSSDESDHVSFLTTALKGVGATPVAACEYDFGYDSVETFLATASILEGVGVSAYLGAAADIMSKAYLTAAGSILTVEARHSSYIRAGVKQAPFAQPFDAPLTYNEVFSLASGFITSCPESNPALPVKAFPALAAAPTESAIKTGSKVTLQTPDYTLKGDKVYAAFIAVTGPTFVEATPVEGGFTVEIPEGFAGQTYVVLTGCKDFVTDDTVAAGPAIIEISS

SEQ ID NO: 2354 - protein, 259 aa, Unknown
  Kingdom: Fungi, Phylum: Ascomycota
MATPGAQISKRKKFVADGVFYAELNEFFQRELAEEGYSGVEVRVTPTVTDIIIRATHTQEVLGEQGRRIRELTSLIQKRFKFPENSVSLYAAKVQNRGLSAVAQCESLRYKLLNGLAVRRACYGVLRFIMESGAKGCEVVVSGKLRAARAKSMKFTDGFMIHSGQPAKDFIDHATRHVLLRQGVLGIKVKIMRGSDPEGKAGPQKSLPDAVTVIEPKEEQTVLQPVSQDYGAKAVAAQQASQDARNAEEGGEEEAAGEQ

SEQ ID NO: 2355 - protein, 844 aa, Unknown
  Kingdom: Fungi, Phylum: Ascomycota
MVNFTVEEVRALMDKPTNVRNMSVIAHVDHGKSTLTDSLLAKAGIISTAKAGDARATDTRADEQERGITIKSTAISLYGHLDDADDIKDIVGQKTDGQDFLINLIDSPGHVDFSSEVTAALRVTDGALVVVDTVEGVCVQTETVLRQALGERIKPIIIINKVDRALLELQVSKEDLYQSFSRTIESVNVIISTYFDKVLGDVQVYPYKGTVAFGSGLHGWAFTVRQFAIRYAKKFGVDKNKMMERLWGDNYFNPYTKKWTTKSTYEGKELERAFNQFILDPIFKIFHSVMDFKKEEIATLLEKLQLKLSVDDRQKEGKQLLKVVMRTFLPAADSLLEMMILHLPSPVTAQHYRAETLYEGPMDDDVAIGIRDCDPKAPLMLYVSKMVPTSDKGRFYAFGRVFSGTVRSGLKVRIQGPNYTPGKKEDLFIKAIQRTVLMMGGKVEPIDDMPAGNIVGLVGIDQFLLKSGTLTTSETAHNLKVMKFSVSPVVQRSVAVKNAQDLPKLVEGLKRLSKSDPCVLTMTSPTGEHIVAGAGELHLEICLKDLEEDHAGVPLTISDPVVQYRETVTGKSSITALSKSPNKHNRLYMIAEPIEEELSLAIESGKVSARDDFKARARILADDYNWDVTDARKIWTFGPDGNGANLLVDQTKAVQYLNEIKDSVVSGFQWASREGPVAEEPMRSVRFNLMDVTLHADAIHRGGGQIIPTARRVLLASALLAEPALLEPVYLVEIQVPEQAMGGVYGVLTRRRGHVFAEEQRPGTPLFNIKAYLPVLESFGFNGDLRQATSGQAFPQSVFDHWQVLPGGSPLDPSSKVGAIVTEMRKRKGVKEVVPGVENYYDKL

SEQ ID NO: 2356 - protein, 205 aa, Unknown
  Kingdom: Fungi, Phylum: Ascomycota
MKFTLTASILAFATLTLAQIQATPIILAIAPGSKSCAADNKECRTAEQASPFIASAMSRYKLYSVNEMAAVISLMAFESVDFAYKTNQVPGRPGQGTANMQMAEFNLKYAKSIDKVKDKVADISSVDGLSDEELNNIRALVIDDEYNFASGPWFLTTQCEPSVREQLRSDIDKGFAAYMGCVGVTVDEARTAYLERAKTAFNIKA

SEQ ID NO: 2357 - protein, 227 aa, Unknown
  Kingdom: Fungi, Phylum: Ascomycota
MVSFKSLALGSLAIGSALAFPFNITEMQEMFKRDSELQPRTSPGTGTHDGYFYSFWTDGAGQINYENTQGGSYKVSWNNVGNYVAGKGWNPGAARTINYSGSFQTSGNGYLSIYGWTQNPLVEYYIVETFGSYDPSSAAQTVGTIDVDGGTYKILQTTRYNQPSIEGTSTFQQYWSVRQNHRVGGSVDVGAHFNAWAQHGMKLGNHNYQIVASEGYQSSGSASITVS

SEQ ID NO: 2358 - protein, 211 aa, Unknown
  Kingdom: Fungi, Phylum: Ascomycota
MAEIRRKLVIVGDGACGKTCLLIVFSKGTFPEVYVPTVFENYVADVEVDGKHVELALWDTAGQEDYDRLRPLSYPDSHVILICFAVDSPDSLDNVQEKWISEVLHFCQGLPIILVGCKKDLRYDQKTIEELRKTSQKPVSPEEGVLYMSNLLTSPKGEEIRKKIGAYKYLECSAKTNEGVREVFEHATRAALMSRTGRGGKSGKTKKCMVL

SEQ ID NO: 2359 - protein, 557 aa, Unknown
  Kingdom: Fungi, Phylum: Ascomycota
MDSGNSTNMGEKGDGKPGSPTFAGDHAEGEMAVAGPNELHRRLKGRHMQMIAIGGAIGAGLFISSGGAFQTGGPASVLIGFSIIGVMMVLMMQALAELSVMYPINGAFTIYICRFVDPSWGFACSWEYAISWLTVLPFEISAACNIIHYWQGSEGINNSAWIVPILVALVAIQVFGVKGYGEVEFVLSLMKVIACIGFIILGIITNCGGVPTDDRGYIGTRYWSAPWSGFLNGFQGFCSVFVSAAFSYVGTELTGLAAAETINPRKEIPRASKQVVWRILIFYIVNLFLIGLNVPANSPLYTEEGSTSRHSPFVIAIQLAGIKVLPSIFNAVILISVLSVANSCTFGSTRTIQALAANGMAPQALAKIDPKGRPIPVIIIQLLFGCLAFINLADNGGVIFNWLLSLSSLSALFVYGSIGVAHIRFRMAWKAQGHTLDELPYQAFCGVWGSYVCVLINVLAFLGQTYVALYPVGGSPDPNAFFQAYLAAPLAIFLYLAWKIYSWFYYPEHRAIWVPIKKIDIYSGMREIEGVVSEDVQPAEKAKGVKGFAMGIVRSIV

SEQ ID NO: 2360 - protein, 531 aa, Unknown
  Kingdom: Fungi, Phylum: Ascomycota
MSSVTESPEGVSRQDSNTITRHSSINDVKDEQRITVAACFLGLVASVGGFMFGYVSGQISGFFLMEDYLERFGELNTSTGERSFSAARQGTIVGLLSVGCLFGCLIAGRLADVIGRRLTISASAFFSCVGIIIQISSNKSWVQFAIGRLVDGLGIGALSVAVPMYQSESSPAIIRGVIVSCYQLFVTLGIWTSNMVNYGTNTMSGSASWRIPNGLGFAWALILGGGILLLPESPRFAFLKGREEEARQTIAKLAGVDTNAVSVRAEISEIREKVQEMKEGAQTKWYEVFTGPRMLYRLMLGILLQSGQQLTGANFFFYYGTTVFQATGLNNSYVTQVILGSVNVACTFGGLVVVKKCGRRAALIVGALWMMMCFLVYAFVGHFKLDDEDPSRTPQAGTILIAFSCLFIAGFATTWGPLVWTVVAEIYPSRYRSTAMGIATASNWLWNFLISFFTRFIVDEIEWLYGLVFAGCCAALAVLVFFTLNESKDRSLEEIDTMYTTRVNPITSSKWKGMEAEAAHKESVSEGMRQR

SEQ ID NO: 2361 - protein, 319 aa, Unknown
  Kingdom: Fungi, Phylum: Ascomycota
MVSFTAFVVGLGALALSQGAPTASLSPLEERGDMNFVMGYDHPLAKRFGNFSVRAIGPAVGPRSNTNYNQNYKTGGTVNFTPGTNSFSLNWNTQQDFVVGVGWQPGGHSPITHSGTFSVNSGLGSLGVYGWTTNPLVEYYVMETNVGINTGGSQRGTVTSDGATYAIWEHQQVNQPSIQGTSTFNQYISIRQSATSSGTITIDNHFKAWAALGMNLGTLNYQVIAVESWSGSGSAQQTVSNTGSGDTGGGNTGGGDNGGGNNGGGNNGGGNNGGGNNGGGTGSCSAIWGQCGGNGWSGPTCCQSGSTCHKQNDYYSQCT

SEQ ID NO: 2362 - protein, 366 aa, Unknown
  Kingdom: Fungi, Phylum: Ascomycota
MAEHNIVVLGGDHCGPEVVSEAIKIIKTVEQHSSSAGKFNLQEHLMGGCSIDKHGEPLTEEALSAAKSADAVLLGAIGGPKWGTGAVRPEQGLLRLRKEMGTYGNLRPCFFASDALVEYSPLKASVCKGTDIVIVRELTGGIYFGDRTEDDGSGYAMDTEPYSRAEVERVARLAGFLARGRGEKRVWSLDKANVLATSRLWRKVMNETFEKEFPDLKVEHQLIDSAAMIMVKNPTGLNGVVVTSNLFGDIISDEASVIPGSIGLLPSASLSGIPDGKGKCNGIYEPIHGSAPDISGQGIVNPIGTILSVAMMLRYSLNLPKEADAVEAAVRTAIDSGLRTKDMGGSAGTQEAGDKINEALVKVLSG

SEQ ID NO: 2363 - protein, 249 aa, Unknown
  Kingdom: Fungi, Phylum: Ascomycota
MRFASDILPLAAILWLGGIVTAQDPNCAPGGNFDLSKFNLQLPVGTSSNPNSPRTISSGELQGCNGWQDRSYFFTSSSGSLITKVPGSPSSSGCVTTPNSDHCRTELRESNPNSWNPNNNVNRLKVRLAVKVPGNGGIAIGQILHNLTPNKPVAELYYKPNGDIEIGVAQTTAGGNQIRQPVGHINVGTIFTFELRYEKNALSIALNGGSFKNLDTYQLNAPPCYFKTGNYNQGDAPTEVAFHGIDITH

SEQ ID NO: 2364 - protein, 1343 aa, Unknown
  Kingdom: Fungi, Phylum: Ascomycota
MRSTVLLLGLATFFATATQPPARKWRRDETEVVDATPSRYIVELNSQSCNKRVKARIAKSKGLRVVKTFDHDLFPAISVECDNGCNADLLARLLETDDKDAARDVATVYKPATMQLKLPVEGRSFSDDAAALNYSFHGLTGVDELHKAGIIGEGATVAIVDSGVEWTHPDLGGGLGPDFTVIGGYDLVGDGDWPQEDADPDDEPNDQYGHGTHVAGIVAGKGKQFVGVAPGAKILAYKVIGSNGQSNEEMVIEGFLKAYDSGADIITASLGEKSGWASNAWATLASRMVDKGVFVSIAGGNDGEDGAFSMSNGAAGANVMTVAASDPDMVPVYPFAAHFTLEGSTNMSELGYAPAPRQGGLDFFPDTIIDWPIIPLSLNFTVIGDACQPLDNDALPELNDYILLVRLGGCSLYQKTQTLSTAEVPFVLFYQDANPYSAPSQNRPNSKIGIIDSEAGKAIVQTFIEGGNVTVSFNESTTRFVGMRDAGGGRPAIFTQWGPNYDLRLKPDIMAPGSRVLSTYIGGGYRILSGTSMATPYVAGVAALYIGEHGGRKAHADDPEWAKRLMSRIMSTAQSAPWVEDFTAETNHDFRAPPVQVGAGLLNARRVLETKTTFGFGGRKFELNDTAHYQGKHSVEITNSGDEDVTYSFSLESAAGFDSWEPNAPGAPPAFGKDSFKGYYDYEPMEMVPDVAMPDEITLSPGERASALFEFTPPSALNSSRIPIYGGRVLIHASNGEEFGIPYYGIGADIKEVIPGNWERGFSLPNMISGPDRQSIQDKPTLTFNLSLQSQDFPLLVAQVAYGSREIRWDVFDSSFNESDWSYPPIPGKNHFVGSATAWSRSMQASYFNPETDDASDVFAFPRYNIPRSLATYYMWLGQFANGSHVQPGQYQFRVAALRPFGDPHVAQDWDVWETPEITHLCDWGTDSTTVDIDVESREVVAKTEEPDSLPVLEYSVPTIYRSSVAMLFATIALTLASLAQTALAVTGAAEGFAKGVTGGGSARTVTPSTTAELVSYLGSSEALNIVLTKTFDFTGSEGTATEPGCAPWGTGNSCQKAINKDNWCNNYQPNAPKVNIQYDKAGMLGITVKSNKSIVGQGNKGVIKGKGLRLVSSVSNIIIQNIQITEINPAYVWGGDALTIDGADLVWIDHVTISRIGRQHLVFGSKASGRVTISNCDIDGRSSWSADTGCTGNHYWGMYFTGSNDLITMKNNYIHHTSGRSPKVEGNTLLHAVNNYFYSNPGHAFETASGGMVLAEGNVFQNVKAAVENNGGKWFASPDSNSNAKCSSFLGRNCQLNAYGSSGSLSGSDTSFLSNFQGKNIASASSANDAKNVPNTAGFGKI

SEQ ID NO: 2365 - protein, 204 aa, Unknown
  Kingdom: Fungi, Phylum: Ascomycota
MSSNRNYDFLIKLLLIGDSGVGKSCCLLRFSEDSFTPSFITTIGIDFKIRTIELDGKRVKLQIWDTAGQERFRTITTAYYRGAMGILLVYDTTDQRSFDNIRTWFANVEQHATEGVNKILIGNKCDWEEKRVVTTEQGQALADELGIPFLEVSAKSNINIDKAFYSLAADIKKRLIDNQKNEAPSAAGVNVGDKGDGGAGSKCC

SEQ ID NO: 2366 - protein, 492 aa, Unknown
  Kingdom: Fungi, Phylum: Ascomycota
MSDHIASVSPMAENNKKAEVPDLEKAGGSESGGDNSGTGGIVGDSSSIGDKIADPNAILVQQKTEEGHQKYNRLGWKRLTVVLIVEAIALGSLSLPAAFATLGMVAGVILTVGLGLVAIYTSYIVGQVKLKFPEVSHYADAGRLLFGRWGYEIVGVMFALQLTFLVGSHCLTGTIAFLNITDNGACSLVFGAVSAIILLILAIPPSFAEVAILGYVDFASIILAIGLTIVATGVQSSDATGGLSQVDWSAWPKEDLSFSSAFISITNIVFAYSFAVCQFSFMDEMHTPSDYVKSIWALGIIEIVIYTLTGALIYAFVGVDVKSPALLSAGTTVSKIAFGIALPVIYISGSINTTVVARYINGRIWENTKRSLNVYVNTKEGWMAWLALITTITVVAWVIAESIPFFSDLLSISSSLFISGFTFYFPALMWFMLIREGGLFERKNILKTIVNAIVFVIGIVVLVCGTYASIADIIHKYNDGTVRGVFTCAPIE

SEQ ID NO: 2367 - protein, 453 aa, Unknown
  Kingdom: Fungi, Phylum: Ascomycota
MKTGTVAALAAALGLANGCLMDSELEAEREFVRTGKRSEIHAMPHPRQATTTFPIGEGDRFKRGCKVPKGLGLNDRDLGSILNVGEVETALKGLKKGFPDEVELFEPPFETFEGRKFFGAKVGEDPRVFIMSGIHARERGGPDNVIYFLADLLEARKTGSGVTYGGKSYTAEQVETALSAGVIILPNTNPDGAAHDQSTSSCWRKNRNPTSSSGTGSGRDVGIDLNRNYDFIWDYTTHFHPDTSPASNNPGSETFYGTEPESEPETKAVVWTLDQYQNITWFMDLHSYGPSILYAWGDDEAQTIDPNQNFVNPEFDGKRGLVGAPDPPEAEYQEYFLAEDLTTEEDVTGSMIDAMLTAGGAPYTAYPAVGLYPTSGASNDYAMGRYYGNLTCGSSRMFGLTMEFGAPSRSFPSCPFYPNKDEYHRNVRQVGAGFLEMMLLAAGKAGDPLYAEC

SEQ ID NO: 2368 - protein, 526 aa, Unknown
  Kingdom: Fungi, Phylum: Ascomycota
MHVTYTLLAALIAFAPPVKAVTIDANSKLQKIDGFGFSQAFGRAKEFQTAPSGMQKQALDYLFSTTSGAGFSIIRNRIGSGGSGDSIEPNNPGSPSATPKYVWDNDDKGQVWFTKQAVAYGVTTIYADAWSAPGFMKTSGNEASPGYLCGTTGHSCSSGDWRQAYANFLVQYVKYYASIGINISHLGFLNEPDYQVSYSQMQISSNAQEAISFIPILASAVKAAGLSTAIACCDPVGWPTARTYTPNLVNAGMEQYLGLMTSHTYSGDANSKLGTKLPVWVTEAGTGDSSKFVTTWYSNGAAGDGMTWANKIATGMIDAGLSAYLYWEGFENKQTQSGSHLVDTFDGSTATPNGIFWAFAMWSRHIRPGAYGLTVSGTISGVKTGAYKNTDGTIVIVFTNSGTSQQTGSASFSGFTPSSASAWLMDNSHTFASTSVTLSGGAISIALPAHSVVTVKLSSNGSTNPPSSTTSTTTSKTSSVPPASTSAPPGSCAALYGQCGGTGFSGPTCCAQGTCKYSNDWYSQCL

SEQ ID NO: 2369 - protein, 218 aa, Unknown
  Kingdom: Fungi, Phylum: Ascomycota
MSASVLRPLLPRHTFRSTVSRSSSLPQQLAFKQTTFSAARFFSATNAAMGNKVFFDLEWEDKSGPQTGRINFNLYDDKVPKTAENFRALCTGEKGFGYQGSSFHRIIPEFMLQGGDFTRGNGTGGKSIYGEKFADENFALKHTRPGLLSMANAGPNTNGSQFFITTVVTSWLDGRHVVFGEVADDESMKVVKALEGVGSSSGSIKFSKKPTIVKSGEA

SEQ ID NO: 2370 - protein, 336 aa, Unknown
  Kingdom: Fungi, Phylum: Ascomycota
MAPMHLAGALVGLALLGSTDALFTVNCAPLTVQRGDPIVSPGRISSHVHAVVGGTAFQLEQSNEVAVNAKATTCDKVLDNSNYWQPQLYHMRNDTKFELVHMQGIAAYYIPRACDYKEGRRNCNDAKDPIAPPAGLRMVVGDPMRKTLDTSIFEHKAIQHVCLKESDSTNTYELPREKCLRMRAETFFPSCWDGENLDSANHKSHMAFPAFGDYNGGVCPSTHPVAIFSVFFEFFYDTNAIKNFNRLVWAQGDAKGYGLHGDFLNGWTDQERLNNSMTTCTGQGGVNAEGCSLNMGGEEGPGRARERDVEVAAPVEEVGLNGALAKLPGNNPVFGL

SEQ ID NO: 2371 - protein, 249 aa, Unknown
  Kingdom: Fungi, Phylum: Ascomycota
MPATTVPTNDQIMVPETLLKKRKSQEKARAERTAAQEKKKAGSKDKRQVIFKRAEKYVKEYRDAEREKVRLHREAKKSDSAYIPAEATLIFVVRIKGINKMPPKPRKVLQLLRLLQINNGVFVRVTKATTEMLKIIEPWVAYGYPNLKSVKELVYKRGYGKVNKQRVALTDNSIIEENLGKYGIVCMEDLIHEIYTVGPNFKQASNFLWPFKLSNPNGGFRPRKFKHFIEGGDLGNREENINALIRRMN

SEQ ID NO: 2372 - protein, 507 aa, Unknown
  Kingdom: Fungi, Phylum: Ascomycota
MGQEDIQENTTGVMVSSNTSRAEVEKPGNPEQQIEPTITAKKRQSLSDIFTIFCAGAALLSDGYQNNLMTMANVLLGKEYPKEYTADVSTRVSNSLLVGQIIGMIVIGLTCDHMGRKAAIMATTTLIVLGGILATASNGVTISGMFWMMTVARGTVGFGAGGEYPASSTSASEASNEHALKKRGPIFILVTNLPLSFGGPFAVIVFLIVFAACGKAHYTTVWRICFGIGCIWPLSIFYFRIKMMNSKLYRRSALKKNVPYKLIFKYFGKNLIGTCGAWFLYDFITFPNGVFSGTIISSVVSHSGSEGDVIQRTAEWQLLLGILSIPGVFLGAFLCDRIGRKNTMMLGFSGYLVFGLIIGCSFDKITKIVPLFVVFYGLMQSTGNMGPGDMLGLLSSETYATPVRGTCYGISAAVGKTGAAIGTQAFKPIQQNLGKKWTFIIAAICGVAGVVVTYFFIEDIKGDDLALRDEQFRQYLVDNGWEGEIGEADLKENAAVHIVAEKAEEQK

SEQ ID NO: 2373 - protein, 202 aa, Unknown
  Kingdom: Fungi, Phylum: Ascomycota
MSSFESVVVIDGKGHLLGRLASIVAKQLLSGQKIVVVRCEALNISGEFFRAKLKYHAYLRKMTRYNPTRGGPFHFRAPSRIFYKAVRGMIPHKTPRGAAALERLKVFEGVPPPYDKQKKMVVPQALRVLRLQPGRKYCTVGRLSHEVGWKYQDVVARLEERRKAKSSAYYERKKVAARQLSDAKKNASTKKETTEALAALGY

SEQ ID NO: 2374 - protein, 614 aa, Unknown
  Kingdom: Fungi, Phylum: Ascomycota
MGFLPFSKSKNEETVPVAAPTQTGWDQTPVNDVNVAAAHNGEHVPASRAVRDLKSPGVARVEAISSAITFTDRIFIFFGIFLIAYVYGLDGTLRYIYQTYATLDFGQHSLLSTVNVVRAVIAAAAQPTAAKIADVFGRVELVVLSIFFYVIGTIVEAVATNVKTFAAGAVIYQIGYTMIILLLEIIIADITSTRARLFFSYIPALPFIINTWVSGNISEEVINSTTWHWGIGMFAIIYPVCALPLILSLMLVSRRAKKQGLLDNWRSSFQVFGVGNVFIELFWVLDVIGIILIIAVFSLILVPINIATDSDTVWKEAHILAPLIIGVFCIPAFIFWELKAPHPLVPFRLIKDRSVWAPMGIAVLLNFAWGMQADFLYTVLIVGFDFSIKTATRITSLYSFTSVIIGPLLGVLVYYVRRLKMFIIAGTALFMVAFGLMIRYRGSPSGDGKAGVIAAQVVLGVAGGMFPYPAQASLQVFLRHENLATMTALFLATYNIGSALGNAVSGAMWRQTLPSRLNSGLQGINSTLADSVFADPLTAAATYPMGTPERTAIINAIQSVQRYLCITGICLCVPLIAFALCMRNPKLNDNQTLAKEIESDSETDAESKRRHDGA

SEQ ID NO: 2375 - protein, 695 aa, Unknown
  Kingdom: Fungi, Phylum: Ascomycota
MMTIQATHFTPEVLLSAPRRSPAVPNPTGDLILYTVSTYSFETHSKSSQIRVRDVKETSSYVVADDPAAHEPVWISDAEILYLVPGKNGSTSLMRLDVKNHPSGPELVYNSPGALSNPKVKLVSEEEVIFCCSAPTLPSGKLFCEASEPKAHSSAKIYDSLMVRHWDTWLTKNRNSLWYGLLKKGDGKWELEGSRLTNLLAGTQLSSPVPPFGGTGDFDISSKGIAFVAKDPKLNEARHTKTDLYYVPIKDFRDEPGTLPQVVMTGQLRGYSNSPTFSKDGEKLAFTRMKSDRYESDKTRLLLIPDIEDLSNVQEFYETEDGKGAWELRPDWIVWSNDGRELYVSAEQHGRAVLWKMPASPRHATQVPPEAIHEDGCLIDAKPLGSYNSLFITRRSRVESSSFAILDPNTKSVTEVSSSSKHGKSFGLRHSQCHDVWFAGAGGYDNHALVMRPSNFDPSKKYPLALLIHGGPQGAWADDWSTRWNPAIFAEQGYVVVCPNVTGSTGYGQDHVDAITKNWGGTPYEDLVKCFEYVEKKMPYVDTDRSVALGASYGGYMINWIQGHELGRKFKALVCHDGVFSTRNQYQTEELFFPEHDFGGTPWENTEYYDKWDPSRFSKNWETPMLVIHSELDYRLPIGEGLSMFNVLQAREVPSKLLVFPDENHWVLKPENSLVWHKTVLDFINKFTGVEQEAE

SEQ ID NO: 2376 - protein, 207 aa, Unknown
  Kingdom: Fungi, Phylum: Ascomycota
MSTVNIGSSGEWDKLLSGTDVVIADFYADWCGPCKMIAPHYERLAKEHSRPKKVAFAKVNTDNQSDVARSNGISAMPTFKIFHKGACVETIKGANPSALNDAVTKAVKLAGGGATAGELFKSPGRTLGGESGSGGSGSGGGIFSMSNLLQVLMAFFDPYKAAENSRFNLKKGPGDGKKPRQGGFPAGRGGPVQKTPFTTFADLNGCG

SEQ ID NO: 2377 - protein, 369 aa, Unknown
  Kingdom: Fungi, Phylum: Ascomycota
MLPNALILLGALASAVVATPASAQVGIEARAVSCKFTTLDEVLKGKKNCDKLTLDNISVPAGKTLDLTGLKKGCNLIFKGKTTFGYKEWEGPLISVSGENVRVEGTSGHTIDCDGKRWWDGKGGNGGKTKPKLFSAKNLNNSVIKGLNVKNQPVHGFSINTVKNLDIIDVTLDSQAGDTQGGHNTDGFNIGNAENIYISGAIVRNQDDCIAINSGKNITFTNGDCSGGHGLSIGSVGGRSNNEVLNVRITNSIISKSDNGVRIKTIANASGRVDNILYENITLKDIVKQGVVIQQDYENGGPTGKPSGGMPITNVKLDGVKGNVLEKGANVYILCAKGACSGWEWKGVDVTGGKKPKSCLNVPSPAKCS

SEQ ID NO: 2378 - protein, 808 aa, Unknown
  Kingdom: Fungi, Phylum: Ascomycota
MYARFTTTVLCNSLVQNAIQDCGLSQNEAEPLCADTCAEFARSEAFITNDNELCSSPAGNLNDLIRADFTNCALPEAALSGSTCISGIDNEPENCGYGNSTTGFCSYCAAGGINSTDTCCYSADAEKRCQDVELPTIAQTMSFDAPTATGSPSSTASSNTDEEDDDDNDNGLSGGAIAGIVIGSIVGLALIALLLFFCLRRRRHREGSTKGSIFNQPSPARKGASMSMTQSAPQGYEVLPGGRIARMSALEGHSGGSPSRDHHHTGLAAGAMGAGAGYMAGRRKNDTQSSSSDFGDSPASDGRAGVLRAPPTALKRDGSLSSGSVLGSSVPQSPTSAGFSSPQGLASQQSEQLPFFKDYYSSDDIHPGDRVATLWAYQPRAADEFTLERADMLKVVGIWDDGWATGILLNERAEEWEARRQAQRDSGVSNTSGRRDSSPAASGEIKAFPLLQTSALTLSSTSVNDQTGTKRQLRMAEAKANAEALVPKFKLARVLNHDQAGRRTSLCGTIDAKPALLILERAPFPNEDVYLAGVPSSLSRLRNLGANDIYAWFMARTGSQDTDAAAPAAAKGAEGSSFFPDLKINLIYPCTDTHIKKYSKQGVRHVLETPDIYRNSIKPYMQQKREEGRLNWVFNIIEGRKEVEDVIYRTKLGESGDEGFLLLPDLNWDRETLEALHLLAIVERRDIWSLRDLKKRHIPWLRHMKQKLVNAATQTYPSIEADQLKLYVHYQPTYYHFHVHIVHVALEAGATQATGKAVGWDSIVETLEVMDGDEDAGMDRLSLGYTLGEESELWKAIYKPLKEAAANS

SEQ ID NO: 2379 - protein, 463 aa, Unknown
  Kingdom: Fungi, Phylum: Ascomycota
MKSFTALLSITAALSAAPALAADKEAWKTRNIYFVLTDRVARDSGDSGGNACGNLGNYCGGTFAGLEGKLDYIQGMGFDAIWMTPIVANTDGGYHGYWAKDLYSVNENYGTADDLKSLVNAAHEKGMYIMADVVPNHMGAGDISTYRPEPLNQESSYHSKCDINYNDQNSIENCWIAGLPDVKTSDSTVRGVLYEWIAWLVDEYGFDGLRLDTVKHVEKDFWSGFTEASGVYTVGEVWDGNVDYLAGYDGLMGGVLDYATYYPMNRFYQQEGSSQDLANMISTVESSFGDPAALGAFLDNHDNARWLNQEPDTALFKNALTFVLLSRGIPIVYYGTEQGYAGGNDPQNREDLWRSGFNTNADLYKFIAAVTRAKSTAGGLGGNDHETLYVADTAYAWSRAGGDLIVLTTNGGQGTSGEHCFNTGVNNGSWDIMLGGEGSVSSDGNGRICLKFNYGLPVAIVAS

SEQ ID NO: 2380 - protein, 393 aa, Unknown
  Kingdom: Fungi, Phylum: Ascomycota
MLWPNVVVLERPVGASDRSSEGLIVEVGSRTRAMQEFGSGEAGDAVLLNTTVSYTTLPTTSVTTTVTTSVTTVDESSAETTQTDWTEATSTIYSDTTTVVETEYAATKTVEAGSGIPVRDLELNARYVVPAPVKEYPTYASVCGSFEKYSSACGCLGQRPRTTTAPRPTETSICTKYSTTVSTEVVVEHSTEINYIPYIESVDATTYIATETVWEHTVTSTQTITPTVTSVVRNGGFESGTYQRWRADEYNQLDFSITRTGNRGTKYALQSGNMWNNYLLEIYQNTLAVEGVRYKCVYDWKFTNYYSTWYAGEGKYFIPYIHVYLRDSWDAVDWVSPDQNTKGTWQTSSFEFTAKGGDRIWFDAASPQPKKASDGGGSNSLFLDNIACYPVPV

SEQ ID NO: 2381 - protein, 604 aa, Unknown
  Kingdom: Fungi, Phylum: Ascomycota
MTTATQLDVDAIANSGLNDPEFKGIHPHDARGSMDVNQKIHDPYVTTTDDEEDWPDKPTEDELATLRRVSGKIPWAMFTIAFVELCERFSYYGSSILYTNFVNNPLPDGSNTGSDPSPEGHPGALGQGPQAAQGISLFNQFFAYIMPLVGAYIADARMGRFWTLHLAIGISTIAHAILVASAAPGVIVHTDGAFAAFIIGLLTLCVGTGFFKANVSPLLAEQNQDTRMRVEERKGERVIVDPAITNTRVFLYFYLCINIGSLTGQISMVYVEKYHSFWLAFLIPTILFLLSPLVLWSNKKKYKLSPPTGSLLAKFLTMWNYTRKNSSSMFKLNWDVAKPSGIPVHERPAWMTYDDAWVDEVKRGLMACKVFLFLPVFFLAYNQMTGNLTIQAGTLQRNGVPNDILQNLNPISIVIMIPLIDFVLYPGLRKLGIAFTPIKRMTAGFVMSALSMVAAAVMQHYIYKMSPCGEDALACDEPAPINVWAQSLPYILIGLSEIFTNVTSYEYAFSKAPENMKSLVMSVNLFMSAVSAAIGQAFTPMSKDPLYLWNYVCVALIAAIGGIAFWFCFRHLDSDEDKWNMLKKSEYIGQNKPTDTAESKQIDA

SEQ ID NO: 2382 - protein, 627 aa, Unknown
  Kingdom: Fungi, Phylum: Ascomycota
MRDDTTERLCPTILQQLSPLLFFRASTSLVSFSALGQVRPCAPKLTFLSLASFFQPLLLPIPPNNINPKARDIMADVKTVEFKPFQDQKPGTSGLRKKVTVFQQDHYSEAFITSILLSIPEGVEGSTLVIGGDGRYWNPEVVQLTAKIGAAYGVKKLIIGHNGILSTPAASHVIRLRKATGGILLTASHNPGGPKADFGMKYNLSNGGPAPESVTNKIFEASKTLTSYKIASIPDVDLSTVGTQTVGNLEVEIIDSTADYTAMLKDIFDFDVIKKFFAAHPDFKVLFDGLSGVTGPYGKAIFEQELGLTGATQNCEPSPDFNGGHPDPNLTYAHSLVEVVDKNNIPFGAASDGDGDRNMIYGANAFVSPGDSLAIIAHHANLIPYFQRNGVNGLARSMPTSGAVDLVAKKQGLDCYEVPTGWKFFCALFDAKKLSICGEESFGTGSDHIREKDGLWAIVAWLNIIAGLGVKNPDVVPSIKAIQKEFWGIYGRTFFTRYDYEDVDSEGANKVVGELQKLVADDKFVGSSIGDRKVTKAGNFSYTDLDGSVASNQGLYACFSSGSRIVVRLSGTGSSGATIRLYIEQHTSDPSTYDMDAQDFLKAEVKFATELLKFKEHVGRDEPDVKT

SEQ ID NO: 2383 - protein, 565 aa, Unknown
  Kingdom: Fungi, Phylum: Ascomycota
MKGAIATAAIAALATGANAHIHHRRAHDLFKKSQECKPVCTTYIETIYGKPTWIPDAPKPKPTKEAPPPPPPAPTPTETPVEIITTEIPVVPVPEVTICPTPGTYTIPEETIIVDKTVTVCAAASTHLPPGTHTYGEITTVVEGSTTVTCPYATATNGEEAPVTTHVCHEAGVCTVVPGTVTVIEEETDVYYACPTVYAPGTYTAPATTVTVTVDQFVVYCPYTTSEKPAPPPAATTAPPAPKVEKPKVETPAAPKPAAPKPEATEEYKPKTEQPKEQKPKTIKVGGGLAITGKLGEGNGDHYGITYTPYNPENGDCMSAGAVEKDIIAIKAAGFTTLRIYSTDCNTLETVGPACKKHDMKLIVGVFVKGSCSYSSPDVKEQVDAIGQWADWDRVDLIVMGNESIMNGLCTPGELKSLIDTCKSKWSGYTGPYTIAETLDIWERPEVPATLCSAVDVVGANVHAFFNPNVKSSEAGKFVKGQLDILGKMCPGKEALNLECGWPNGGQCNGAACGSPEDQRKALDSIRKEVGDKSVFFSFKNDDWKQGDALDVERHFGTNSYFTSL

SEQ ID NO: 2384 - protein, 1467 aa, Unknown
  Kingdom: Fungi, Phylum: Ascomycota
MKFLATLLAVAGLANGLGDTDTITWGGDNSRTGYQTNHNMDPAVVGSAQFGQIFRTQLPGRYGNAAEQMFSMPLVYTPSGDDQQYVYVATTQNNVYKLNARTGEIILSRNLHIPFLTADLDGCVDINPNIGITATGVIDPETDTLYLTAKTYRDQNGGTGPQGLLEGRTYLHALDVNDLSERPNFPVDLEGTVARNNPSRSYGGGIHLQRPALLHTGNFIYAGFASHCVQYNFTGWIMGWDKTTGETVERYAMEGEGVDSPTKGGGIWMSGGGLSSDDAGSIFFASGNGYASQLATIPVAGFNPPTALEQAAVHMTMNEDGSLDVVDFFMPWEKQALDGADMDLGTSPLEILPSEFACGDYKRIGVVTGKSGKTYWLNLDDLGGYRNGVDGLDNVIQVYKNENSVYAGAGVYPGEGGYIYINVIQYPSHVFKFSCNAGKPVFTKVADTPVNNAYILGVSHGTVTSLDGQPGTGMLWITDVQGDHLRIYDAVPRDGEMVLLNSFSVPGSMKFGRPVFGDGMMYQTSNQGYIYGFGSPINQPLNCSGTADFGNVDIAETSESVTVTCEALINVEVTSMGLSEDKNFVISDTPTLPLQLAAGKTLTFKAAFKPSTVGFQTTDVAFNTTNGNEGYATRSSTRLTGTGSSVEPLLFVSPNSITFQGVITGQDPNTAIENVQVTNRGNNLLTVTEVQYSSVSADGPFETFTGAGDLTVGKFRVTDIPSEVEANSGATINVRFDSSESGTYSAFLKFVTNGGTKSVAIAGSSGPAPKALVEFQTIDGSDWVEYKEGTPFTFGNVTENTSRSLRMRVSNVAPQGGVRLYLTVSKPPAGGSSIIRAANAVDLGEGTSLAPGENATAVITCASAKRQWNTDAKNGTAVWTMNTNDAEFEKQVIGFYCNSVAEQAPPLMPDGEGQYRYIGCFKENTPGRQLQSQLYGNDASTNAMCIEACNNREFTFCGTQYHRECWGGNLIPAQKVDEINCNFDCSGDIHQTCGGNGEGAGSGGTYISVFADSLTFDGNYTRPDGGNNGGGGGGGGGGEPGPKPVANPGVNGYKHIGCHTEATTGRALSKQIGLEVATVENCVDACAAEAFLMAGVEYAGECFCGNTLRPGAVPAPAAECNLACSGNKTELCGGGSRLNVYQLDDGSIPTPTNGPEPTSSTTTRVSSGTPVPTSPSRTRRVGDYLLQGCWTEGTNVRALAGKTYARDDMTLNDCADFCDGFTYFGTEYGRECYCGNSLGTGSVKAENQYDCSFTCAGNPLQYCGAGNRLELYKLEGATVSSSSSSATSSSSSVVSSSTEASTAEETTAEETTAEETVTPDFTDVAATNTRSSSTISSSTVSSSSSSASASPTGPMVDPGNSNFTFYSCAKEPSSGRLLTTQIFNDGDEMTIQACLERCWNYKWVGVEYGRECWCNSEVKWAGNTGATPGKNVTDETCNFKCPGDKNIFCGGSSVMSLYKRKDDDDEE

SEQ ID NO: 2385 - protein, 580 aa, Unknown
  Kingdom: Fungi, Phylum: Ascomycota
MSAKQAVVQVIYPSGPDATFDMDYYLNKHMPLVDAKWGSSGLKHWTIITAEKGEDWSVQAHLIWESVEAFQSAGDKETVLGDIPNFTNTQPTIKSGSIVATKANGPASRGLGPLQEYDRRVDAGELKNDEHQRGIIENLQWLYDDLCDYDAPPVVHPSRDLLKPAKKSVFSFFGGGKSAASQSAIGAIPQNLPRGLYLYGDVGSGKTMLMNLFYDTLPSSVKTKTRIHFHNFMQDVHKRLHKMKMEHGSDCDAIPFVAADIAEKGNVLCFDEFQCTDVADAMILRRLLEALMSHGVVLVTTSNRHPDELYKNGIQRESFIPAIKLLKNRLHVINLDSPTDYRKIPRPASGVYHTSLDAHAKSHADKWFRFLGDSENFNPHPETQNVWGREIHVPQVSGRCARFTFDELIGKPKSAADYLELVRAYDAFIVTDVPGMTIRERDLARRFITFIDAVYEGNAKLVLTAAKPLTELFVSRDEIAEALLDGDASRDKSKKETKAEASQAMHNILEDVDDSAAKLKNTNLFAGEEEAFAFARALSRLKHMESQEWVERGMGLEKKGGKQDRDGWVKARSRQMEDSM

SEQ ID NO: 2386 - protein, 629 aa, Unknown
  Kingdom: Fungi, Phylum: Ascomycota
MMTIATALRWAALVGLAQAQFPPKPEGLTVLKSKIHENVTISYKEPGICETTPGVKSYAGYVQLPPGFLDDINGEPQDYPINTFFWFFESRKDPANAPLAIWLNGGPGGSSMMGLLQENGPCMIAEDSKSTVLNPWSWNNEVNMLYIDEPVQVGFSYDEATNCTVKMLNDPEEFFEIIPSDFSDGLPDLNFTTYVGTMASQNLSHTANSTASAAHALWHFAQTWFFEFPAYTPENDRISLWAESYGGHYGPGFMRFFQSQNEKIENGTIEVDDAHYMHLDTLGIINGALDEVIQGEAYIDFPYHNTYGIKAFNESIYKELKHNWTTDGGCKDQLKECQGRLRSFDAATINQNEALAADICDNVEVSCQKGAVYQYFQLDHGWFDIAHPQADPFPPPYMFGYLTESGVLGALGVPVNFTFASPTVATAFQSTNDMTHGGFVEAVGYLLDHGVKVHMMYGDRDYACNWFGGEDASLAVPYSGSESFAAAGYAPLLTPDGYSGLTRQYGNYSFSRVFQAGHEIPSYQPEAAYAIFMRATFNTDIATGLLPIQDDYSTLGPSEIRSVLNVAPERPEPRCYVIKPDSCTPDVWEKVVAGKAVIKDFMVAGFVGEDSDESGIDDGDDDETLGEEL

SEQ ID NO: 2387 - protein, 247 aa, Unknown
  Kingdom: Fungi, Phylum: Ascomycota
MARKFFVGGNFKMNGSISSIKEIVKNLNDADLDPNTEVVIAPPALYLLLVREHLRSGLEVASQNVFDKPNGAYTGEISVSQLQDSNITWTILGHSERRTILNESDDLVASKTKVATEAGVGVIWCCGETLEQREAGKTIEVVSKQLEALKAQVSDWSKIVIAYEPIWAIGTGKVATTEQAQEVHKAIRDWLKAVSDKVADETRILYGGSVSEKNCVELSKQPDIDGFLVGGASLKPAFVDIINSKKQ

SEQ ID NO: 2388 - protein, 283 aa, Unknown
  Kingdom: Fungi, Phylum: Ascomycota
MFGKAIAVALSLASAATAIEAPNYSGFTRLWQETFTGSAGSAPNGNNWETRVGDLGVNNELQIYTTSNSNLQLSGGSTLQIVPRRDGSAPKGWTSGRIESRYTFTPGAGEVTRAEAQIRFGDGNSKQGIWPAFWQLGESIRHGVDWPACGEIDILETVNGILTGHGTVHCGQYPGGPCGEPNGIGGSIGIPDQSWHTWRVDYDRRSGNFQDQSITWFMDGRQFHQVTGARIGDAGVWAALAQSPVFFILNVAVGGDWPGYPNGNTQDGYNSMMEVAYVAHYST

SEQ ID NO: 2389 - protein, 417 aa, Unknown
  Kingdom: Fungi, Phylum: Ascomycota
MQISCFVAVATFLSAVHAHPGHDISEEVAERRHFVNSIHRKDLSHCAENLRARGVEARSIARRSAAVEEARARRGVSKRDLEEASAESHDQSKLGYTENTDASKLFSGNASCILTPEVTQGPYYVGGEFVREDITDDEPGVDITLDYQVIDVDTCEPVPDVYVEIWHCNSTGVYSGVVANGNGNTDDETNLDATFLRGIQETDLDGVATFKSVFPGHYTGRATHIHVMVHTNASLLANKTLGNDIYASHVGQAFFDQDLITAVEKTSPYSTNTQDVTLNSKDSILAEEAEDVDPFMDYVYLGDDLDSGLFAWIAFGINTSYSSHVTPAASYYEDGGVANEDSGMGGGPGGSGGPGGNGTMPDGMPPGGTPTPSAGSDTTTQSDSGSAGTSTSTGAAAVATLPALGAIAGSIGLAIFL

SEQ ID NO: 2390 - protein, 236 aa, Unknown
  Kingdom: Fungi, Phylum: Ascomycota
MKSISLLAFAATLALADNLCDQFAHTESNGYYANNNKWGDNLGTGTQCLSVDKMTTDGVSWSVDWTWSGNDDMTKAYPYAGRTLEEKKLVSAISTIPSQADWGYSGDAVRANVAYDMFTSSDPAHDTSSGEYEVMVWLGNDAKLWPVGTAGDVVKVAGKEWTLWDGLNGDMHVYSFVATEDQNSVDFDVKEFFDHLRDNKDYPVDSQYLTTLQLGTEPMTGGPAQFLVNWFSAEVN

SEQ ID NO: 2391 - protein, 185 aa, Unknown
  Kingdom: Fungi, Phylum: Ascomycota
MVHADASNFANGVTKEEAYEQVLLMAEGLFHGQSNWVCNLSNAASLLWHAYKSLSAPSDEVNWAGFYVRDTSSKNEQLILGPFQGKVACQTILFGKGVCGTAAATQKTQLVRDVEAFPGHIACDGDSKSEIVVPILVPVADGSEEKRTVAIIDIDCAELNGFDDEDQKFLEQLAALLAKSCAWPQ

SEQ ID NO: 2392 - protein, 322 aa, Unknown
  Kingdom: Fungi, Phylum: Ascomycota
MRSSITAAAAAASLWTPVTIAQDVGDSSCVDGLFMIVARGTNEDPGPGVTGLIAERIASRIKDSDVVALDYPATFTDPLYTDSVNNGTQELSEVIRNYTESCPDGKMAVFGYSQGAHVSSNVFCGGTGEPFDESAPLPKDLVDEHVISIILFGDPSHVANTTYDIGTSKNDGIFERPNITACEDYKFMKSYCDTGDVYCDSGDIRAVHGGYLEHYGTEVVTDVLKAWNKATDGDVDTDGGPSFGGGSSGNTTETPEATPSATTSSTMTSTQTQTGTETSTETGGSGDGQGGGNEPDAAVGLSAMGSLLVGAPVMMLALWNVL

SEQ ID NO: 2393 - protein, 541 aa, Unknown
  Kingdom: Fungi, Phylum: Ascomycota
MEASIDQRLSQDTVTPEQQQPQTTLDPAHPEPASETGHPVKSHVVDFEDGDTENPKNWSKAYKWYCTMVVALTCFVVAFASSVITADIVGVVDEFNVSEEVALLSISLFVVGFGVGPMAFAPLSEIYGRRIIYASTLLLAVIFIIPCAVAPNIATLLVCRTIDGIAFSAPMTLVGGTLADLWRNEERGVPMAAFSAAPFLGPAIGPLVGGFLSDATNWRWLYWIQLILAGIVWVLISFTVPETYAPTILARRAKKLRTSTGDDSYMTEQELDSRSLSDRLRVFLIRPFQLLFGELIVFLISLYMSVLYGLLYMFFVAFPIIYQKGKGYSAGKTGLMFIPVAVGVVASACCSPWVNKHYMTFVHKHNGKPPAETRLIPMMLSCWFIPIGLFIFAWTSYSELSWAGPAMGGFPVGFGFIFLYNSANNYLVDSYQHQAASALAAKTFIRSFWGAAVVLFTEQMYDRLGDQWASTLIAFISLACCAIPFLFWRYGARIRARSKYAYGGEDEAKDSSDDLEKAADQEAPTARDEALMRAISYVSNP

SEQ ID NO: 2394 - protein, 250 aa, Unknown
  Kingdom: Fungi, Phylum: Ascomycota
MFFKTLIPAFALGASAELIVGLGSSYAEGPGLDQRIGDRLRQKLADNDGSEWTFTNVAVSGSTLGDIVDDQAPKLDGTNPRIAYIVSGGNDLSYATCLGNPSDDACQNSISEDEWKQRYRDVLDSVIQHTDGDRTIFCVTYIRALGANTECPSDDCPMSAEEKEQNDNLYNRVVDYTVNAIDEWKAAGENGNYDVRMIPMRQYSEEHYVGTAEPWINGAQVPDGAGGITWHPNNAGAEAVAQILFESFTS

SEQ ID NO: 2395 - protein, 273 aa, Unknown
  Kingdom: Fungi, Phylum: Ascomycota
MSGSGPAVTDEDFSYITSQDLDDPSLGLPETRPRARSRGARPDPEDDVLLIKNKGVIYPLHFPAYSIGDGKLRVSDVRSRICVEMDLPQRLANRIKLLYKGRQLKDASAPAREYGVKNKSEVMAVLPEGEAAGSTSEEEEEVIVDGTKSRRRKKKKNKKASDKKDNGGSSQAPPPAATGAMGKLDELRAEFTNKWLPMCRDFIAAPPADPKKKDEEHRKISESILQAIVLKLDGIETDGNEEIRARRKAQVKETQAILRELDIAAGKDRPGGI

SEQ ID NO: 2396 - protein, 227 aa, Unknown
  Kingdom: Fungi, Phylum: Ascomycota
MAATTAPLRLGSIAPNFQAETTQGKIDFHEFIGNNWVILFSHPEDYTPVCTTELGAFAKLTPEFEKRGVKLIGLSANTIDSHDGWIKDINEVTGSNLTFPIIGDKSRQVALSYDMIDHQDATNVDSKGIAFTIRSVFVIDPKKTIRTILSYPASTGRNAAEVLRIVDSLQTGDKYKITTPINWVPGDDVIVHPSVSNEQAKELFPEFRIVKPYLRFTPLPKEKATPQ

SEQ ID NO: 2397 - protein, 514 aa, Unknown
  Kingdom: Fungi, Phylum: Ascomycota
MQPYGTTLAVLGSLPFLSGIAEASSTLLWGGTIIAFNNDTNSLEVHRNGSILIEDDRIVEIHDKARPQDDAGEGVVVIDVTGQIVTPGFIDTHRHGWQTGLKTLGSNTTLGEYFGRYGSPASGTDFRAEDVYVGQLAGLYEALNAGVTTIVDHAHHTWTDETSWAGLNASAESSARVFWCYAFENTTNADGPRTVEEQMANFRNIIESDEWKRSPVEIGVAYDSWGPQPDTNERSKVIDLATEHKVPVITTHSLGGPWGVTNMPSDLGGLDILEGDIPIIFSHASFLSPNDRDLLRQNNHYVSITPESEMHYGHTHPHSYLVQDQSALGVDTHFTFSTDILTQARIWLQSTRYRLFNQVVENWRIPRNTPETVNQAFLLATRNGGLALRRHDLGVLNKGAKADLIVWNARESPALLGWNDPVAAVMLHASVGDIFDVMVDGKFVKREGKLVVDGYGEVRERFLASAKRLQDLWANKDYPVLEGQWFAGGSEFGDTLKVDVVSGEGDGYGELFVE

SEQ ID NO: 2398 - protein, 635 aa, Unknown
  Kingdom: Fungi, Phylum: Ascomycota
MNQPSSSPPPNTNDQRRSLSQTSTTVLSNVSAESPDAAKMLSPRNGSSGDGTYQELQDDHLAHEHELSNMNMDANNKLHGSDSDHLATAESITTATTQKPEAPHPRKDLPNWKWQGTLAVCFLTSLVNGYDVSNVANIQPRIYEQFGDIELLPWIGLSYSLAFFACLSFARKILFIFNMRWVLIFFCFIFVIGAAIAGAAPSMTAVIVGRVIMGLAGACIQQCDMSYLAVFATPAESPKLFAILSSCWAIGLVIGGPIGSGFAANVTWRWAFYLNLPWVGICAAIAVACLPSHSLAPSSLSIAQRLRKIDPLGITFNIAAPVLFGIALTFAGPIWAWDDARTITVWVVFGVVFVCWWVQQYFCFFTTPEERAFPLHILPRRDLLPIWVASGCAGASYAIVLYYTPLFFAFVKGASEMDQTVRLLPFILVFIVVVLTTGASLPAIGRYQVIYIMAGILTLAGAAAMASTLDASSPESLVMGLGALIGAGLGMHWQHGASLCNVINKDPRQKVDAIVIFNMSQMGAIAVALAMGGAIFQNVGFRLLSDALAGQNYSDHEIRAALAGVSSRVWESRDPEVLQRGAEAVATVIAREFWIVVAGGALCLVCGLLMKRERLDFGRPQKVKKDTKEVPAETT

SEQ ID NO: 2399 - protein, 526 aa, Unknown
  Kingdom: Fungi, Phylum: Ascomycota
MEKVKLDESARRSYSNRQSQQFTMRFFTYTLCHVLGFAALAGAASSTNSSSVRWVKCPAETPPGVDCGEIKVPLNYKNGSTIEPADNRTVTLGLVRLNSTGNSTRGPLFVNPGGPGAPASLFVAGGAFLPEVGFSKDVMRTYDIIGLDPRGVGSSQPVKCDPKIFNRRVPTFVNSTKTYEALKNQSRDLGGSCAKLTGDLINYLDTIHVAKDHEVLRRAIGAKQFDFFGLSYGSLLGSTYLNLFPKSVGRMALDGIVDHSQSEIGSLLTEAVTYETTLNKFFEWCNNNSSCPLHNNNPKEVFDSLVYNATQKPIPAPGCNDTCQPNVTAEDILYNTQTLLEFVNSTLGPGWYGLAGYIAQAAEGNATGLSTALATSEISSAYSGSPFTYLAIGCQDWKRSANTEQDLQQRLESVMPFAPQTKGATQTYYYQSLCLGWPAKVTYPQQSFNLTMTEKAPAILLSNSMYDPATSIAWANGVREQLPNAVSIIRNGTGHTSHMILGRTRDAIDNYLATGKLPKDGTIYQT

SEQ ID NO: 2400 - protein, 298 aa, Unknown
  Kingdom: Fungi, Phylum: Ascomycota
MAPSNLPSIFNATTQDIEMLLAAQCHLGSKNLQTHMEPYLWKTRQDGVNVLNIGKTWEKIVLAARIIVAIDNPADICVISARPYGQRAVLKFAAHTGASPIAGRFTPGSFTNYITRSFKEPRLIIVTDPRTDAQAIKEASYVNIPVIALCDTDSPTEYVDVAIPTNNKGRHAIGTIWWLLAREVLRLRGTLLDRETPWDTMVDLYFYRDPEAEAEDKVEEEKLPGVDEEGPAAIESGFQQSGGGDWEAPAAGFAGAAATTSNWDAAAAPAAGETADWAASAGQPAGEWANESAKETQW

SEQ ID NO: 2401 - protein, 594 aa, Unknown
  Kingdom: Fungi, Phylum: Ascomycota
MAIASMSATQASRGGQSDYELVDQNDEDTRDSGPHKPAPFAPPARALYRPDHRQRVTTVFLSACVVLLLASTLYFSLPLSFTPHRPGSCPCAPSDVPQYFQTSPQLWPGPTATGAAAFMAQTRTFDPEATYVPNAPLQTSVPIAGMGAANRSIFQMMGYLSPYSPSSGFGVKEYPLPPGADIVQVQMLSRHGSRYPTSGSNVARLGERIAKAGGKLRASKQLEFLNDWEYRLGGEILVPKGRQELFDSGVLHSYMYGSMYNPNSKLIVRTTDRMLKSAENWMAGFFGLEWTNNATIEVIIESKGFNNSLAGSQNCPNAWNRSSNNDALAKWTGIYLKDAQSRLQDMTEGFDWSIEDVYAAQTMCPYETVAYGYSRFCELFTYEEWRDFGYSIDIVFSAGSGFHSPTGRAVGIGYQQEVMARLKNHTLGYSGSNINTTLDSSTETFPLNQTLYFDFSHDTNIVAILTAFGIRQFAEELPADKYPGDHAFTVSNVTPFGARLNMEIIKTPKPLSPARDGYLDGKETKYIHFVLNQRTIPLGKSFPECGPDRVDGWCELETFLKVQEKMPERAKFDYSCFGEYEKEPYGDITDGVPA

SEQ ID NO: 2402 - protein, 328 aa, Unknown
  Kingdom: Fungi, Phylum: Ascomycota
MMISVIYSLLSLWLVLFVCHGLELESDHAQAILLPTNPEYTSHQYVPPWQTSPKPGSLPKALTEDIARINNIDLWYATYGTPLEESLAKGLSPVVFLHGGFANSDYYANQIKYLKDSPYTLIAIDSRAQGRSSDDLEKPITYDLMTQDVIALMDHLHIDRFSTVGWSDGSCISFNLAMNYTTRIDRVFAFGGTYSYKNINETVMDTPTFSKYMEWVRDDYKRLSPSHGSFDSFEERMLAMWSTEPVWSAESFQKVTTLYSDPKNAPIIWIVAGDSEEAVTRSTPHELHSWIWGSSLVMLPSVSHFAMLQDPQTFNIMLERLLQIDRQS

SEQ ID NO: 2403 - protein, 726 aa, Unknown
  Kingdom: Fungi, Phylum: Ascomycota
MRTSSFVISVLGLCASLGLAKDLYVSTAGSHDGDGTQGSPFGSLEKVQEAVRGIIAVANEDILIHFANGVYTLEAPLNLSTPDSGQKGHTVIWKADGDDVLFSGGLKVTGWQKGDDGVYSASVPKGTKSRNLYVNGQASNYARRKIERKDFNYTPSGMTWSDSKYDWLATTNLAGAEVRFINSFTDRYCPIKLAQKNELVMVQEFWGNNIIGWDTVNNPFADFGVWVQNARQLLHEGGQFYLDTDAGLVYYMPLDGEDMGTAETYLGIQETLVSISGQYDDPVHDIAFEGINFAHTTWNAVSQIGYTDQQTGGYIGENKTYPEFEASRPWWWQMPGAIQISAAKNIAFTGGSYTQLGAGGFGIGNDDNAHLSGTGLGAQNISVTEGQFRQVMGNSVTSGGIQAQAHHPDSAAKINREINISNNIFRNNSALFSSTVNILVTYVQYSNITHNDIYQAPYSGICHGYGWGSNDAGGSSEYEKRGLYKYQPLYNTPTTSQNNLILGNLVHSYGLSHTDLAALYTLSKSPSTYINENFNFDSAFGGIYNDEGSNSMIFNYNDLFSSNSWQNLNGVNTANNTYNHNWYLNGPSVDTNNQAGSVSDTDAMGQRVAYRAGIEPLKRAGRPVTNPTDLADGYLGVSCSDGTLILTFWNFDDLIFSDVKFTASADGVSISEKKVPTEIKPDSWDQATYSVSGGGCPNFTAQVSYKNQRTGASKTLVGVNASPPSS

SEQ ID NO: 2404 - protein, 694 aa, Unknown
  Kingdom: Fungi, Phylum: Ascomycota
MGIAQLLQRAAALAVVSYTAFGQAAPSTVESTILIFAPDQYQASNAVSGLNAYGIPSEAIIVPKEGITLPTLKSSEVDGNYGGIIVMNSVTYEYDGGNWRSAITDAQWSVIHEYQKDFNVRMVRLGDSPSTSSGTSAAGGAAGGVDEQFFSFTDTSDFPTAGLKQGATVSSKGFWHVPGQITDTSTTRRIAKYHPSGAFTSDTVAAVINNFDGREQMVFFIPHASDWSQTSNFLQHAFVHWITRGLFVGKRKVHLSMQVDDVQLGTDMYFPQGVTVKIGTSDLQDHITWQQGLSARLPAGSDIVLELAHNGNGDIIAACELPNADQVCDPDEAVDYPYPPDTALEFQKPLGSGTDIWPPALQTYPWTKACCQTDQFAAWFLNPTNRDAFAHLSHTFTHQELNNATYNDADREIHFNQDWMAQMGIDQAARFSPKGLVPPAITGLHNGDAIRAWMDNGLESVVGDNTRPVLRNQDSKYWPLISNVANNGYAGLVIVPRFATMIYYNCHTPACTTKEWEDTSTGASGGWQGLLDLSRTDNTRNLLALQADPYMFHQANMLRGASTMTIGTQTGRLSILMAWAETVVQELIRLTTWPVTSLTHDQTAKYFVDRMTLDACEPRLTYEYATSGSSIASVTLRTKNNNCGVPVPVTLPQGQATVSGGQSSSDQVGSEPLIEWVTMAGSPVVLQLSDPVTV

SEQ ID NO: 2405 - protein, 329 aa, Unknown
  Kingdom: Fungi, Phylum: Ascomycota
MLSVATLVRALALLPAIASAAEKFDYDSLSLREVGARNTLDWRVWLEKDGEPISFWHDIPLYADESKKNIISFYVEIPRWTDAKIETKRNEPLNPIFHDTKDDKPRFVESVWPHKTYPILYGSVPQTWEDPNFDHEYTGFPGDNDPVDLFDVSGIDEGYVGQVKQVKILGALAMVDDDTTDWKVIAIDIRDPVADLVESVEDLEKYRPGLAQSMYDWFIYYKVARGNPTNTIVGGDYVNATTATEVIHESHEYWLDLMKGKTVAKKINREQTSNPRWCKTFVEKEVTTEKFGIPKESKIEPAAKKPEKYEYWYYLDDEFKPIELPGQKM

SEQ ID NO: 2406 - protein, 389 aa, Unknown
  Kingdom: Fungi, Phylum: Ascomycota
MTNKVFAVPIFLVVFRETLETVIIVSVLLAFLKQTLDGPKNDPKVYKALRKQVWLGMLSGFVICLIVAAALIGTFYGVGKDKWQANEYYYEGAFSIFASVIITLVGVGLLRVGQMQEKWRVKLAQAIEAPLKNSKGCGAWFTRATEKYAMFVLPFITILREGIEAILFVSAVSFSAPATAIPLPTVLGLIVGGFVGYLIYKGGATAKLQIFLVVSTCFLYIVAAGLFSRAVWYFEQQKWNNVVGGDAAELGMGPGSYDVDKSVWHVNCCSPEFNGGSGWGILNAIFGWTNSATCGSVISYNVYWIVVITGFLFLRYREARGGLPFVKGGKRSASQSDVRSADLIESDVGVSEKAATTAGGGELLRPSQRLITSKLQRAQLRYFDDNRKT

SEQ ID NO: 2407 - protein, 613 aa, Unknown
  Kingdom: Fungi, Phylum: Ascomycota
MRFSLLPAIAALASAVAAVKVNPLPAPQSICWGKSGPKNVGWLEYRTNGNGAGGENSQLLNDAWNRAYDTMRRLAWVPAAIEEPIPEFEPFPTPGSDAHSKRAETPWLSSVHVQVEDWTADLKHAVDESYTLRIEASSPTVEISAKTVWGAFHAFTTFQQIVISNGQDGLIVEQPVTIKDKPNFPYRGVMIDSARNFISPEKIKEQMNGMALAKLNVLHWHITDNQAWPIEIQAFPEMTKDAYSPREKYSVDVVADLIAYARARAIRVIPEIDMPGHSASGWLQIDEDLITCENSWWSNDDWALHTAVQPNPGQLDVLNPDTYDAVRKVYAELSKRFTDDFFHVGGDELQTNCFNFSKTIRDWFEEDDSRTYSDLNQHWLDHALPIFTSKNITAGKNRRLIMWEDVLLSPNSPAHDVPKDVILQAWNDGSNHVQNITARGHDVIVSSNEFFYLDCGVGGYVTNDARYNDQVNPDLETPNYNYGGGGGSWCAPYKTWQRIYSYDFTANLTAEQEKHVLGVTAPLWSEQIDDSVISSRLWPRGAALGELAWSGNKDPKTGKKRLTQLTQRILNFREYLLANGVGASPLVPKYCLQHPHHCDLWYDQDAVEKDLRL

SEQ ID NO: 2408 - protein, 385 aa, Unknown
  Kingdom: Fungi, Phylum: Ascomycota
MTEDTAATPAKQCMGDECTNDAGGLQCPTCLKLGLKDSFFCSQDCFKKSWNTHKALHKTVQAKSSAYNPYPSFMYTGSVRPVYPLSTMRTVPRAIKHPDWAFTGVPKAEARLSRTKIDILDAKAQEAMRKVCKLSREVLDIVAAEIKPGVTTDYLDEVCHKACVERKSYPSPLNYRGFPKSLCTSVNEVVCHGIPDQRVLLDGDILNLDISIYHEGYHADLNETYYVGDRALADPENIRLIETTREALDLAIALVKPGTPIRDFGPVIEAHARSRGCAVVATWGGHGINTEFHPPPWIPHYAKNKAVGTCKPGMTFTIEPILTLGKPKEVYWPDNWTNTSIDGKRTAQFEHTLLVTETGVEVLTARTATSPGGPVPIPAGAAPGS

SEQ ID NO: 2409 - protein, 448 aa, Unknown
  Kingdom: Fungi, Phylum: Ascomycota
MKVSTMAVLASAGSASALIKDCTGTATNEGGNWFCGAVDHILYSGIKGAGSYQAVTKMTESGECLRESRAYSGPLAPLDQDLSLHFRGPLELEEVAVYYPSSSKKRDVAETSSHVHARRHGHAHFHSERKAKRDMVVATIDGQVVSWENNYFGGAAAPTDAPAPVAAAAVEDAPAAAAPTEDSKPSEASKPKTSNGPVSKLKNKISNAGSAGGDWSRVAYYNANDGVADNLVFLGNYGGEGSGVFDTTWGNSLSYLNSQGTGGCAKPEVLKPGRLPSNKEFSIWSNEPCDESCGYARAEDVAYKGFTGANKVFLFSFKMPMDGDREFNGDMPAIWALNGEISRAAQYSKCSCWTSGCGEADFIEVLAPGDDKCKSTLHLTNGGGSSDYFKRPTDEFVRYAVVFDEKSASMSVRELPSGTDFAEGFDSNTVNSWVEGGKEDLFSLFQMG

SEQ ID NO: 2410 - protein, 304 aa, Unknown
  Kingdom: Fungi, Phylum: Ascomycota
MDNNTEPPRKKARSSGHRLLTHTQVLAIADERPSIIRVRDLQVTLKGPKDAWGRTGKEQPALVSVEVRMREPFGESSEKDEVAGDTVHYGLLAKAIMAKIQKTEQECLMGYIMTLWQRLVGYADLSCIIRYIDEKALLKKEQVAYVRISIKMTKASLLGEGVSMTWAAAFPEDIGTRGMEAAASSMKVHGLRIPTLVGVNANERTAKQIVLANVWVEKMLGVYEDFHPDFEAVVTQAISESSFETLEALAQFVLEKLKAKYAESWKKNVDGTGSGPWLFGIELQKPIAVPFAEAACVELKASAE

SEQ ID NO: 2411 - protein, 931 aa, Unknown
  Kingdom: Fungi, Phylum: Ascomycota
MNEEKVSSAPALDTNIESGGFDEKRAQQHAPATGAPPAKPAPVDDDDEDEDIDALIDDLQSQDGHEFEEEEEEAATPGGGRTVPEDMLKTDSRVGLTESEVEARRRKFGLNQMKEEKENLILKFLSYFVGPIQFVMEAAAVLAAGLEDWVDFGVICGLLLLNAGVGFIQEFQAGSIVDELKKTLALKAVVLRDGTLKEIEAPMVVPGDILQVEEGTIIPADGRIVTEDAFLQVDQSAITGESLAVDKHNGDNCFQSSAVKRGEAFIVVTSTGDNTFVGRAAALVSQSAGGTGHFTEVLHGIGTILLVLVIVTLLVVWVSSFYRSNGIVTILRFTLAITIVGVPVGLPAVVTTTMAVGAAYLAKKKAIVQKLSAIESLAGVEILCSDKTGTLTKNKLSLSEPFCVAGVDPDDLMLTACLAASRKKKGIDAIDKAFLKALRHYPVAKNVLSKYKVLDFQPFDPVSKKVQVTVESPQGERIICVKGAPMAVLNTVAHDHPIPEEIDQAYKNKVAEFATRGFRSLGVCRKREGGSWEILGIMPCSDPPRHDTFRTINEAKNLGLSIKMLTGDAVGIARETSRQLGLGTNVYNSERLGLGGGGDMPGSEVYDFVEAADGFAEVFPQHKYSVVEILQQRGYLVAMTGDGVNDAPSLKKADTGIAVEGASDAARSAADIVFLAPGLGAIIDALKTSRQIFHRMYAYVVYRIALSLHMEIFLGLWIAILNRSLNIELVVFIAIFADIATLAIAYDNAPYSQTPVKWNLPKLWGMSVLLGIVLAIGTWIALTTMYVGGSDGGIVQNFGNIDEVLFLEISLTENWLIFITRANGPFWSSIPSWQLAGAILVVDILATLFCIFGWFVDGPSNRTSIVAVVRIWIFSFGVFCIMGGLYYFMQGSAGFDNLMHGKSPKRNPKQRSLEDFVVSLQRVSTQHEKSQ

SEQ ID NO: 2412 - protein, 437 aa, Unknown
  Kingdom: Fungi, Phylum: Ascomycota
MSWTPAIGSLETWDTVRGYARQPPTTAGGGDRRGLPACGGKLPSRAGSKVVNLDFEARVPVPFSIFPSTYRENDTQVTEQVETEQKLEVNLPQKQPAGREGQHSSSEHRYTEEEVRITREEERYRRPGFKEEHYSREEHRPSHTEYHDTHIEIDTHRQPYASPVDIAEREYRERFRPAARDSCDNDYTVDARFHRPTYHQEVRVCNDTEPARFTTADQKSNMGYYDEDGQYHSFRQGIHKLADRINNPRGREEVDVEVREERSAPMGSSSRTTYRRESSGGNGGNCDSYLPNTVTIPCHHIRIGDFLMLQGRPCQVIKISVSAATGQYRYLGVDMFTKQLHEESSYISNPAPSVVVQTMMGPVFKQYRVLDMSEGYIVAMTENGDVKQSLAVSEQSNLWSRLSRAFDTGRGSVRVLVLNDNGNELAVDMKVMHGSRL

SEQ ID NO: 2413 - protein, 411 aa, Unknown
  Kingdom: Fungi, Phylum: Ascomycota
MFSKVLSTAAVALAASSVVSAQTFTECNPIEKDCKPDPAFGNTKVDCDLTKGPCKAFYELDGTALEYTSEGAVFKIEKETNAPTIATENYMFFGRLEVELNPAPGKGVVTSVVLQSDVLDEIDWEWVGGDVDQVQTNYFSKGDTSTYDRGAYHPVPGAVGTPHVYTIEWTAEKIDWIVNGAIVRTLKASDAKGGSAFPQTPMEVKLGTWVAGRKDAPDGTVEWAGGYTDFSKAPFNAYYKSVKIVDYAGGSGPATGSVRQYVYGDKTGDWESIVVEKGDGPADGQGEDETTSAAATTKSAKPTGTMIEPEEETTTAEETTSSTSERIYTKPKTTIEPSTPVPTTLITPTTTSSDASEETTTTGSGSEESGSGSGAEESTGTDTVGEDAAGSVRVAFGTVAFAGIVALAQLL

SEQ ID NO: 2414 - protein, 619 aa, Unknown
  Kingdom: Fungi, Phylum: Ascomycota
MGFNFRGLTSAALVARSEQNASATNKDVADVPASVLGHTSSNDTPNNVDEKLGGPHDAKAAGESSDEESVDKIDAKAEKGVMQAQGMTMVWTRNELILAYVNVWLLAFMLAFAGSCVGYLTPFVTSSFQYHSLTALTGVISSLISGIWKLPYAKIMNIWGRPFALAIGVTSITMGLIMMAACKNVQTYCAAMTFYYMGYNMIDFSITIFVADTSKLRNRAFFIAFVASPWLITTWVASPATEQMLSENGIGFRWGFGIFAIIIPVVAAPLLFLFVKNNRKARKQGLIPEEPSRGGFTQALKYYVIEFDVAGLLILATGLSLFLLAFNLYSYQAEQWKSPMIICFIVFGFLLIIAFGFWEKHGAPVSFVPWHLLKNRTIIFTYLMAFTLYISWYIWDTYLYSMLIVVFNQPITYAGYINNTYTMGSCTCSLIYGLALRYYGKLKMYSVTLGVPLTILGVGLMIHFRQPDVNIGYIVMCLIFVAFGGGILVISEQTTLMAVSKQQDYPALLATESMIISIGSAIGSTIAGAIWTGVFPKKLMENLPASAMEKFAEIYGDISVQSSYPMGSETRDAINKSYGQAQRYMLISAVCVYIITWGSVFFWENVDVRKQKQRTVGLL

SEQ ID NO: 2415 - protein, 407 aa, Unknown
  Kingdom: Fungi, Phylum: Ascomycota
MAQYGYNGGSNPYDQRDDSGGNYGYGGQQNPYAQQPNPYGQQQQNPYGGQQQNNYAQGGDDGRYGGGNSMEMAPLANNAGPPNSDPNAILNECRDIDSGINTVEQNLEQLRVIQQRTLDDADSSASSQANRQLDALSSETMALYRTLTERVRQVKSSPEARSPRNSAQVGRVDRRLKAAIQQYQQVESQFQKRTRDQMARQYRIVRPEASEQEVRAAVEDTSSGGQVFQQALMQSDRQGRARAALSAVQDRHKALVKIEQQMVELSQLFQDMDTLVVQQEAAVTQIEQKGEEVVDHLDKGNEEMGTAVKTARATRKKKWWCLGICCVIILIIVIVVLIYVFVIKDQNNGSNNKRHILLTPEMMNRVNVPISKPALTLKARNEIGDRPQLTEAARSIMQRVARVGVAI

SEQ ID NO: 2416 - protein, 324 aa, Unknown
  Kingdom: Fungi, Phylum: Ascomycota
MQLSWLADPVRYPTLKSATNHRPSISELQPKPIGNLRHHENALPKLSAKGIITSSEPIASTPRPTTPAAPHLLPPHPRISSLLSTSNCITFTMATLSTASRLALRSAAGVKAPAVRALSSTAVRGADASPSYTSPFKGTEDKGNKIPSFGKYMRGGEGSNKVFQYFMVGTMGALTAAGAKSTVQEFLVNMSASADVLAMAKVEVDLNAIPEGKNVIIKWRGKPVFIRHRTQSEIDQANKVNVSSLRDPQADEERVKQPEWLVMLGVCTHLGCVPIGEAGDFGGWFCPCHGSHYDISGRIRKGPAPLNLEIPEYDFPEEGKLIIG

SEQ ID NO: 2417 - protein, 1077 aa, Unknown
  Kingdom: Fungi, Phylum: Ascomycota
MALPSLRSFVIAAVALLPAFATAQANSSFSEADMIRAQYELMNGRPKDCPPCFNCLLPAHHCSQYSGCNEFNGKCDCPPGFGGDDCLNPLCGSLPKGKDRPMRGRDNCKCDEGWTGINCNVCTSNNACNAMVEPGEGGVCYQNGEVVNQNHQICDVTNKKITSLLGTQRPEVTFTCDSKSETCDFQFWVDQVESFYCHLSDCESSASSTATKNSTSAKCGHISCECIPDRMLCGKDGSIDLGEFLEVSIKGPGSFDCSQKDGGTHNCAFKEPEMDALISSLIGDSSIFLDCRAGECLYETQVPGFKRPINKINTPLIAGVIGGCGLFVVAVIVLVWYLSRRKLRHGAIRLEDSDDESTKLMTDHKPAGLYFEDVAYNLNGKVILSNIQGICHPGEVTAIMGASGAGKTTFLDILARKNKRGNVSGNFFVNGEKVNDANYKNVVGFVDQEDTMLPTLTVHETILNSALLRLPRHMGRAAKEQRVYEVEKELGIHHIRDSLIGSEEGNGRGISGGEKRRVGIACELVTSPSILFLDEPTSGLDAYNAYNVIECLVTLAKTYKRTVIFTIHQPRSNIVALFDRLILLAKGKTVYSGPFSQCQSYFDSIGYECPPGFNIADYLVDLTMHAGNVSYTDDGTIPNDAASVGPSSTRAVKSIASISGGSTGEDSGNEQGSSKRPKNLRKDSVRAQQERALFTRRKTLDTAASSDAGGEAVGSYRLLANPTDSLSSQLPEDLHDLPPSAVSGTDLDTMTKAFAQSGISSNIREEIQQTVTSAGMANGQNGRHGTSINDSAVGRGYARVGYTRQFIILSGRTWKNLYRNPMLMLTHYAIAIILAVFAGYLFYGVTNDIKGFQNRLGLFFFLLALFGFSTLTSLTVFAQERLLFVRERANGYYAPFTYFLAKVLFDIIPLRIIPPILMGAIIYPMVGLIPDSVHFFRFILVLVLFNLAAAAICLFIGIICKDHGVANLLGSLVMLFSLLFAGFLLNQETVPEGAAWLQTLSIFHYGFESLIVNEMIELTVLDKQFGLEIKVPGATVLSTFGFNNAMMWPDIWSLGVFAGVFMVVAYIALHFVLVERR

SEQ ID NO: 2418 - protein, 310 aa, Unknown
  Kingdom: Fungi, Phylum: Ascomycota
MDLVNSLEGRLLFAVPKKGRLNSATLNLLEGADVQFRRENRLDIALVKNLPIALIFLPAADIPTFVGEGQVDLGITGWDQVQEHDAGVRAPHSDPESVPASCEVVMELGFGSCKLQTQVPEKGKYATTQDLVGKSIGTSFVNLARQHFAKLEGVPAGGKLQTKIIELSGSVEAACALGVADGIVDLVESGETMRAAGLKAIDTVVDSTAVLIKSRKPSDTKTVDLIAARIRGVITAQKYVLCQYNIERSRLGEATKITPGKRAATITTLDADGWVAVSSMVEKKKIALTMDDLESVGAQDILVLDIHNTR

SEQ ID NO: 2419 - protein, 474 aa, Unknown
  Kingdom: Fungi, Phylum: Ascomycota
MASRRLALNLSQGLRNRQALSSTTALRRGFASPASVGKTQTSTLPNGLTVATDYSPWAQTSTIGMWIDSGSRAETQETNGTAHFLEHLAFKGTAKRSQQQLELEIENMGGHLNAYTSRENTVYFAKAFNSDVPQCVDIISDILQNSKLEPSAIERERDVILRESEEVEKQVEEVVFDHLHATAFQHQPLGRTILGPRENIRDITRTELTNYIKQNYTADRMVLVNSGGVPHEQIVELAEKHFSGLANKGSENHAALLSKQKADFIGSDVRVRDDTMSTANIAIAVEGVSWDSEDYFTALVAQAIVGNYDKAAGNAPHQGSKLSGYVHKHDLANSFMSFSTSYSDTGLWGIFLVTDKTTRVDDLVHFAIREWMRLCTNVSQAETERAKAQLKASILLSLDGTTAVAEDIGRQLVTTGRRKEPSEIERQIDAITEKDVMDFANRKLWDRDIAISAVGQIEGLFDYQRLRNTMKPKW

SEQ ID NO: 2420 - protein, 743 aa, Unknown
  Kingdom: Fungi, Phylum: Ascomycota
MRWSQAPLLAFAAVASYVAPASAERILRSSSLNTCQEKSSFTASLFNVVYTPNNNSASVEIVATSSVQGHVKFDVTGWAYGYQFLHEVVDPCDMDLAGLCPMVAGKIPLTFALDLPKDAASAIPGIAYDIPDLDAKVRVYVNLTKTGETAACVEAEVSNGKTVDLIGVKWATAVVAGLALMSSAVLSGLGHTNAAAHVAANSLSLFGYFQSQAIIGLTGVQQPPIVQSWTQDFQWSMGIIRVGFMQDIFTWYQRATGGSPASIFDSLTTTSVQVQKRGLEYASAGVDLFKRGIAMTPMAGLMKRANIENGSGGFIVFGIQRVAFRARIETTNLVITGITFFCIFVIATVLAVAAFKGMLELAAKQKWMKNDTFLEFRNGWLTILKGVLFRVALLGFPPLTILCLWEFTQVDSPAIVVLSVVFFFGLLITLAWGASKVIRIARRSVAMHRNPAYILFSDPQALNKWGFLYIQFRASAYYFIVPMLAYTLIKGMFVAFAQRSGVAQAIGFLILEAAALIAASVLRPWMDKPTNSFNIAIYAVNFVNAICLLIFSNVFGAPPLVNGVVGVVLFVLNAAFSLILLLMVIISTCVIFFRKNPDARYQFMADDRASFMKSQTQLNTTTELDALAATARGDKGGYNKSQLDLDDDNDSMISSSLVARRNNDSQASFHQGGPRSPVNPNMPMFPAGRPESPFRSASPSPYNRSGSSLAQQRGVNDASPAGGYRPPPQQGSSPWQRGAGYDH

SEQ ID NO: 2421 - protein, 584 aa, Unknown
  Kingdom: Fungi, Phylum: Ascomycota
MSSTDETNRAPAPALAPRTGGVQKTSGGNSAFHNFHNDFAHVTDLNERRRLALAEIDRAPFGWYHVRACVVAGVGFFTDSYDIFCVSMLTIMLGIVYFGDDKGKMPVSSDSAIKLSTSAGTVVGQLGFGAMADIVGRKRMYGLELIVIIFATLAQALTSGSPACNIVGLIIFWRVIMGVGIGGDYPLSSIITSEFATTKWRGAMMGAVFAMQGIGQLTAALVMLFITLGFKSSLESTPKIAECTGDCQLAVDKMWRILIGFGAVPACIALYYRLTIPETPRYTFDVARDVEQANEDVKAYIHGKHEGSPDEVSRATAHRAAQETLEVPKASWSDFFRHHRKYKNWSLLLGTAGSWFCLDVAFYGLSLNNGTILEVIGYSTKDATSVYKFLYNTAVGNIIIVLAGAVPGYWVSVATIDTLGRKKIQFGGFCILTVLFVIMGFAYNKISSNGLLAIYVLAQFFFNFGPNTTTFIVPGEVFPTRYRSTCHGISAASGKIGSIIGQGAIATLRTRGATADNAAPWMNHVLEIYALFMLLGCVTTYFIPETARKTLEELSGENDYATTVQNTSQNDSLKGEKLNAQSAV

SEQ ID NO: 2422 - protein, 639 aa, Unknown
  Kingdom: Fungi, Phylum: Ascomycota
MPHNNQHHGGLPGLRQLSRQLSWLLLLVWSPFTQAAYDLDINSTESIKKISKSLVEDMLTFYTGDEPGQEPGLLPQPYYWWAAGAMFGTLIDYWYYTGDDSYVNLTSEALLAQVGEHDDYMPKAQVLNEGNDDQGFWGLAVMSAAEYNFPNPPEDEPQWLGLAQAVFNTQASRWDKDHCNGGLRWQIFEWNNGYDYKNSISNGCFFAIAARLALFTGNTSYSDWAEKTWDWMLGVDLIDEKGYVYDGGHIGDNCTKLTRYQWSYNAGVFINGASAMYNMTGEEKWKDRLDLLLDGVKVFFTGPDKNIMTEVACEPVNLCNLDQQSFKAYLSRWLASTTKWVPSTYDFIMPYLRASAIAAVEECTGGDNGRMCGLHWINGTWDGSTGVGQQMNVVEVLMANMVKDRGDAKTAKTGGTSKSDPGAGGNDIGRTIPEGVTYRPLNAGDIVGAIILTILFGGGFIAGIAFIMFDEMSDKTAMQQVRGLRSSAAALFGGGSAAAGAAILQKRDSHNEKGAAGAVISERSSQTSSDGLEITQAPPAFAFGHVRSVSAPDRNQRRLSSMPRGWPHNPSLRASQIYDSSSGRPMSVQPSSSRLSTTEGLGQSASLDRVAPRPTSMQEVQEVQEARNELRRKSIASNR

SEQ ID NO: 2423 - protein, 796 aa, Unknown
  Kingdom: Fungi, Phylum: Ascomycota
MGLSNIVNRFKENSAANVYTTGTESGSGEDIAHADTHLRRVKDQHKWDPYMDLDKINAVEAAIETGDAEKEAAVEQSILQEDSPYFEVRSAVKPTDDPTAYVDTIRAWVIGALVCTVIGSINVLLYEHYTQVSITSSVVQLIAYPLGTGWAKFMPDVKIFGAPLNPGPFNKKEHTLITMMAAAGTVISYSISILIAQEIFYGQSWGWGFQILLIMSTQVMGFGLAGVMRRFLIWPAAMVWPATLITTSVMDALHSGGHGEPANGWTIGRYRFFMILAGATFFWEWIPNCIAPFLSFLGLFPTWIAPHNVAVNQAFGGRNGLGFIPGTLDWSGVAGFFNNPLQFPGFAIWNSIFGAFLILICGYGVAYGGADFYRYLPLSANKNFDNTGMVYNTSRILNDDLTLNVEAYEEYSPLLIGPVFTMAYALGFAALISTVTHVALFYGKDIWRRTKNAKYEEPDIHLKLMRKYPEAPEWWFMSVFAISFGFAMVASQVWDTKLTWWAFILCVIMGVVMILPVGIIQAITSQQTGLNIITEFIVGYMLPGRPVAMMLFKSWGYMLMANGLTFVSDMKVGHYMKVPPRSMFRAQLFAAVWLSLVQIATYNFLLGNIPEFCSETQPQGFICPGATTFYNASVIWGVVGPKRMFGPGALFAWINWFWLIGFLVTVAHYFVARRYPKSIARYIYFPAIFSIGGMIPPATLWNLSNWLLVGALFNIYIYRKYKPWWSRYTYVTAGALDVGNAICLVLFALGLGLSNSAFPTWWGTTVADTTYDAMRMARAKQMPADGSLIGPKPGDW

SEQ ID NO: 2424 - protein, 341 aa, Unknown
  Kingdom: Fungi, Phylum: Ascomycota
MIPKCRVVAKQSDSPFVADFLSTPLRLEYAIMMPVTLVGGISAAVSKTAAAPIERVKLLIQNQLANIRSVTNGSQDEMLKSGRLDRRYAGIGDCFKRTMANEGAMSLWRGNTANVIRYFPTQALNFAFRDKFKKMFGFKKERDGYAKWMAGNLASGGAAGATSMLFVYSLDYARTRLANDSKNAKTGGDRQFNGLIDVYRKTLASDGVAGLYRGFMPSVAGIIVYRGLYFGMYDSFKPLLPAGLSDSFLASFALGWCVTTGAGIAAYPLDTIRRRMMMTSGEAVKYKNSFDAARQIIATSGVKSLFNGAGANILRGVAGAGVLSIYDQLQLLLFGKAFKGA

SEQ ID NO: 2425 - protein, 496 aa, Unknown
  Kingdom: Fungi, Phylum: Ascomycota
MRPYVLLGAAALVASSPAPTGLDFAAIESAPAATGPAIGVASQDSVYDSASAAREANAAASAEVEAHKRSLVERTYCWYDKRYCPSNNNGHHDKPKPPSGGNKPHPPPGHEHEKPHPPPGHEHEKPHPPPGPGHEKPHPPPGPGHEKPHPPPPSSTSCDEPQPQPPTSTSTNCDETTTSATLITTTSAPTTSHEVPSSCTPVSWTNTFAFTTDPACPTPFEVGTYCGFINPEDPCAIQPDGFGPVSSPDTVDAFRNNEVLHNMAKSASDPSGYANTFKDLSAAVNANSYLGYRTLESYDVQGCADWCDDKDLCTAFNIYIERDPKWNPEQCSCDQPDSITNYKCSLWGSGVEPEAANNGGQNRGDFEVAIIGSNGYAKTNETEPETPEGCEKPQKCPAVHDHSSSCIGEHFFPGPYDVSVCAKYAHAHNEKNKHHSKSNHCSFFNAFMIKEDHVAKGTYCKLFTQQYPSKAATWVPGWFKNKWYSIESSWSYCIKA

SEQ ID NO: 2426 - protein, 556 aa, Unknown
  Kingdom: Fungi, Phylum: Ascomycota
MSASEPDIAKPAMNAKSPALWQLQDTVSQPVIAAFCAGGMAGAVSRTVVSPLERLKILMQVQSAGREAYKLSVWQALKKMWVEEGWRGFMRGNGVNCIRIVPYSAVQFSSYNFYKRNIFESYPDAPLAPLTRLVCGGIAGITSVFLTYPLDIVRTRLSIQSASFAELGDRPKQLPGMWATLITMYKNEGGAAALYRGIIPTVAGVAPYVGLNFMVYESVRKYLTPEGDQNPSAGRKLLAGAISGGVAQTCTYPLQEGIRGLYKGIVPNLLKVAPSMASSWLSFEMTRDYLVSLKPEADEASLVDPLGEGRGAHLRVGVAVCPSPNSKFGQSGRSAKFLRLWVWFSCLPFYDHGFRPQPTSSTTFRSRPPNTANMGIDLNRHHVKNTHRSAPKSDNVYLKLLVKLYRFLARRTDSNFNKVVLRRLFMSKINRPPVSLSRIVGNTTKDEKRTIVVVGTITDDNRMLTFPKLTVAALRFTATARARIIAAGGEAITLDQLALRAPTGANTLILRGPKNSREAVRHFGFGPHSHKKPYVQSKGRKFERARGRRRSRGFKV

SEQ ID NO: 2427 - protein, 492 aa, Unknown
  Kingdom: Fungi, Phylum: Ascomycota
MRLSTLFSTAVLVTAHTATASDAHRRLHGHDHLHALEKKHAHGHLEVRATEEAAPAKRGGQCQFPSDDPNLVAVTPGSKNAGWALPPDQACEPDMYCPIACKPGMVMAQWEPDSTYVYPQSMNGGLYCDKSGNIKKPFPNKPNCVPGTGAVKAVNKCGKKMSWCQTVLPGREDMIIPTLVSDSATLAVPGPSYWGSTAAHFYVNPPGTEEKDCVWGDESTAIGNWSPYVAGTNTDSQGLSYVKLGLNPIWIDSPLKSSKPDFGLRIECPDGGCNGLPCSIDISGSSPQIKGLTADTGAGGASFCVVTVPKGSSANIVAYSAGGDGGSDTGSDDSDEAPSEAPKPKPKPSPKPKPSPKPEPVPEPVVEETTSSEPEPEPTSTYTPPPPPPEPTTTEEPESTAEPTTSEEPTTSSSKEERPSYKPGIFRENGTDPTPTFVQVSTSTSEATETETIEEVEEKPETKDEDNEAGRKGGRAPLAGLVIAFVAAACFF

SEQ ID NO: 2428 - protein, 646 aa, Unknown
  Kingdom: Fungi, Phylum: Ascomycota
MASWLTPPVQLTGSRAFTCDGFTEEQCAYYMQRWHFWYIADHVYALPTVAFFMSALGLFIIGHFVSNTAGITSSRGSSLWRRSIAGLRYLSYRGFHIKSLRWNSAPLGLLLLALVGTVFFFCMTLIPQPYCWSTLDFGGSPPLGTRAGWMALACMPFVFLSHNFMSDDSRSISATASKTNWITLLTGVSHERLQVFHRWTAYAFFVLALIHTFPFIVYHVRFHDMEMQWKMSNVFYWTGIVALIFQAWLTFASHSAFRKMGYEFFKMTHYAAAAVFIVIFFFHCDYTLTSWHYFIATAAIYVPCFGFSWIRTLIEHRFAKKAYLQVEDNGFTRITIPVKGHIWTPGQHCFLRFTSFGIQRMSSHPFTICSLPPSARHSDGKSELVFYIRHQRGLTEKLYNHALSDPGVAVPVMVDGPYGGINMQQFGRAGRLLVIAGGSGAGWVLPFVELFTRRHAMLAQSQEEELQQLDQNEKDNFQASSDSSSQEGKLLSNEPTMRVILATRETSSRIWFQQAIAETLSKTSLPGIGSAAVEVQTFVTGKADQEANVGTSQQTPARGMTEGQATDAQSPESPRAPHHGRPDLPSLIQEEAVRAAEADQLLSVFVCGPDTMLQDVRNAVAAENLRVAKGSSRAEVYLHTEHFSWA

SEQ ID NO: 2429 - protein, 262 aa, Unknown
  Kingdom: Fungi, Phylum: Ascomycota
MIANSLLVLATAALAAATPINSGRRLHRRCNGVKPVLPVNGDFQELPAPEAGVRLKKIALGYGIQNYTCAGTDADPVATGALAGLYDLTPFYPNPEDANSLDQETFDRLTAMVIESASENIPLNLLDSLPDRVPNSSPGADLTSPFLPAAALPIPGMDGFELPHVGEHFFDNAGVPTFKLEDGLSIKCAKLDGFNAPLSAAAGANGEAAVAWLRLGAKENTPGTEGLKFVYRVQTGAGSSHGCKEGGKSDSSFYTAAYWFFG

SEQ ID NO: 2430 - protein, 324 aa, Unknown
  Kingdom: Fungi, Phylum: Ascomycota
MGVLARLVVLFPLALSIVGIVLSSLCLFAGHTEDFLEDYDIIRLNTSKIGQDVIPWDELDLGNIVDNLKRDIGDDIRDKWDDLKGDAGDKLDELQDDAKDKANDLTNDVIEQVADRLGISDWYSIHVMSACHGSWEPNATDPSPSLNITNCQDTTPNNPLNLTEMLDKELAVGDLGINLADINWPPEIQEKIDLINDLLLAIFIVYVIGMGFCGLAVLGCIGSLILASSRLLVLFNFVLSGLGALALTIGSIVVTIVGTKGISELNKVAKEVSVHASRGKNFLIISWVAAACMIAAAIFWTTRFCVLCVQKRRDKKMAGRKGSY

SEQ ID NO: 2431 - protein, 567 aa, Unknown
  Kingdom: Fungi, Phylum: Ascomycota
MSDQQYYGGQQPQGQYYPLQTYGGQPQPQQQQYGQQQYGQQQPCGGQQQWQQQQPYGGYQQQQPPPPPPPQDYNQSQPQQQQQAYAPNGGYEGGYDEKHSYDQQFKIEKPKYNDKWAGILLIITFLGFAGISGYAIYGFAKAQSDNGGAIDGGRNNFSLNSNTLILFGIVLAVSFILSLLYLFLARTFPKIFIWVTGILNIVFAIGTAIFYLYQKQYVAGIIFMVFGLFLAFCFYTWISRIPFAALMLTTAIDISKSFGHVYMVSLIGGIVATVFGAWFSVTLVAIYLRWEPGTNNPNCADGGCSKGTVIGLIAFVTFAMYWITEFIKNVIHTIIAGVYGSWYFCVHNFPKDATRAAAKRALTYSFGSISFGSLIVAIIQFLRLVCNAARSSAADEGGIFGMIGYVVFCIIGCLLSLIEWLVEFFNKYAYIHIALYGKAYIPAAKDTWAMMKDRGIDALVNDCLIGPVLSFGGVFIGYATALLAYLYLHFTAPAYNEDGGFTAVIMAFSFLIGLQVCTIFTTPIASGIQTIFVAAGWDPAVMGRDHPELYHKMVQVYPQVQEAIHVR

SEQ ID NO: 2432 - protein, 588 aa, Unknown
  Kingdom: Fungi, Phylum: Ascomycota
MAVGIRSLLLLSSAASFALAQSPAYGQCGGQGWDGPKTCVSGSCCTFSNDWYSQCIPGNCNGGGGGGGVSSSSTTLTTRTSTTSTAGSSNPTQTFTNPVLWEDLADNDVFRVGSDYYYTSSTMHYSPGAPVLHSKDLVNWEYVGHAVPTLDWGNKYNLNGARAYVNGIWASTMRYRKSNGLYYWLGCIDFGTTYVYTAPSPSGPWKLGGKINTCYYDAGMLIDDNDQIYVAYGNSQISVAKLSSDGFSQVSTQQVFSTPSSIGTLEGSRFYKRNGQYYIFLTRPANGQYVIKSSSPQSGYGSANQVLLNLKSPVSGSGIPHQGSLVDTPNGDWYYMAFIDAYPGGRIPVLAPITWTGDGWPTIQTVNNAWGLNYRYPVTPVNLGSTTGKDSFAGTSLGHQWEWNHNPDTNRFSVNNGLSLSAATVTNDLYWARNTLTKRIHGPQGTGTLELDFTNMADGDRAGLALFRDRSAWIGIAKDGSTHKLQYVTGLNLGTGNGWPTQGTGSVSATQSLSGTKVWLRIKADISPGGSKTATFQWSTDGNSFSQLGGSFTMNSDWQFFMGYRYGIFEYATKALGGSVKVVSFTSA

SEQ ID NO: 2433 - protein, 520 aa, Unknown
  Kingdom: Fungi, Phylum: Ascomycota
MKFSSAALVLSTALGTVSAGPVGPKGPKQRRAECCSALAKELDGQVWTPDQQRYTTRLGQYYSANAAQAPWCMVFPESAEDVSKVVTVLEKNDCPFGMRSGAHSAFAGSNGIKDGVTVDFGYMNATTYDEATQVASIGPGSDWGKAYKTLAPYNVVAVGGRADVVGVGGFTTGGGYSFHTGVRGFACDNVVNFEVVTGEGKIVNANKDENSDLWRALKGGSGNFGFVTRIDTEVFPSSEIYASLNLVPFEEKPAVRQVYLDFVNNQDEDPASQIIVASNYAAGEYGCGVILSNIEANENTPSFDDAKQLPTIQSIPATGPAHEVVPIFTGPTPLGLFANWQTGMVDHKLDIMEAIDEIMVEHIEKMRAVVADDAFEMIFQWQPVTPGVVAVMNERGGNPMGLEAITADGPVLMYNIVFTVDTSENQDIVLPIAFEMNDAIQAKADALGRNKHWQFLNYAHGSQDPISHYGAENIAFMQDVSRKYDGKSVFQRLRQTGFHLPGPVGPAGPPGPGGPKGPKN

SEQ ID NO: 2434 - protein, 501 aa, Unknown
  Kingdom: Fungi, Phylum: Ascomycota
MSSLLNAVLATVAIQTVSGSPSTKDACATLSKLFPDDVAVPDSEDYAQSNNYWSTRQAELSPECFVSPRSTEDVSIIIKTLTCAKAPFTVKGGGHSAFEGASNTDGGVTIDLAYLNQITVSEDKSTVSIGPGNRWINVSEALDPQGLAVVGGRVASVGVSGLTLGGGISYFSGKYGWACDNVRNYEVVLSSGKVVNASPEEHEDLYWALRGGGGSNLGIVTRFDLAAFEQGDLWSNTVIFPGPMNQTLIPTFVDLAKNRLPEDIEAHTYFIMAYQPDFGGVITAASFYHATFSDENAVPEVFESFKGLPGSLVDIKSVANVSTQSRAIDEAYGLRQTWWDTTVKITSPELFQKIALLFDAHLATLLAAAGGTTLLPFLVYQPIPTNVLEAMQKNGGNALGLHPDDGPLMIIQLTTKWSDSSIDTVIEESSQKFIADVEKLAEEYDASKGYVYMNYAGKAQDVLRSYGEDNFARLQKIAKKYDPKGHLQRDWTGYFQLGGVE

SEQ ID NO: 2435 - protein, 347 aa, Unknown
  Kingdom: Fungi, Phylum: Ascomycota
MAGPITTGLLMLPSIISVLLGMMSAPAGAQSTCATKGRPEGKVLQGYWENWDGASNGVHPGFGWTPIDDPQIQQHGYNVIMGAFPIILPDGTARWEDGMDSGVVVGSPEDYCAAKAMGATLLLSIGGAAASIDLSSSAVADRFISTIVPILKEYNFDGIDIDIEVGLTGSGNINELSTSQANLIRIIDGVLDQMPANFGLTMAPETAYVTGGSVVYGSIWGAYLPIIKKYADNGRLWWLNMQYYNGEMYGCAGDSYAAGTVQGFIAQTDCLDRGLVIQGTTIRVPYDKQVPGLPAQVGAGGGYMSPGLVAEAWNHYSGALKGLMTWSINWDGSKSWTFGDNVKNLIS

SEQ ID NO: 2436 - protein, 702 aa, Unknown
  Kingdom: Fungi, Phylum: Ascomycota
MSPRESSRPSNRHKHGESSRSKNQHRKRKSQSSRRPISASDESREGDRSSHTLSADALAQLNRTNNKRSRDGAGGSPAKKKTRPERTKKVAREHYRELARDAERERHDRHREKRRGDGKKRRVVSGAVMEEGRVRSGLRGGGQWSEESLEKDYYNTKAPKKRSKKRLWIIGGIILVLIIVIVIVAVVVSQKKSKGNDDNSSSSSGSGDQSSDLDDMDRNSVPSKWKNSYLDPWSWASTTDFNLTFTDETVGDLPVMGLFDKWDDSARANDQVPPLDEDWGSYSKRPARGVNLGGWLSLEPFITPSLFNYDIKDGIIDEWHLCEKLGASKSKTLEDHYASFITEQTFKDIQSAGLDHVRIPFSYWAVQVYEDEPYLFRTSWRYLLRAIEWARKYGIRVNLDLHGMPGSQNGWNHSGKWGTIGWYNGTDGPTNVERSIEVHDRLSKFFSQDRYKNVISHYGLCNEPRMTFLETSDVVAWNEQVYSLVRKNGIKALVVFGDGFMGLNNWKGIMSGYDDMVLDVHQYVIFNENQIDFTHQKKVEYACKGWSDQAELSQDPTRGYGGGTIFAEWSQADTDCTKFLTGVGWGNRWEGTYDTGSPSSSILEPKCPSGDSKCSCAKANADPSDWSDEYKQFLKMFAEAQMHSFEKGWGWWYWTWKTESAPQWSYEAGLKAGVLPAKPWERDFDCDKDVPDFEKMGLDEYY

SEQ ID NO: 2437 - protein, 666 aa, Unknown
  Kingdom: Fungi, Phylum: Ascomycota
MARSRSSLALGFGLLCWLTLLFSPLAFVQTVNAADEADSYGTVIGIDLGTTYSCVGVMQKGKVEILVNDQGNRITPSYVAFTEDERLVGDSAKNQAAANPYNTVFDVKRLIGRKYEEKDVQADLKHFPYKVVNKEGKPIVQVEVDGAKKQFTPEEISAMILGKMKEVAESYLGKKVTHAVVTVPAYFNDNQRQATKDAGIIAGLNVLRIVNEPTAAAIAYGLDKTDGERQIIVYDLGGGTFDVSLLSIDEGVFEVLATAGDTHLGGEDFDQRVINYFAKQYNKKNNVDITKDAKAMGKLKREAEKAKRTLSSQKSTRIEIEAFFEGNDFSETLTQAKFEELNMDLFKKTLKPVEQVLKDANVKKTEIDDIVLVGGSTRIPKVVSLIEEFFSGKKASKGINPDEAVAFGAAVQAGVLSGEEGTEDIVLMDVNPLTLGIETTGGVMTKLIPRNTPIPTRKSQIFSTAADNQPVVLIQVFEGERSMTKDNNILGKFELTGIPPAPRGVPQIEVSFELDANGILKVSAHDKGTGKQESITITNDKGRLTPEEIERMVAEAEKFADEDKATRERIEARNGLENYAFSLKNQVNDDEGLGGKIDDEEKETILDAVKEATEWLEENGAEAATEDFEEQKEKLSNVAYPITSKMYQGGPGGAEGDDDAEIHDEL

SEQ ID NO: 2438 - protein, 840 aa, Unknown
  Kingdom: Fungi, Phylum: Ascomycota
MRSIYALLTTFALGVVATEPAPVALTGSDWLGVDGNWSSISLRVGNPPQDVNLLVSTALSEVWVISSGGCVTNDPTCINARGGVFDSGSSEAWSAMGTWQLGLDYPGYEANGEYGKDKINAHSSIGNGEFSMDGVLVSALNTTNYFNGYFGLGIATGHFDDKVADPAIVQAVKKFGRIPSYTYGFTAGASYRDQPASLTLGGFDKARFVDHSTNFVISQGDDLPHTLVRGIGLSADDSDQVPDAWDSQELSLFSWNDSFTALIDSTTPYLWLPEAVCDELAEYLNLTYDDNFDLYTLSNDRYQDYVESENISLTFSLSSIDNSDDFGSPLDAPGVVNISVPLRAFVGTIQYPFMGGASIDYGDPAVPYFTLRKAPDNETYVIGRSFLQEAYIVTQYDQRQFSVHQARFPKEPIRGAEIETMGQGSNSPYPGPAVSKKSGLTTGAIVGIVVGVVLACVLAFAVWFFYRRRQKARSPTPANSIDEAKDTGSSTTSSTPSTPLARLWSRLRGKSTTGSTVAEKATPVPPAEAAHGEIYELPAPVPPAELDGVDESEMTGETQFGFDGEQNLSPYEQTRRKLERQLQGPVPAYSPPENGFEPPPEKTIPDLAPPQTTRSTNHPLPVSPATGGTNSNSLPNSLPSPISSRTDSNGELTDMVSPVAAEAPPFPPFSAHGSTSPSVSPLDSSSQGRSNGISITRSQSGLPSPMSPPPAGLPHQSAAIQRTPIDPSKVVYLGEMPEHVTFPRRTSLPRINLDNLNSVPQAEAQNLQPSSTLGSNFTEDQESAQNRPSGTATSDRATALRRQDSSEPDSPRSQERIDPGEDLVHVPQMAARRYSWEDSL

SEQ ID NO: 2439 - protein, 388 aa, Unknown
  Kingdom: Fungi, Phylum: Ascomycota
MVHTTYLFMALAAIGVIAGPIQPRTKTLTVPVHSVNNVKSIKGLVEKGQSRIQKVNGAVHFNKDVSSGTVINEDVSYVAPLKIGGSTYNLIVDTGSSNTWCGAQGKCEPSSTGKDTGHSVSVSYGSGSFSGEEYIDNVSFGGLTVKSQSVGAASTATGFNGVDGILGLGPVDLTQGTVSGVSSVPTFLDNLYSQGSISSEVLGVSFRPESGSDTNDANGELTLGGTDSSRYTGSISYFPQLQSGSAAPYWGISIAKFTYGSTTLASSGSGIVDTGTTLIYIPSSAYSKFLSATGGKTDSSSGLAVFSTKPTANFGITFGSQTFTLTPAQYLVPQAQYSFYGLSSGKYYAWINDGGSSGVNTIIGQKFLENYYSVYDTTNARIGFATAA

SEQ ID NO: 2440 - protein, 151 aa, Unknown
  Kingdom: Fungi, Phylum: Ascomycota
MGRLHSNGKGISASALPYSRAPPAWLKTTPDQVVEQICKLARKGATPSQIGVILRDSHGVAQVKIVTGNRILRILKAHGLAPDVPEDLYMLIKKAVSVRKHLERNRKDKDSKFRLILIESRIHRLARYYRTVGVMPPNWKYESATASTMVA

SEQ ID NO: 2441 - protein, 147 aa, Unknown
  Kingdom: Fungi, Phylum: Ascomycota
MALKRINKELTDLGRDPPSSCSAGPVGEDLFHWQATIMGPGDSPYSGGVFFLAIHFPTDYPFKPPKVNFTTRIYHPNINSNGSICLDILRDQWSPALTISKVLLSICSMLTDPNPDDPLVPEIAHVYKNDRPKYEATAREWTRKYAV

(The sequence listing continues in the following parts.)

The invention claimed is:

1. A synthetic combination comprising a purified microbial population in association with a plurality of seeds or seedlings of an agricultural plant, wherein the purified microbial population comprises a first endophyte, wherein the first endophyte comprises a 16S rRNA or ITS rRNA nucleic acid sequence at least 97% identical to a nucleic acid sequence selected from the group consisting of SEQ ID NOs:1-395 and 397-455, and wherein the first endophyte is heterologously disposed to the seeds or seedlings in an amount effective to provide a benefit to the seeds or seedlings or the plants derived from the seeds or seedlings.

2. The synthetic combination of claim 1, wherein the synthetic combination is present within a packaging material selected from a bag, box, bin, envelope, carton, and container.

3. The synthetic combination of claim 1, wherein the purified microbial population further comprises a second endophyte, wherein the second endophyte comprises a 16S rRNA or ITS rRNA nucleic acid sequence that is less than 95% identical to that of the first endophyte.

4. The synthetic combination of claim 1, wherein the purified microbial population further comprises a second endophyte, and wherein the first and second endophytes are independently capable of at least one of production of an auxin, nitrogen fixation, production of an antimicrobial, production of a siderophore, mineral phosphate solubilization, production of a cellulase, production of a chitinase, production of a xylanase, or production of acetoin, or a combination of two or more thereof.

5. The synthetic combination of claim 1, wherein the purified microbial population further comprises a second endophyte, wherein the first and second endophytes are independently capable of metabolizing at least one substrate selected from the group consisting of: a-D-glucose, arabinose, arbutin, b-methyl-D-galactoside, b-methyl-D-glucoside, D-alanine, D-arabitol, D-aspartic acid, D-cellobiose, dextrin, D-fructose, D-galactose, D-gluconic acid, D-glucosamine, dihydroxyacetone, DL-malic acid, D-mannitol, D-mannose, D-melezitose, D-melibiose, D-raffinose, D-ribose, D-serine, D-threonine, D-trehalose, D-xylose, g-amino-N-butyric acid, g-cyclodextrin, gelatin, gentiobiose, glycogen, glycyl-L-aspartic acid, glycyl-L-glutamic acid, glycyl-L-proline, glyoxylic acid, i-erythritol, inosine, L-alanine, L-alanyl-glycine, L-arabinose, L-asparagine, L-aspartic acid, L-galactonic acid-g-lactone, L-glutamic acid, L-glutamine, L-histidine, L-proline, L-rhamnose, L-serine, L-threonine, maltitol, maltose, maltotriose, mannose, N-acetyl-D-glucosamine, oxalic acid, palatinose, pectin, proline, salicin, stachyose, sucrose, trehalose, turanose, tyramine, uridine, and xylose, or a combination of two or more thereof.

6. The synthetic combination of claim 1, wherein the benefit is selected from the group consisting of: increased root biomass, increased root length, increased height, increased shoot length, increased leaf number, increased water use efficiency, increased tolerance to low nitrogen stress, increased nitrogen use efficiency, increased overall biomass, increased grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, a detectable modulation in the transcriptome, and a detectable modulation in the proteome, relative to reference seeds or agricultural plants derived from reference seeds.

7. The synthetic combination of claim 1, wherein the combination comprises seedlings and the first endophyte is contacted with the seedlings as a spray applied to one or more leaves and/or one or more roots of the seedlings.

8. The synthetic combination of claim 1, wherein the first endophyte is present in an amount of at least 10 CFU or spores, at least 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, or at least 1,000,000 CFU spores per seed.

9. The synthetic combination of claim 1, further comprising one or more of the following selected from the group consisting of: a stabilizer, a preservative, a carrier, a surfactant, an anticomplex agent, a fungicide, a nematicide, a bactericide, a insecticide, a herbicide, and any combination thereof.

10. The synthetic combination of claim 1, wherein the first endophyte is present in the synthetic combination in an amount effective to provide a benefit to the seeds or seedlings or the plants obtained from the seeds or seedlings under water limited conditions.

11. The synthetic combination of claim 1, wherein the combination comprises seeds and wherein the benefit is a detectable increase in germination rate of the seeds.

12. The synthetic combination of claim 1, wherein the combination comprises seedlings and the first endophyte expresses one or more genes encoding a protein whose amino acid sequence is at least 95%, at least 96%, at least 97%, at least 98%, at least 99%, or 100% identical to an amino acid sequence selected from the group consisting of SEQ ID NOs: 479, 483, 519, 532, 549, 557, 561, 562, 577, 578, 611, 626, 640, 656, 660, 666, 674, 676, 677, 678, 679, 680, 682, 683, 684, 685, 686, 688, 689, 690, 691, 692, 693, 696, 697, 698, 701, 704, 706, 710, 711, 716, 717, 718, 719, 720, 721, 722, 723, 724, 727, 728, 729, 730, 731, 732, 733, 734, 735, 737, 738, 741, 743, 744, 745, 746, 747, 748, 749, 751, 753, 756, 757, 759, 761, 762, 763, 764, 765, 766, 767, 768, 769, 771, 772, 773, 774, 775, 776, 777, 778, 779, 780, 782, 783, 784, 785, 786, 788, 790, 793, 795, 796, 797, 798, 800, 801, 802, 803, 804, 805, 806, 807, 808, 809, 810, 811, 812, 813, 815, 816, 817, 818, 819, 820, 822, 823, 824, 825, 826, 829, 830, 833, 835, 836, 837, 838, 839, 840, 841, 842, 843, 844, 846, 848, 850, 851, 853, 854, 855, 856, 857, 858, 859, 860, 864, 865, 866, 868, 869, 870, 871, 872, 873, 874, 875, 876, 877, 878, 879, 880, 881, 882, 884, 886, 887, 888, 889, 890, 891, 892, 893, 894, 895, 897, 898, 899, 901, 902, 903, 904, 905, 906, 907, 908, 910, 911, 912, 913, 914, 915, 916, 917, 918, 920, 921, 922, 923, 924, 926, 927, 928, 930, 931, 932, 933, 934, 935, 936, 937, 938, 939, 940, 941, 942, 943, 944, 945, 946, 947, 948, 949, 950, 952, 953, 954, 955, 956, 957, 958, 959, 960, 961, 962, 963, 964, 968, 969, 971, 974, 976, 978, 979, 980, 984, 985, 987, 988, 989, 992, 993, 994, 995, 996, 998, 1000, 1001, 1002, 1003, 1006, 1008, 1010, 1011, 1012, 1014, 1015, 1016, 1017, 1018, 1019, 1021, 1022, 1023, 1024, 1025, 1028, 1029, 1030, 1031, 1032, 1033, 1034, 1036, 1037, 1038, 1040, 1041, 1042, 1043, 1044, 1045, 1046, 1047, 1048, 1049, 1050, 1051, 1055, 1056, 1058, 1059, 1060, 1062, 1064, 1065, 1066, 1068, 1070, 1071, 1072, 1076, 1077, 1079, 1080, 1081, 1083, 1085, 1086, 1087, 1088, 1090, 1091, 1092, 1094, 1095, 1096, 1097, 1098, 1099, 1101, 1102, 1103, 1104, 1106, 1107, 1108, 1110, 1111, 1112, 1113, 1114, 1115, 1116, 1117, 1118, 1119, 1121, 1122, 1123, 1124, 1126, 1127, 1129, 1130, 1131, 1132, 1133, 1134, 1136, 1137, 1138, 1139, 1140, 1142, 1143, 1144, 1145, 1146, 1147, 1148, 1149, 1151, 1153, 1155, 1156, 1157, 1158, 1159, 1160, 1161, 1162, 1163, 1165, 1166, 1167, 1168, 1169, 1170, 1171, 1172, 1174, 1176, 1178, 1179, 1180, 1181, 1182, 1183, 1184, 1185, 1186, 1188, 1189, 1190, 1191, 1192, 1193, 1194, 1196, 1197, 1198, 1199, 1200, 1201, 1203, 1205, 1206, 1207, 1208, 1209, 1210, 1211, 1213, 1214, 1216, 1217, 1218, 1219, 1221, 1222, 1223, 1225, 1226, 1228, 1229, 1230, 1231, 1232, 1233, 1235, 1237, 1238, 1239, 1241, 1242, 1243, 1244, 1245, 1246, 1247, 1248, 1249, 1250, 1251, 1252, 1253, 1255, 1256, 1257, 1258, 1259, 1260, 1261, 1262, 1263, 1264, 1265, 1266, 1267, 1268, 1269, 1270, 1271, 1272, 1273, 1274, 1275, 1276, 1277, 1279, 1280, 1281, 1282, 1283, 1284, 1285, 1286, 1287, 1288, 1290, 1292, 1293, 1296, 1297, 1298, 1300, 1301, 1303, 1304, 1306, 1307, 1308, 1309, 1311, 1312, 1313, 1314, 1317, 1319, 1320, 1321, 1322, 1323, 1324, 1325, 1326, 1327, 1328, 1330, 1331, 1333, 1334, 1335, 1336, 1337, 1338, 1339, 1340, 1341, 1342, 1343, 1344, 1345, 1346, 1347, 1348, 1350, 1351, 1352, 1353, 1355, 1356, 1357, 1358, 1359, 1360, 1361, 1362, 1363, 1364, 1365, 1366, 1368, 1369, 1370, 1371, 1372, 1374, 1375, 1376, 1379, 1380, 1382, 1383, 1384, 1385, 1386, 1388, 1389, 1390, 1391, 1392, 1393, 1396, 1397, 1398, 1399, 1400, 1402, 1403, 1404, 1405, 1406, 1407, 1408, 1409, 1410, 1411, 1412, 1413, 1414, 1415, 1416, 1417, 1418, 1419, 1420, 1421, 1422, 1424, 1425, 1426, 1427, 1428, 1430, 1431, 1432, 1433, 1437, 1438, 1439, 1440, 1441, 1442, 1443, 1444, 1445, 1446, 1447, 1448, 1449, 1450, 1452, 1453, 1456, 1459, 1466, 1467, 1469, 1471, 1478, 1479, 1482, 1483, 1484, 1485, 1487, 1488, 1489, 1490, 1495, 1497, 1498, 1499, 1500, 1501, 1504, 1505, 1506, 1508, 1511, 1513, 1514, 1516, 1520, 1526, 1529, 1534, 1535, 1537, 1538, 1540, 1545, 1547, 1548, 1549, 1550, 1551, 1552, 1553, 1554, 1556, 1559, 1561, 1562, 1565, 1566, 1568, 1569, 1570, 1571, 1573, 1574, 1575, 1576, 1577, 1578, 1579, 1580, 1581, 1582, 1583, 1585, 1588, 1589, 1591, 1592, 1593, 1594, 1595, 1596, 1597, 1598, 1601, 1603, 1604, 1605, 1607, 1608, 1609, 1611, 1612, 1613, 1614, 1615, 1616, 1617, 1618, 1619, 1620, 1622, 1624, 1625, 1626, 1627, 1628, 1629, 1630, 1632, 1633, 1636, 1637, 1638, 1639, 1640, 1641, 1642, 1643, 1644, 1646, 1647, 1648, 1650, 1651, 1652, 1654, 1657, 1659, 1660, 1661, 1664, 1665, 1666, 1667, 1668, 1671, 1673, 1675, 1676, 1678, 1679, 1681, 1684, 1685, 1686, 1689, 1690, 1692, 1693, 1694, 1695, 1696, 1697, 1698, 1701, 1705, 1706, 1707, 1709, 1711, 1712, 1713, 1714, 1716, 1717, 1718, 1720, 1721, 1723, 1724, 1725, 1726, 1728, 1729, 1731, 1732, 1734, 1735, 1736, 1737, 1738, 1739, 1740, 1741, 1743, 1744, 1745, 1746, 1747, 1750, 1751, 1753, 1754, 1755, 1760, 1761, 1762, 1763, 1764, 1765, 1767, 1770, 1771, 1772, 1775, 1776, 1777, 1778, 1779, 1780, 1781, 1782, 1786, 1787, 1788, 1789, 1791, 1792, 1793, 1794, 1795, 1797, 1798, 1799, 1800, 1801, 1803, 1804, 1805, 1806, 1809, 1810, 1811, 1814, 1815, 1818, 1819, 1820, 1821, 1822, 1823, 1824, 1825, 1826, 1828, 1830, 1831, 1833, 1835, 1836, 1837, 1838, 1839, 1840, 1841, 1842, 1843, 1846, 1851, 1852, 1854, 1857, 1858, 1860, 1861, 1862, 1863, 1864, 1866, 1868, 1869, 1870, 1872, 1873, 1874, 1875, 1876, 1878, 1879, 1880, 1881, 1883, 1884, 1885, 1887, 1888, 1892, 1893, 1894, 1896, 1898, 1899, 1900, 1901, 1902, 1903, 1904, 1905, 1906, 1907, 1910, 1911, 1913, 1915, 1916, 1917, 1918, 1920, 1921, 1924, 1925, 1926, 1927, 1928, 1930, 1932, 1933, 1934, 1935, 1938, 1939, 1940, 1942, 1943, 1945, 1946, 1948, 1949, 1950, 1951, 1953, 1954, 1955, 1959, 1960, 1961, 1962, 1963, 1965, 1966, 1967, 1970, 1971, 1973, 1975, 1976, 1977, 1979, 1981, 1982, 1983, 1984, 1985, 1986, 1988, 1990, 1994, 1995, 1996, 1998, 1999, 2000, 2001, 2002, 2003, 2006, 2007, 2008, 2009, 2010, 2011, 2013, 2014, 2015, 2016, 2017, 2018, 2019, 2020, 2021, 2022, 2024, 2025, 2026, 2027, 2028, 2029, 2030, 2031, 2032, 2034, 2035, 2036, 2037, 2038, 2039, 2040, 2041, 2042, 2043, 2044, 2045, 2046, 2047, 2048, 2049, 2050, 2052, 2054, 2055, 2059, 2060, 2062, 2065, 2066, 2067, 2068, 2069, 2070, 2071, 2074, 2076, 2077, 2080, 2081, 2082, 2083, 2085, 2086, 2087, 2088, 2089, 2090, 2091, 2092, 2093, 2095, 2096, 2097, 2098, 2100, 2101, 2102, 2103, 2104, 2105, 2108, 2109, 2110, 2112, 2113, 2115, 2116, 2117, 2118, 2119, 2120, 2121, 2125, 2127, 2128, 2129, 2131, 2132, 2134, 2135, 2136, 2138, 2140, 2141, 2142, 2143, 2145, 2146, 2147, 2148, 2149, 2150, 2153, 2154, 2155, 2156, 2158, 2159, 2160, 2162, 2163, 2165, 2166, 2167, 2168, 2169, 2170, 2171, 2172, 2174, 2176, 2177, 2179, 2180, 2181, 2182, 2183, 2184, 2185, 2186, 2188, 2190, 2191, 2192, 2193, 2194, 2195, 2196, 2197, 2198, 2200, 2202, 2204, 2205, 2206, 2207, 2208, 2210, 2211, 2212, 2214, 2215, 2216, 2217, 2218, 2219, 2220, 2221, 2222, 2223, 2225, 2226, 2227, 2228, 2229, 2230, 2231, 2232, 2233, 2234, 2235, 2236, 2238, 2239, 2241, 2242, 2243, 2244, 2245, 2246, 2248, 2249, 2251, 2253, 2254, 2255, 2257, 2258, 2259, 2261, 2262, 2265, 2267, 2268, 2269, and 2270; wherein protein expression is modulated in response to the first endophyte contacting the seedlings.

13. A method for preparing a seed comprising an endophyte population, said method comprising heterologously disposing to an exterior surface a seed formulation comprising an endophyte population comprising an endophyte comprising a 16S rRNA or ITS rRNA nucleic acid sequence at least 97% identical to a nucleicacid sequence selected from the group consisting of SEQ ID NOs: 1-395 and 397-455 in an amount effective to provide a benefit to the seed or plant derived from the seed.

14. The method of claim 13, wherein the endophyte is capable of a function or activity selected from the group consisting of auxin production, nitrogen fixation, production of an antimicrobial compound, mineral phosphate solubilization, siderophore production, cellulase production, chitinase production, xylanase production, and acetoin production.

15. The method of claim 13, wherein the benefit is selected from the group consisting of: increased root biomass, increased root length, increased height, increased shoot length, increased leaf number, increased water use efficiency, increased tolerance to low nitrogen stress, increased nitrogen use efficiency, increased overall biomass, increased grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, a detectable modulation in the transcriptome, and a detectable modulation in the proteome, relative to reference seeds or agricultural plants derived from reference seeds.

16. The method of claim 13, wherein the formulation comprises at least one member selected from the group consisting of an agriculturally compatible carrier, a tackifier, a microbial stabilizer, a fungicide, an antibacterial agent, an herbicide, a nematicide, an insecticide, a plant growth regulator, a rodenticide, and a nutrient.

17. The method of claim 13, wherein the seed is contacted with at least 10 CFU or spores, at least 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, at least 1,000,000 CFU or spores, or more, of the endophyte.

18. The method of claim 13, wherein the formulation comprises at least two endophyte populations comprising a nucleic acid sequence that is at least 97% identical, at least 98% identical, at least 99% identical, at least 99.5% identical, or 100% identical, to a nucleic acid sequence selected from the group consisting of SEQ ID NOs: 1-395 and 397-455, wherein the at least two endophyte populations are present in the formulation in an amount effective to colonize the mature agricultural plant.

19. The method of claim 13, wherein the plant is a monocot.

20. The method of claim 19, wherein the monocot is selected from the group consisting of corn, wheat, barley and rice.

21. The method of claim 13, wherein the plant is a dicot.

22. The method of claim 21, wherein the dicot is selected from the group consisting of a soybean, peanut, canola, cotton, *Brassica Napus*, cabbage, lettuce, melon, strawberry, turnip, watermelon, tomato and pepper.

23. The method of claim 13, wherein the endophyte is present in the formulation in an amount effective to increase the biomass and/or yield of the fruit or seed produced by the plant by at least 1%, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with the fruit or seed of a reference agricultural plant.

24. The method of claim 13, wherein the endophyte is present in the formulation in an amount effective to detectably increase the rate of germination of the seed.

25. The method of claim 13, wherein the benefit to the seeds or seedlings or the plants derived from the seeds is conferred under water limited conditions.

26. The method of claim 13, wherein the plant derived from the seed is a soybean plant in water limited conditions and the plant expresses one or more genes whose nucleic acid sequence is at least 95%, at least 96%, at least 97%, at least 98%, at least 99%, or 100% identical to a nucleic acid sequence selected from the group consisting of SEQ ID NOs: 4131, 4140, 4142, 4150, 4153, 4162, 4167, 4181, 4183, 4184, 4195, 4199, 4201, 4206, 4213, 4222, 4223, 4250, 4253, and 4269, wherein the one or more plant genes are modulated in response to the first endophyte contacting the plant as compared to a reference microorganism contacting the plant.

27. A method for modulating a plant trait comprising heterologously disposing to vegetation or an area adjacent the vegetation, a formulation comprising an endophyte population comprising an endophyte comprising a 16S rRNA or ITS rRNA nucleicacid sequence at least 97% identical to a nucleicacid sequence selected from the group consisting of SEQ ID NOs: 1-395 and 397-455, wherein the formulation is capable of providing a benefit to the vegetation, or to a crop produced from the vegetation.

28. The method of claim 27, wherein the plant is a soybean plant in water limited conditions and the plant expresses one or more genes whose nucleic acid sequence is at least 95%, at least 96%, at least 97%, at least 98%, at least 99%, or 100% identical to a nucleic acid sequence selected from the group consisting of SEQ ID NOs: 4131, 4140, 4142, 4150, 4153, 4162, 4167, 4181, 4183, 4184, 4195, 4199, 4201, 4206, 4213, 4222, 4223, 4250, 4253, and 4269, wherein the one or more plant genes are modulated in response to the endophyte contacting the plant as compared to a reference microorganism contacting the plant.

* * * * *

UNITED STATES PATENT AND TRADEMARK OFFICE

CERTIFICATE OF CORRECTION

PATENT NO. : 10,667,523 B2
APPLICATION NO. : 15/540961
DATED : June 2, 2020
INVENTOR(S) : Ambrose et al.

It is certified that error appears in the above-identified patent and that said Letters Patent is hereby corrected as shown below:

In the Claims

In Column 498, Claim 27, Line 48, delete "nucleicacid" and insert -- nucleic acid --, therefor.

In Column 498, Claim 27, Line 49, delete "nucleicacid" and insert -- nucleic acid --, therefor.

Signed and Sealed this
Twenty-second Day of December, 2020

Andrei Iancu
*Director of the United States Patent and Trademark Office*